United States Patent 7,745,391 (HUMAN THROMBOSPONDIN POLYPEPTIDE) - sequence listing, part 54

SEQ ID NO: 163028 - DNA, 1907 bp, Homo sapiens
atagaagataatccccttatattttatacacatatatataggcatgtatatattgtatattcatgtgtgcatgatgttgtgtgtgtacgtatatatttcttcttctggtctgaatgttgcctaaacctctaccattgatgctccatctcttcgctataaagccatcttctattaaaataaacataaccctgcctggacgggtgaacacattggctcttggttgaaagtcagctaagcaggtgccctctgggtgatgtggctcagactctccatttacatttcaaatttttccatttcaaaattgggaaagaaaaactattactttgttcatcacaaaaaacgtgccccctgcctgtggaacctcaggccccagaccccaggcccagttgcaagacccccaaatgcaaggccaccgctcctcattgccccctcgtgtgttccggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163029 - DNA, 1427 bp, Homo sapiens
gcaacatatgacgcactctcccctgaactctacacaacatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163030 - DNA, 2601 bp, Homo sapiens
atccttaattaaattaattcttccccccccgggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgacatctagtcggctaccagagggatcctcggggcaatccgaaccgtaagacgggctttgaacagttctcggaatgagaatacggataacgcccagcggtaccaaacaagtagaaccggaagactaaagcggggcgacaggcaattgcgctcgcggaaagacagcgccacaggagcacaccacgagacagggctccttcggcctctcc

SEQ ID NO: 163031 - DNA, 671 bp, Homo sapiens
aggtcgtctagaggatcccagaggaggtggactgcacagtgaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163032 - DNA, 1559 bp, Homo sapiens
atccttaattaaattaattcttccccccccgggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacaattcccggcgtttcaactaacctcctcggactcctgcctcactcatttacaccacccacccaactatctatatacctagccatggccatccccttatgagcgggcgcagtgattatagcctttcgctctaagattaaaaatgccctagcccacttcttaccacc

SEQ ID NO: 163033 - DNA, 423 bp, Homo sapiens
acacggctcacaaagcggtgggaaattccagtgatggcattgtttgttggctggttccttttatccaaatggagacaagacacatttccgcaggactgtccacctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163034 - DNA, 3619 bp, Homo sapiens
ctcgcgaacgtgttatccgggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163035 - DNA, 3837 bp, Homo sapiens
aaccagaactccagagagggaaaacatctatcttgctgtgtttggacaggccagcccctgaaacatcttgggcaatggagggttaacttctcaaagtttaataggcaagaccagcaaccatgcaacaaggacttcaactaaccaactaaagaactgttccccagagcattgttcctgagaaggaaaagagtccaaacacctacccacacctgctttgtgccaagaatccacagttggattgcaaggacagtgcgttcaagacccagctgttgagagtagaaaagcagaagaaaggacccgaggtcagcaagtgccctccccacaatggggcagatctgccagcgagaatcggctacagcagctgaaaaaccaaaacttcatctacttgctgaaagtgagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163036 - DNA, 3949 bp, Homo sapiens
aaccagaactccagagagggaaaacatctatcttgctgtgtttggacaggccagcccctgaaacatcttgggcaatggagggttaacttctcaaagtttaataggcaagaccagcaaccatgcaacaagacagagtctcgcactgtcacccaggctggagagatctcggctcactgtaagctccgcctcctgggctcacgccattctcctgcctcagcctcccaagtagctgggactacaggacttcaactaaccaactaaagaactgttccccagagcattgttcctgagaaggaaaagagtccaaacacctacccacacctgctttgtgccaagaatccacagttggattgcaaggacagtgcgttcaagacccagctgttgagagtagaaaagcagaagaaaggacccgaggtcagcaagtgccctccccacaatggggcagatctgccagcgagaatcggctacagcagctgaaaaaccaaaacttcatctacttgctgaaagtgagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163037 - DNA, 3660 bp, Homo sapiens
atccttaattaaattaattcttccccccccgggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaaaaaaaaaagaaacggaaacaaacaacggg

SEQ ID NO: 163038 - DNA, 4377 bp, Homo sapiens
atccttaattaaattaattcttccccccccgggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaaaaaaaaaaaaaaacaaaaaaaaaaaaaaaaaaaaaaaaaaaaaagaaaaagaaaaataaataaaataaaagaaaaaaaaaaaataaaaaaataaaaaataaagaagaaaataaaatcacaataaaatatataaaagaaattggacagtcataatgacagacaggagagtcgaggagtagtgaatgcacgatatgaagagcctggtaaagattatcgagctcctcgtactgcaagtctgaaatagggcccagcatagagggtgataaagaagaacatctctatgaactggaccagtaaaagtgtatgcatatgtttaacgaaacaagcatatatggacatctggataaacatgaacctttacaaaatgcgtaaaaactataaaaactaatatacggagacacgttactgaaaaaaagaattcgtcatcagatgcatcctgagttgttacaccctttaatcacacttgattgcacccggtcagagggccctcactgaaccaattacttgaggtacagtaaaaatatggttaaaaacttaacaatggtccaaacaacatcccagatctatcccttagcgccaaacgttcattaataacgcgggaagacctggtggattcataggacagaattgagccacactgaacctttggatcaaggtacagtactcaggggtataaaaccatttatatcttcctttcattgccccaaggacgtggtatttttggtgaaagaaggtctcatacatat

SEQ ID NO: 163039 - DNA, 4111 bp, Homo sapiens
  misc_feature (4111)..(4111): n is a, c, g, or t
atccttaattaaattaattcttccccccccgggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaaaaaaaaaaaaaaaaaaaaaaaaaaaaggggggggcgcggccaaaaatttcccccggggggcccccaggttccgggttcccccaggttttgttggtcaccaagggtgcgcccctatatggggggcgccgatataattacgcgcttagggcacgggcgccggctgttttaacccaaccggtcggacgctggggagaaccccgtggaacccttggcgggaccctttgggcggaagagacccctttatttcggggggggggcgagacatatattggggagaaaaaattatccccttatcaaagagatttttaaagcgcctcaagggggaaaattttttaaaaatttctaagggtgttataacgggggcttaaaacacctaaaggctcgacattgaggccaggacggcctgaaaagtttggggcctacccgggagctattgcctttagaaaacatttttttaccacgggggccgcggttgaatan

SEQ ID NO: 163040 - DNA, 3750 bp, Homo sapiens
atccttaattaaattaattcttccccccccgggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcagcagtgggtcgtccgtggccatcgtgcgtgcaccgtttcgtgtgccgcaccttaacaagtgggagttcattcaaagaaggggcgcgcggaaaagggggaattggcacgtttcattgtggggggccttttacaaacggattttcctttccgagtttttcttccgccgccctttggacccccaaagaccaaaggaaacccttgaatggcttccctaagggagccgctggcggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163041 - DNA, 3663 bp, Homo sapiens
atccttaattaaattaattcttccccccccgggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttggggtttggccccttgcccccccaaatttttttgttttggggggggggaaggaaccaaccaacaaacaatgccatcactggaatttcccaccgctttgtgagccgtgtcgtatgacctagtaaactttgtaccaattcaaa

SEQ ID NO: 163042 - DNA, 2006 bp, Homo sapiens
gtcgtgactggaggcattggaatggcgcggcgaagatgcaggcctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163043 - DNA, 3194 bp, Homo sapiens
atccttaattaaattaattcttccccccccgggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaagacaccccaggcccctcctcctgtctcaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163044 - DNA, 3381 bp, Homo sapiens
atccttaattaaattaattcttccccccccgggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactgtgaagtcggcctgatcatcggcactggcaccaatgcttgctacatggaggaactgaggcacattgatctggtggaaggagacgaggggaggatgtgtatcaatacagaatggggagcctttggagacgatggatcattagaagacatccggacagagtttgacagggagatagaccggggatccctcaaccctggaaaacagctgtttgagaagatggtcagtggcatgtacttgggagagctggttcgactgatcctagtcaagatggccaaggagggcctcttatttgaagggcggatcaccccggagctgctcacccgagggaagtttaacaccagtgatgtgtcagccatcgaaaagaataaggaaggcctccacaatgccaaagaaatcctgacccgcctgggagtggagccgtccgatgatgactgtgtctcagtccagcacgtttgcaccattgtctcatttcgctcagccaacttggtggctgccacactgggcgccatcttgaaccgcctgcgtgataacaagggcacacccaggctgcggaccacggttggtgtcgacggatctctttacaagacgcacccacagtattcccggcgtttccacaagactctaaggcgcttggtgccagactccgatgtgcgcttcctcctctcggagagtggcagcggcaagggggctgccatggtgacggcggtggcctaccgcttggccgagcagcaccggcagatagaggagaccctggctcatttccacctcaccaaagacatgctgctggaggtgaagaagaggatgcgggccgagatggagctggggctgaggaagcagacgcacaacaatgccgtggttaagatgctgccctccttcgtccggagaactcccgacgggaccgagaatggtgacttcttggccctggatcttggaggaaccaatttccgtgtgctgctggtgaaaatccgtagtgggaaaaagagaacggtggaaatgcacaacaagatctacgccattcctattgaaatcatgcagggcactggggaagagctgtttgatcacattgtctcctgcatctctgacttcttggactacatggggatcaaaggccccaggatgcctctgggcttcacgttctcatttccctgccagcagacgagtctggacgcgggaatcttgatcacgtggacaaagggttttaaggcaacagactgcgtgggccacgatgtagtcaccttactaagggatgcgataaaaaggagagaggaatttgacctggacgtggtggctgtggtcaacgacacagtgggcaccatgatgacctgtgcttatgaggagcccacctgtgaggttggactcattgttgggaccggcagcaatgcctgctacatggaggagatgaagaacgtggagatggtggagggggaccaggggcagatgtgcatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccacctccgccatcccctggtcccctgacactggggttgtatgttaaaaaaaagtaataaaagaattt

SEQ ID NO: 163045 - DNA, 1542 bp, Homo sapiens
cacacagggagggggtaccccaaggatgggctttggaggcccagaaggcctgtcaggtggtgtgattttccatctccagccaataaataactctgttggatgaatgcatacattagaaatggatgccactacacttcacacgtgggggaccagatcaacatggagtggggggcctttggggacaacgggtgtctggatgatatcaggacacactacgacagactggtggacgaatattccctaaatgctgggaaacaaaggtatgagaagatgatcagtggtatgtacctgggtgaaatcgtccgcaacatcttaatcgacttcaccaagaagggattcctcttccgagggcagatctctgagacgctgaagacccggggcatctttgagaccaagtttctctctcagatcgagagtgaccgattagcactgctccaggtccgggctatcctccagcagctaggtctgaatagcacctgcgatgacagtatcctcgtcaagacagtgtgcggggtggtgtccaggagggccgcacagctgtgtggcgcaggcatggctgcggttgtggataagatccgcgagaacagaggactggaccgtctgaatgtgactgtgggagtggacgggacactctacaagcttcatccacacttctccagaatcatgcaccagacggtgaaggaactgtcaccaaaatgtaacgtgtccttcctcctgtctgaggatggcagcggcaagggggccgccctcatcacggccgtgggcgtgcggttacgcacagaggcaagcagctaagagtccgggatccccagcctactgcctctccagcacttctctcttcaagcggcgaccccctaccctcccagcgagttgcgctgggagacgctggcgccagggcctgccggcgcggggaggaaagcaaaatccaactaatggtatatattgtagggtacagaatagagcgtgtgctgttgataatatctctcacccggatccctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163046 - DNA, 827 bp, Homo sapiens
  misc_feature (167)..(167): n is a, c, g, or t
  misc_feature (275)..(275): n is a, c, g, or t
tcatctccaacagagttattattggctggagatggaaaatcacaccacctgacaggccttctgggcctccaaagcccatccttggggttccccctccctgtgtgaaatgtattatcaccagcagacactgccgggcctccctcccgggggcactgcctgaaggcgantgtgggcatagcattagctgcttcctcccctcctggcacccactgtggcctggcatcgcatcgtggtgtgtcaatgccacaaaatcgtgtgtccgtggggtaggaggncaagacctcctcacttgccctgccactttgcatggtttgattttgacctggtcccccacgtgtgaagtgtagtggcatccatttctaatgtatgcattcatccaacagagttatttattggctggagatggaaaatcacaccacctgacaggccttctgggcctccaaagcccatccttggggttccccctccctgtgtgaaatgtattatcaccagcagacactgccgggcctccctcccgggggcactgcctgaaggcgagtgtgggcatagcattagctgcttcctcccctcctggcacccactgtggcctggcatcgcatcgtggtgtgtcaatgccacaaaatcgtgtgtccgtggaaccagtcctagccgcgtgtgacagtcttgcattctgtttgtctcgtggggggaggtggacagtcctgcggaaatgtgtcttgtctccatttggataaaaggaaccaaccaacaaacaatgccatcactggaatttcccaccgctttgtgagccgtgtcgtatgacctagtaaactttgtaccaattcaaa

SEQ ID NO: 163047 - DNA, 828 bp, Homo sapiens
atccttaattaaattaattcttccccccccgggaggagccgccgagcagccgccggaggaccacggctcgccagggctgcggaggaccgaccgtccccacgcctgccgccccgcgaccccgaccgccagcatgatcgccgcgcagctcctggcctattacttcacggagctgaaggatgaccaggtcaaaaagattgacaagtatctctatgccatgcggctctccgatgaaactctcatagatatcatgactcgcttcaggaaggagatgaagaatggcctctcccgggattttaatccaacagccacagtcaagatgttgccaacattcgtaaggtccattcctgatggctctgaaaagggagatttcattgccctggatcttggtgggtcttcctttcgaattctgcgggtgcaagtgaatcatgagaaaaaccagaatgttcacatggagtccgaggtttatgacaccccagagaacatcgtgcacggcagtggaagccagctttttgatcatgttgctgagtgcctgggagatttcatggagaaaaggaagatcaaggacaagaagttacctgtgggattcacgttttcttttccttgccaacaatccaaaatagatgaggccatcctgatcacctggacaaagcgatttaaagcgagcggagtggaaggagcagatgtggtcaaactgcttaacaaagccatcaaaaagcgaggggactatgatgccaacatcgtagctgtggtgaatgacacagtgggcaccatgatgacctgtggctatgacgaccagcactcaacgcctcactacaacgcctgggacct

SEQ ID NO: 163048 - DNA, 934 bp, Homo sapiens
ctgtcttaccactttgtaggagttctttatgaatatcagatacgagtcctttgttggttataggtattgcaaatatttctatgagtaaataaatacaaaagcccttggttttggtgtcttctgaagtgtcagggccactggaacaagaatataatctctatatctattttgatcactagtgtaaacccagctcctggcacatagtaggtacttaataaatatgttgaatgaatgatggatgaggtggataaagctgatgtaggtactttgctctgtattgtgctgatccctagagtcaaacaccaagaggacctgggggaagcagatttcctctggcttagccagctgtgaccttaggaagaggaagacatcctggcccttctctactgaaagagcagaaatagctacagtctgtgaaatgatgagcacagatgtagggagcggaggtcacagatgaaaagacaggaactaccagcaagtagcaggccagccagatacttcagaaggagagacgcagttgggggtatcaaaaagatagtgagggtctctgagcatcactgtggacctttgtatgacaagaacctccaaaggtcatgtggactctctcttgcctcaagacatgcccagtctttgagcttgttagccaagagagctcttccacacctagaaacacatttctttctccaaaggaggttccctgaaactttggttggagggtcttattcctaacctgcattgggcaactctttttttaaaatcagctttaacttcctcatggcctgtaatgtccatcctgaatatggaagaccaccgaatcagcctcttctccatgcactgttttcataggcctgttgcattctacagcgtttttctcttgctgtgtttctctccagcatccttgaccagctctggtcaagagtctcactgattcctg

SEQ ID NO: 163049 - DNA, 173 bp, Homo sapiens
ctgccgtgttcagtcccaaggtgtacagaggtggagagcttccagtttagccccaggtcctgtgtgccctgaaggcacaatctccctcacaccctggggccccactcccctcagccagccggctgttgcgcttcccatctgcctggggccgttcacgtctccccagctgttgt

SEQ ID NO: 163050 - DNA, 444 bp, Homo sapiens
cttatctgggaattcaaacatttattgaacacctactacgtacaaagtacatggtattttctctctcctatcttccttacactctcggtactacaaaagattttttaatgtgttaacataacatatctttactcaaggatcctgagatgaaatattttataggagaaatgaagatttctcagttaattaaaagtcctggattcacaaaagatttcttcatcatttctttatatgacaaaaatatagcaaacagctaatagtttacacagattgagtaccatagtagacaaattcatttcaacccaacctgaattctaatgcaggatctgacctttacaaggtatttgaacttgaggcaagttacttccctcctctgggtcttaatttcttcagataattaaggaatgagaccagctagcctcacgttaaataaagtaatattct

SEQ ID NO: 163051 - DNA, 368 bp, Homo sapiens
ttgcctcagtctaccaaagtgttgggattacaggcatgaatacactttaaagtgtgtaatctgtttgcagcacacacggtccaatccatcaatgaggtcatattaactcaattattcaagcaatcatcaccattagaattggagaaaccgaggcatagaggggctactttgccaataaccagctctgccagaactcgaatccaggtctcccagagagaccaggagagggtgtggtatggagtttgggggagtgggagtttgtttgattttttaaatttgtttgtttgtttgaaacagggtcttactctgtggcccaggctggagtgcaatggagccatcatagctcactgcagtctaggactcctggg

SEQ ID NO: 163052 - DNA, 423 bp, Homo sapiens
agcatcctcatgatgactgggatggtagtgaatatttataggtttcttttagtacctttttttttagcgttttccatagttccatgtttctacaacccctgggaacatcagaatcatgtgtgtgtgggtgcttattaaatacaccaattcctgggctcactcccagtgactcccagtttgatgattgggggctcagctaggacctatgttttcaaaagctcccaggtgatctcatgcagccagactggctctggctctggctctgggagctgggttgggaactagtctttggtgctattctgctgaaacttcaagttgggctctttgactccatcttgtattgtcatcacttgtattcaggtctgttcttcctctggattgtaaactccttgatgtctgggtcatctcagctcatgagctgag

SEQ ID NO: 163053 - DNA, 155 bp, Homo sapiens
agaactgctcttgaacttctactcctgaatcttctttctttaaaactccccattcttcaacaatagtttttgttgcttcacttctgatatctatgatcaaaattcgaaacacaagagtatgtctctgaagtgactgtactgctaatgccaatttc

SEQ ID NO: 163054 - DNA, 263 bp, Homo sapiens
tagtaatcttacatagaatgtccccatgctgatccctactcctcctcaccctcaacagcaaagacagatacaaaaacccatcacgtatgtttatacaatttttcaaaaagttgtctatacatacagttgtccttttcagttccaccgtccgctttccatacactcctatccaaatctcttaagaacacttaaaaacggtggccaggagcaatggctcaggcctgtaatcctagcactttgggaagttgaggtaggaggatcac

SEQ ID NO: 163055 - DNA, 1157 bp, Homo sapiens
ttttctctccagataacaggaacattgtctcgaagaatccaggacatttgattctgaaatctccaatgtgaaccacacttcctctcctagtatataaccaaccaattctttagttcaagcttttcaaatttatcctaagtccccttcaaatagcacagagaagtggaagcctatcgctggggtctgagacaaaggagttaaagcacctacatgttgacataattttactttaaattcttctttcttctttaaaagttctgctcatttgcattctccatggagagaaaaagtaaattatactgacgctccgagagggaaacgctcttctcacatggggatccttgctcatggcaacaacctgtgcaccccgcgggctggaactcccacgaatccactaggctcggctcccttaggggtcagcccccatagtatgctgggatcaacctgaacggatcacagctcaaggcttctgaggctttttctgttcgggactgtatttcccagcggccaccgcgccagtccacttccggtctccggggtcgacgacatagcggggtaaggtcttcacgtctgaggaagagatctgtggctgcgggagatctctgcggattggggctccagcctgactgacccgacagtgcgggtggcctagggggaggcgctcagagtaggaacccgggggtgcagacgggatctgccggatccccaggctcgtatttttatccaaaagaaggacctggaggaggatgagagcgttactgctgcacacctaaagtcaagggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactgggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacaggttataaagcaaataagtacaaatc

SEQ ID NO: 163056 - DNA, 1113 bp, Homo sapiens
ttttctctccagataacaggaacattgtctcgaagaatccaggacatttgattctgaaatctccaatgtgaaccacacttcctctcctagtatataaccaaccaattctttagttcaagcttttcaaatttatcctaagtccccttcaaatagcacagagaagtggaagcctatcgctggggtctgagacaaaggagttaaagcacctacatgttgacataattttactttaaattcttctttcttctttaaaagttctgctcatttgcattctccatggagagaaaaagtaaattatactgacgctccgagagggaaacgctcttctcacatggggatccttgctcatggcaacaacctgtgcaccccgcgggctggaactcccacgaatccactaggctcggctcccttaggggtcagcccccatagtatgctgggatcaacctgaacggatcacagctcaaggcttctgaggctttttctgttcgggactgtatttcccagcggccaccgcgccagtccacttccggtctccggggtcgacgacatagcggggtaaggtcttcacgtctgaggaagagatctgtggctgcgggagatctctgcggattggggctccagcctgactgacccgacagtgcgggtggcctagggggaggcgctcagatcgtatttttatccaaaagaaggacctggaggaggatgagagcgttactgctgcacacctaaagtcaagggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactgggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacaggttataaagcaaataagtacaaatc

SEQ ID NO: 163057 - DNA, 1001 bp, Homo sapiens
ttttctctccagataacaggaacattgtctcgaagaatccaggacatttgattctgaaatctccaatgtgaaccacacttcctctcctagtatataaccaaccaattctttagttcaagcttttcaaatttatcctaagtccccttcaaatagcacagagaagtggaagcctatcgctggggtctgagacaaaggagttaaagcacctacatgttgacataattttactttaaattcttctttcttctttaaaagttctgctcatttgcattctccatggagagaaaaagtaaattatactgacgctccgagagggaaacgctcttctcacatggggatccttgctcatggcaacaacctgtgcaccccgcgggctggaactcccacgaatccactaggctcggctcccttaggggtcagcccccatagtatgctgggatcaacctgaacggatcacagctcaaggcttctgaggctttttctgttcgggactgtatttcccagcggccaccgcgccagtccacttccggtctccggggtcgacgacatagcgggtcgtatttttatccaaaagaaggacctggaggaggatgagagcgttactgctgcacacctaaagtcaagggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactgggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacaggttataaagcaaataagtacaaatc

SEQ ID NO: 163058 - DNA, 1312 bp, Homo sapiens
ttttctctccagataacaggaacattgtctcgaagaatccaggacatttgattctgaaatctccaatgtgaaccacacttcctctcctagtatataaccaaccaattctttagttcaagcttttcaaatttatcctaagtccccttcaaatagcacagagaagtggaagcctatcgctggggtctgagacaaaggagttaaagcacctacatgttgacataattttactttaaattcttctttcttctttaaaagttctgctcatttgcattctccatggagagaaaaagtaaattatactgacgctccgagagggaaacgctcttctcacatggggatccttgctcatggcaacaacctgtgcaccccgcgggctggaactcccacgaatccactaggctcggctcccttaggggtcagcccccatagtatgctgggatcaacctgaacggatcacagctcaaggcttctgaggctttttctgttcgggactgtatttcccagcggccaccgcgccagtccacttccggtctccggggtcgacgacatagcggggtaaggtcttcacgtctgaggaagagatctgtggctgcgggagatctctgcggattggggctccagcctgactgacccgacagtgcgggtggcctagggggaggcgctcagagtaggaacccgggggtgcagacgggatctgccggatccccaggctcgtatttttatccaaaagaaggacctggaggaggatgagagcgttactgctgcacacctaaagtcaaggaacaggagcattgggaatatgtgattcattgcgactgctggttgtatattaagaaaatgagtgaggggctcaaatgatctaggacagaaattctttctttttaaatcgacagatataattgtatgtatttatcatgtgcaacatgaagttttatggggagaagcccgaggaagattgaccagttttgtaattctagcaacatggtccatggatcagtgacattcagggatgtggccattgacttctctcaggaggagtgggagtgcctgcagcctgatcagaggaccttgtacagggatgtgatgttggagaactacagccacctgatctcactgggaagttccatttctaaaccagatgtaattacgttactagagcaagagaaagagccctggatggttgtaaggaaagaaacaagcagacggtatccagatttggagttaaaatatggacctgagaaagtatctccagaaaatgatacctctgaagtaaatttacccaaacaggttataaagcaaataagtacaaatc

SEQ ID NO: 163059 - DNA, 304 bp, Homo sapiens
gcagccttgaacttctggactcaagcgatcctcctgcctcagctagctgactagctgggaccacaggtgcttagcaccgtgcctggctgatttttcctggtctcattgttgctggggctggccttgaactccaaacctcaagcaatcctcctgccttggccacattttatgttgggattacaggcctgacccaccatacccagcctaatactatttttaaaaacaaaaagtaggaaatcaattttccttttaaatgaacactaaattataagaattaacttgggtaatctatgcaacattctca

SEQ ID NO: 163060 - DNA, 298 bp, Homo sapiens
taggttattttgaaagacctgtcttctgtctttgagttgtcagattccttcttctgcttaatctagactattgttgaatctaacattttttatttcattcaatgaattcttcagtttcaggatttctgtatggttcttttttatgataactatctctttggcaaatttttcattcatatcctgcactgtttttctgatttctatgtattatttttcataattccctggtatctcactgagcttcttcacaatcaagaatgtgaattatttgttcaggatttcgtgaatttctttttga

SEQ ID NO: 163061 - DNA, 255 bp, Homo sapiens
attgggggatgcagggagggtggagtgtgggggatgaggaaaaacagtgacactgggagggaacaggacagaggagcatctgggatgtttccaggctgtgggaaatggtaagacagagccgcgtagaggcagcacccggaggaccctacaggaagctgcagcagacgcagaggtggagagcgggcaggacgtcagggcgggcaggaggtcagggcacacacctggtctgggcacacacttggtctggacaggctt

SEQ ID NO: 163062 - DNA, 278 bp, Homo sapiens
actgaatcattcacaaaccacatgtaagggaactgagcatccttgaattttactatcctcaaaccaatctattgtggatacccggggttactatctctgtgtgtctgtgtgtgtgtgtgcacgcacacgtgtgtgtgtattttggcatccccagcacttagcacactataaggcacaccatgttttcaacgagtttggaatgatgggcaatttgaacaagcatagcccgatttcctctagcttgggctatcattttcaaattgctaacattggccatc

SEQ ID NO: 163063 - DNA, 308 bp, Homo sapiens
tctcctgcctcagcctcccgagtagttgggactacaggcgcccgccaccacacccagctaatgtttttgtattttgagtggagacggggtttcaccgtgttagccaggatggtctcgatctcctgaccttgtgatcctcccgcctcggcctcccaaagtgctgggattacaggcatgagccaccgtgcccagcccggtgatgctttttgactgctactctcgttaagcgtggcggtcacttgactcccatgcccgaattccttccatgtgtatgacggttatgttgtgtataggatctcagaatgact

SEQ ID NO: 163064 - DNA, 327 bp, Homo sapiens
ccctttgtgtccatagtgccctgtatcttgttgcctaaagtttgaggttacgcaggttgtctggattttgggaaagccgctttatttctgccctctctccacagtgtttatcactgataagatctccagcttctgtcttcaagtggctttacaggttttacaccgcaaacttccccagttttgcgctcatctctgcaatgctgtgattggctacctgagtactcgcggttcctcagtagatggcaggtatggtcagggcctcaggatcgacccaagttggcggggctgtgtgaaatgaatgaggtgatgtagtgcaactgtattttg

SEQ ID NO: 163065 - DNA, 467 bp, Homo sapiens
gaaatgtacataatggttacagattgtcaaagactggagctaaagggtaaagtaaccatggcctttttgttgtcactatttagtttgtgtagttgccaagtgtgtttctaatgcaaccttaggtcatcggcattaaaaaagttttgtgtaaatatcatttactgcctcaagtccttgctctttcaccctaaagatttggaaagttaaaaaaaaaaaaaagcctgctaatcgcctctgggtgttaccagcctgcattagctctaaggcaatccatccctcagcatgggactccccagtgtttgtaattctcagctattgattttgtttgtagttggaggttgtaccacaaataaattctaaggtctatttgtcctacatgagggggagccatagtaattcattctcacattggtgcccagtgtcagtgtgaaaaaaataaaagtcttgttggattcactctgggccgc

SEQ ID NO: 163066 - DNA, 377 bp, Homo sapiens
agcctggtgaggccccgttctggggctggactcctggcctcggagccctgaggtgggaagcgatgtcagcgactgcagggatcgcacgtgctggcgtccaccatgcaggcctggggaagacctggtctcgccctcaaggggctcacggtcaacaggggtgggcgcagggctgggtgtttgatgtggggtgacaggcggggtgcggatcagcaagggggggcttccctgggctggtcctgtctgagctcagtgccgaacaaggatgccgtgggagccggagggagttccaggcggagggaacggcagcacaaaggtcacaaggtggctgaggcagccacgctgcacggataacagcagcgtcctccaggctcatgcag

SEQ ID NO: 163067 - DNA, 367 bp, Homo sapiens
tctgcagatgctcctctcctgcttcactcctcccattctgctggtctcacctccaaagtcctctcctccaggcagccctccttgaatcctctagtctgggtcagatgccccctcctccaggaagccctctctaaacacctccccccatcccaggtccaacacccgccccctgtgagctcctccagttccttggcttcaccatcccagccctgcccgttctggggcatcaccatctggggatgggtctgtccccttcactagactttgtgccccatgagggcagggctgaggctgtcatggtcactgttgtgtccccaacattacccagcacagggctgggcacagaggggctcaggggatggatgga

SEQ ID NO: 163068 - DNA, 132 bp, Homo sapiens
gggcgaggaaggggcatttgcaccggggctgggcgggcgcacccagagccaggcgggcaggaacccctgcgcagccatccggtgcctgcatgtccctggcgcggaagggacgcctcaccagcctcggcgccc

SEQ ID NO: 163069 - DNA, 254 bp, Homo sapiens
cacaaagtaaacgctgcactttgcagattggtccctccagcttttgggaattgtaggacctgtagtgcagtgtctctgaggcacgtggagccctctggatgtttcacccgggcccaatctaccttgtgtaaaggccctcctgttcgactggagacatttcccaggaccttcctaaaaacattcaaaatctggtggtgaaagtccttgtgtaaaattttgacgctaggtgtcctccatcccttgctcctgttaga

SEQ ID NO: 163070 - DNA, 745 bp, Homo sapiens
aaaagttgtgttctctccccactagccctggtgggctctgcctaatcccatttctctttccttaggggtattctgcagtcttcccttctctctctgggaccaagtggttatttccatttttctggactccattctgactccagtacacaccctgtgacccccctcagcagctgagaaacagagcctcttccaaacccatccctaccttccaaatcaagcagaaccctctgctgcccactgggagtcacaaggaggggacggaactgagctgctgggcctcagtgtcccaggacagtggagtctgtgaccaaggtgccgattaggaagaagtctgagctgaaggcagagcattagggatagcagctgggggtgatgttggaagaaccctccctcagtataatcggtatacctgccctacttcggtatagtccttggcacatggcaggcactcagatgacagcactcatatacatccctgcctccagacccactcatgggaaactgatgcaggagagattgggcttttggagaggtggaggtgggggtactgtgaaactggaggagggaaccaggtcaggggatcttaggaatgcagaaaggagttcagagcctttctcaagtctggacaggaccctcggtatccaggtcagagccctcttcccaagaggttgggaccaggtgggccagagcttgtaaggagaggaggcagaagggctggtgccctggtactcacaggtgcgtgcag

SEQ ID NO: 163071 - DNA, 287 bp, Homo sapiens
aatggttcacagaattgatctcataagtttgttataaagattaaatgagatggtctacacaaaagatttaggacactgcccgttacatactaagtattgaatcagtattagtgaccactaactcctataaggagaaggcttcagcaaagactcaagccctctctttgttttgcctctaactccaattcctacacaggatcctctctgaggccagtgtggctggaggtggagaggggcagatggctctggaatggtgtgcatgcacccttcgccccctgcccctttcc

SEQ ID NO: 163072 - DNA, 228 bp, Homo sapiens
atttccggcgggcaatctcaattacaatatatacaccaacaaacaatgttcaaccagtaactactactaaggaacgctcataatcatacaaagcccccgcaccaataggatcctcccaaaacctgcccctactcctcctagacctaacctgactagataatctattaccttatagaagaactaatgttagtataagtaacatgaaaacattctcctcctcataagcct

SEQ ID NO: 163073 - DNA, 464 bp, Homo sapiens
aaattccagctcggtttcctccactagtgtaggccaaaggcttctacatgatttaatcacacatgaaatatgctgtggttgttttgtatgagataaaaactgaaactgagaaaaactttatcacgtgcacaggatcacaccagttggtaagtaatttgtagtgctagaaacttgtacaattataggatctggaccatgagtgacacatgaatcaggaaagaaagaacagcacctgtaggggttcagtttaaaggattgcacactcattgttctctaggttaatggatcctggatgaggccctgttaatactgcatcattcaagaagatttaacttaaacctcatgactcagtaatcccattcctatgtatatatctaagagaagtgagtgcatatgtctaccagaagacatgtttaagaatgcattagtaattttatctacagtaacccctaatagtaaatatt

SEQ ID NO: 163074 - DNA, 685 bp, Homo sapiens
agaccagcctggccaacatggagaaatcccgtctctactgaaaatacaaaaattagccaggtgtggtggtgggcgcctgtgatcccagctactcgggaggctgaggcaggaaaatcactggaacctgggaggaggaggttgcagtgagacaagatggcgccactgcactccagcctgggcgacagagcaagattccatctcaaaaaaaaaaataaaaagaggtaatatgagttggtctggaaatatagggaagaaaggcatcccagaaagagagcaaagactgagagagcaaagactgcaaagtcatgaagaaatgataagggatattttgtgaaatataatgctgagtgtggcaggggtcgatagtgggtatgggagccagttattggagatggaaagtagataaatgggttgggcctgcttgtgaaaggttttaaaattcacgtagtactactatcccatgtttacagatgagaaaactgaggagggtatgagaagttaaataacttgtctatggtaactcaattagtaagtgccagagccatgatttacactctatctgtactccgaatccctacatttatatctgtgaatctgtgctcaaggatgcaaatggaaaccagaaaaccttatcctttacatgcagaagctatactgtttcctctttttaagacacagcaacagg

SEQ ID NO: 163075 - DNA, 300 bp, Homo sapiens
gaagaggttcagtagtgtgatgagtgctgaacctaaattagaagtgatcaaggagtgaaattggaaaaaaagtttaagactatcatttaaggaattcagaagtagaagcaagtagagaagtagattgaagagaaggacttaaatatttttagaaaatgaaagggtataatagaagacttggagaataagtgaagagtttagccttattaaaggaacaaaacactccttcctttgagagaggagggaaaggaagaagaatgaatagaatagaataggaggaagttaagagaaaagcagaga

SEQ ID NO: 163076 - DNA, 278 bp, Homo sapiens
tatagagaggagggatacaaagggaaagaatcaggaagtgccttatccccacgtagggtcaaccagtaggtctataccagctttgtgggaaagctcttaattatttgtctgagagctttgtctatgactctgacctattcaaatagtcattatgaacttgaatgaaaacaaggatatgaaaataaaatttgtgaacaacacagagttagagaaaacctttaatgcattggcttcaataatcaaaaagttgagtgtagttaaacctggataagattatc

SEQ ID NO: 163077 - DNA, 1206 bp, Homo sapiens
gaagtactaactagacatatatatgtcttagttcagtgctatatatttgttggtgccaaacagctctttattgaatagatggatatatgtatgtattactgcacataatgtactcaaaatccaaatgagaacctatagagtatctattttttaggatttttgccatactggttccttgtgtttgcatgaaaaactgaaaattgactgtggagcttttaggcttgggttggaacaatatgtattttagaaagattactctcttaataataactacaactcattcttagaataataaaaatcatatcagtactaagtaatatttatcaactgcttactgtgtgccaggcagtatgctaagtgtgtatgttatcttagttcatatctacagccctgaaagaagacacaacaaggcatgttgtgttattatttccatttatagatgaggtctctttgggagccagcaaggaggtggtacaaggtctaatctttgaacagttgagaaatgggtagttagttttcatagtgctgcttcttattttcaaggttgagggcccttctaggcgaggtgaaaggaacccttaaatctagagactgcctagagggagaaactgacacttacttttggctttctgggaaccagggtaggtcctctcttaattgaagagaattaataggatcctgtggctgggcattgggcagagtgtttgaatagctgctggccatggtaggtaatgccaaagtggcagtgaaaacaagctactgtgggacattagaccctgcctgtcacttttcttcccaggccactcacttgttggagggcccttctgaaactcctcttgctctgtagtctggatgcttgtgaacaagctgcttgcaggtgccgaaacaaacagcagtgtgggtctcagggcctgggcttggaagctgggcagagggtggaagggctccatttgggagcagtgttgatggaagtgatttttctagctgaggtgcgaggttggttctgagctgaatttaagagaaggctatggtcttttgtccttccacacttttgggacccagcagatactacaaatgcaatctttacaaacccactcactgccagaaatgaatctaaaaaagtgctagtctgtgggcctcttggtcaggaaggtgacagcagtggcaacagcagaaaaaccaatcaaacaaacaaaatgcctgtgg

SEQ ID NO: 163078 - DNA, 132 bp, Homo sapiens
atcacagggggtcacctggtgatttaaacaattgaggacaataaactggtttcttataccctcactcattataaaaagataaatttgcatctaaacattaatggaatacttaaaattattcttatctcttca

SEQ ID NO: 163079 - DNA, 377 bp, Homo sapiens
aatgtagtagaatcacagcatttgtccttttctgtcaaattcactatgtgtatttatcaggttcatcctgttacagcacttatcagtagcttaaattcttttgagtagctgggaccacaggcgcgcgccgtcacgcctggctagtttttgtatttttagtagagatggagtttcactatcttggtcagactggtctctaactcctgaccttgtgatccacccgcctcggcctcccagagtgctgggattacaggcatgagccaccgtgcccagccaacatttaaccttttaagatactgtgaaacgtttttcaaaaatggctgcagcattttacattcccataaaatatgagggttccagtttcttcacaacctcag

SEQ ID NO: 163080 - DNA, 433 bp, Homo sapiens
tggggccaggcgcagtgcttcacccctgtaataccagcactctgggaggccaaggcaggcagatcacttgagctcaggagcttgagaccagcctggtcaacatggcgaaaccccgtctctactaaaaatacaaaaattagccaggcatggtggcacacacctgtagtcccagctactcaggaggctgaggcaggagagtcacttgaacccgggaggcagaggttgcagtgagtcgagattgtgccactgcactccagcctgggcaatagagtgagactctgtctcaaagaagaagaagaaaaaaaaaggttaattaattaaagaaaataaaaatcaaatgttacagaaaagccagatttctccacattcccttaaaaaatgggaagatctggcatggcatggtggctcacacctgaaatcccagcactttggg

SEQ ID NO: 163081 - DNA, 192 bp, Homo sapiens
aatgtaatctctaacatcaatgtggtcactcaaatgctgaatggaagaagacatcaggatgggatgaggaggttggggcaatgcctgcagggccctggaattcatcagtgtgctcaggaaaacagcatttccacatcttcctccaaagcttagggacaagtaaaaatataatggaaagtaaacattacaaca

SEQ ID NO: 163082 - DNA, 238 bp, Homo sapiens
cattgactattaattttgcctctttttgattactgttgaggcaaatgtgatgagagtagacctggtttaatttgagtggaaacagaaaggcatagtggaagtgaatgggttttcaagtaagacacacctgggcacacaatgtcctgttgtctctctctttgtgctagtagcagccactggtgatcattgcctagatccactaattaattagggattacaaaacaataatattctagtt

SEQ ID NO: 163083 - DNA, 716 bp, Homo sapiens
tgtcgagctcggtacctacttttccacaggaagataaaagcaggcacgcacaacaggaatgctctgaaggagacagaaaggcagaagagagcaggaggaggaggtccaaggaactgaaaagcgccacaaggtaatgctaagaatcaccaggctccaaaatatccaagaatattgcaagtattgctcccaaataatcacaagcattgcctacagaacataggtcaaagtctttatatcataccaacctcccctcccaactcgtcctcacttttctgggttcatttgcagttacggacatatgtgttccttaaaaaaaataaaaaagcatcttgctatgcaaaaacccaccatttgtgaggaaaaatggaattagggcacaacactgaaaaatgttgtcagtgacacacacacacaaaacaatctagtgaaaatggtagtaaagctctacacatgagaaatggttaagaaatacaagtaactgtgatactttaccttgaaaaaggcctgaagcttgctctgtggaagcgggcctcagtcagtttacagattgtgagttattgagaagtggaggcaaagagagtgaatgctgtaacatcagatggacacaaatgtggctcacatacaagtcaactgaggtgactgatctatgtggaaggtgtgtatattacatggcttggttcagctggcctcaactttttgcgttcacctaatatttc

SEQ ID NO: 163084 - DNA, 239 bp, Homo sapiens
gacagagctagactctgtctcaaaaaataaataaataaataaaaaataaaagccttgatcttttgttgaggcgtcccctcttcaaggtcctgtacaatgtgggagtctttcccacatgaataaatacgaagtgataaagagtgaagtcagactattgccctctaagaatttcaacatcaacaaagtagactactgacaaggaggcagaggtacacagatcttcagtcttaatgacacta

SEQ ID NO: 163085 - DNA, 359 bp, Homo sapiens
cctcgcctccttcagaagccagtgcctctggaaatgcctggatctgcgaccccagcctgagcctagtagggcccaagggaagctgaacgccccgacggctctcatggtaggtagctctttctgtttttttgcgccgccttcaggcaatcatctactccgcttgctatcccctcactcaactcggcttcagtagatggggttggtggggcgggagtgggaaagaggcaggggagtcaaaagggaaaacctgaaaagaaggagggagaagaagcaggggagaccaggacgagacaatgggacagcccaggatgccggtgcagagggcagcggctggatgcagagaagatgggacacgtatc

SEQ ID NO: 163086 - DNA, 850 bp, Homo sapiens
cagcgtctcctcacctgcaggctgagacttactgacacttttcaccctcttggccccacatgtgtggcccactggaggggagcaatggctggcagaaaaccaccaggtctggaggtcaggggctgggttctggcctggccctgcatctggccaacacgtgatctggaactgttttgtgggcctcggttttccttccagaagcagagaatcattctctatttctgagtggggcaagggggctctgacctctcccctggggctgccttttccctttatttccaagcagtattcacaagggcccaccaaagtggcatctggaagtatgtgtttccaacaaatccagtcttttttttttcttttccccttattggcttaccatgatatggtagaaatttattcaggcctgcctttaaaattccccttgattgagtctttggtggatcttacaaagactttggtgagttgcagagtctctcagtatatcacctggatggaggtagaggggcagagggccacgatgggcaggattgggcctctgggagaacagaagggccaaggcaaagcagaaaggagcagggaggtcctcggcaggggagccatctggaagatgtcaacttgcaggccctgaggtctgccctgggctgagttcctgggtctcctactggagagatcagccaaaatacacctctgttcccccaagcactctttgctttctgccttctctctggtcttggaattttcagttcaattgggatcttacaggaaaacaattccaggccaattcctgacttcccaccctagaagggaatgttggagcccttggcctgtggttccctctccctccttcttg

SEQ ID NO: 163087 - DNA, 511 bp, Homo sapiens
gatccagactgtatctagtgggatacagagcaccttgggcagaggagtggccccagcaaagacctagaggcagaaatgcacagctgtggggagggatgattagaattctttttttcctgaaaacatttactctgcaagaaaagcgaaggaatggtgttgttgttgttgttgttgttgtttttgagaagttttcagggaaagtgattgttctcagtgcaaggccagtatcagccatggtgtagagatggagagagcactcatggaaaagggggaggttaggggcttgcccagagcagaaccagaattttccagggcttgatagaaggagccggtagaggaggaaacgagaacagcactggctgaggagttggggttgtgcaggctcaggctttggacacaagatgaaagcatgtaagcatgttataaggaaggcacattgttaatatcatgctaatgttacctacccttccggctgaacagagcctgtggtggtcttgaacagattttcata

SEQ ID NO: 163088 - DNA, 250 bp, Homo sapiens
agggtgtacgtctccaaggcaagttatttaacaacttcttctacttcatacagaaccattcttagtgtttttctttgagattggtataaactcttctaagaatattaattttttgtcctgtggtcaaatatttaaccagtttgccttttaattttgtatatagtatattattacttatctatagatttttttttttttgagacagtgtgtcactcagtcacccaggctggagtgcagtggcacaatctcg

SEQ ID NO: 163089 - DNA, 272 bp, Homo sapiens
cagcatagcctagcccttgatgtctctgagttgggagaacctgttactccagttaggaaatgggataccctattgatgcggctgggaacctctgttgcttattgtacctgagggcagagaccatgtgccaaaggctttattttaggggaagtggtaagaaagttcaggctgtaggtatgttcttagccacttctttcagcttcagcaaggtcttacaagagataaatttaggctacactggattctaagagcatagagggaagatcatgcag

SEQ ID NO: 163090 - DNA, 269 bp, Homo sapiens
ttaaatctcccactagctattccatctctttctatcactttttgtcctagggtggctccagggtcagatgtagtctgtctggcttgtaacttgcttcccctcaaactgacaggccctttctattttaagtgacttgctactgatgcctataagaaaatagagaagagacaacaaaagtaataaacagttaaagccattataagcctgtatctgcaattttaacaggactagacacagattaggaagagaaaagtatatttcatttatat

SEQ ID NO: 163091 - DNA, 195 bp, Homo sapiens
ctgcctcagaagtgaacaagaaagacagagacacacagaaacatggagagccactgagagaccgataatgaaggagtcaggcctactcttcccaatggttatgctaccacttctgacacttgggtggaagagaggtgagaatgagacagaacaagcaggccagaggtccttgagcagtgaagtgggtcctagccc

SEQ ID NO: 163092 - DNA, 154 bp, Homo sapiens
ttggccgaggatagagagctggtctcctatatgagaatgatgatgaaaagcaagtagacacaaactgcatatgagccaccaatgtagaaactccgctgtttgcggtctttacacggtcccacctcccaaatcacgagtgatggtcccacatttc

SEQ ID NO: 163093 - DNA, 270 bp, Homo sapiens
tgctgggattacatgcgtgagccactgtgcctggcctgttaagtattaccataaactcttctcctatctgtcttgtaagttatgtacacctcatctatgttcttgatgtagcttgttacttagtctgttatagtaataatctctttaattattagcttttatgtcttctccattgtccactgacagccataactgcgtatatctttttgtatacctgtctacagaccagccatcctaggttgaagaatagaattacttctcattgcttcc

SEQ ID NO: 163094 - DNA, 657 bp, Homo sapiens
tgagttaaaaattacatcagattcattgtaactgaaccctcaataacccagtttagattacattggtcagggctgggcgtcgtggctcgcatgtataatcccaatactttcagagatggaggtgggcaaattgcttgaggccaggagttggagacaagcctggcaaacacggcaaaacctcatctctactgcaaatacaaaaattagcccaggcgtggtggcgcacacctgtaattccagctatttggtaggctgaggtaagagaatcgcttgaacctggaagggggacattgcagtgagctgagatcacgctgctgcactccagactgggtgacagaacaagacttgttctgaaaaaaaatacactggttaaatttgttatgcatgtgtctaattgaagagacaacctgaacaggctaagtgtgagcaacaaggctgttgattcactcgggtgcgagtgggctgagtctgaaaagggagtcagtggagggtggcgggattggagctagttttacaggttagggctaagcagtggaaagttacagttaggggacgtttattgcgggcggggaagaatgtcacaaggtacattatcacaaggtgggaggggtcacagggcacagtgtcacgaggttgatcagttagggtagagcatgt

SEQ ID NO: 163095 - DNA, 127 bp, Homo sapiens
gggtcagatggggtttaggaggctgggggcagggttctggaccacctggcagagagtagatcacttttcactgatgcctgcccccttcactccttcccactgctcaggataaaacccacattctaaa

SEQ ID NO: 163096 - DNA, 644 bp, Homo sapiens
agcagttgactatgtgaatctaaagcagggatcagaaagcttttccttaaaggaccgtataataaatacttaagcctttgcaggccatggatttctgtcacaactacttagctttgccattgtagtgagaaaacagccatagacaatatggaaacagatggttgtagatgtgttctagtaaaattctatttacaaaatgggaaacaggcctgtgggctgtaatttgctgacccctgttctagagcccagatgtgataaattgataaatcaattgattcatccaacaaatatgtgtcgagtacccactttatgccaggtactgtttcaggaactctagatatcatcttcatagagtttatatttagaaaaagtaaacaaatagtattcaaagtaagtaaagtatataatattttagattgtaatgaacattaaggagaaaagcagagaagggaaataggaagggttggaaagtggttttgcaattttaaatacagataggaaaggagaaaataaggaaatgaggagggcctcacagagaagatgacctttcagcagagatcgatagggagtagaggaatgattcattcacctatccagagagaaaggattctaggctgaggaaatggtaagtgcaacacgaataa

SEQ ID NO: 163097 - DNA, 545 bp, Homo sapiens
ggtatggagtgtttgcccatgcggtagactctggcaggacagagagggttttcccgggcctttagttgtccaggtcctgtattctcacatctcctctgggctgctgactgcgcacaaacacaaaattcattcctccaatagaacagtgtttggcctggctcccaaaaactgctctcctcacttgcacggctttgattgagtgttaggtgtctctttggctgcctccagtgtctcttatttttagggccttcgttaatgtcttctgtgtgtgaaacatgaaaatggagccatggctgctggaattggaaacttagggtttttaggccaccattcccttatcacatggcgttatcaggttatttagttacagaggttaaaaaaaaagtccaccctaggagccggcgtgtgtggggaaaggagagagggggcagctgagcacctaatgggcagtgaaaaaagatattgtaactaaagctcgggctagtgtcctcagagcgatggcctttcaggtgctggcaggggtctgcttacagctcagcctggtt

SEQ ID NO: 163098 - DNA, 358 bp, Homo sapiens
ttagccttgtatcttgctagtattttctcaatcttattttgaatgttttgtgtcaagtgttaaatcctcttataccacagaatccagaaaatttaaatgcaacagaagtaaaacgaatataaaaattctatggttgttgtggaggggcgttcttggctaacccatagggtgtttgaatgtaaaggcagcttacagaactgctgctagttgaattgtggagggtttcacttttaagagtacatttgagacaaaattgcaattttggaatcacttattcctgcttgttcagtgaaataggagaggggggaattcctgagggaagctgggagatttccaggtgatgatagagtagccatgt

SEQ ID NO: 163099 - DNA, 246 bp, Homo sapiens
tgtaccaattaggaccaatttgcatttcgaaagcaagcattatagcagaattgactttgcaagaaaattctgaccctgaagaaaaagaatcatagtcatgttttattcaaataaagtagacagaaattacgggttaccaaagcagtgacagtgaggatttctggtatatttatgctacacttcgtttaaaaggcagaaatcactcagttgatactagccattatttagagaactcaaaaggtgaag

SEQ ID NO: 163100 - DNA, 596 bp, Homo sapiens
tgtgctgtcagaggttccgagataacgcattatagcataaagaacatgatgaccaggaaagaggctggtgtgataaatattttaatgctatttcagaacaagacaagactgatgacagttagtttgagataaatgggatgttactttagcaataaagacaaatttagaaattacatgcctactaaaaaataagattgtgctggctgggcacggtggctcactttgggaggctgagacaggcagatcacaaggtcagaagatcgagaccatcctggctaagacagtgaaaccccgtctctactaaaaatacaaaaaattagccaggcgtggtggcacacacctgtagtcccagttactcgggaggctgagccaggagaatcacttgaacatggaaggcagaggctgcagtgagccgagatcataccactgcactccagctctaagtgacagagctaggccctgtctctttacaaaaaaagaaaaaggaaaaagaaaagaaaaaaagaaaatgtttcaaatggccaaaggaaacttgcaatttaagagaaggttgactgttctaaagattcttcagccaaagaaaaagagagagagaa

SEQ ID NO: 163101 - DNA, 403 bp, Homo sapiens
ctatcttcctttttgccacttggttcccttcattctccaaaaatttggggacttaactccccaatagtttttatctttatcctacctcctagtaccatcctaggagttgctgttaacaactgttccactaacttagctttttaatttttgtaccttcttaacccttctgaccttctccttcaatctactttagtcatccaccacttaggaccacattttgtatcttgtcatcactcagacattacaccttagcaatcttagattctgatatcccactttctgactacttgcttctaaccttccagcttaaaaattgcattactgttttggggattagctgcttagaggtggggcatacatagtctagaagggactggctataagaaaatagctggccaggctc

SEQ ID NO: 163102 - DNA, 359 bp, Homo sapiens
tgctctcatggttgcactggaagatggatttccccattgcttttatttcttttatagtgtattaaattttttgctctttctgttatgcatacatttcagtatttgttcatgattgtgccttatcttagataagcttgtccaaataagtcatatactctatattcattcagttttctcaaaatgaattccgttcccaactctataatacttttatttccctttaaactttaaaaaaagttatttgtaatgggttttgctgtcatatggtgctcaacatttaactcatgtttttttctgtgtggtgtcccaataaggttatttttttcactcctcttttctttaattcccatccaaccagg

SEQ ID NO: 163103 - DNA, 367 bp, Homo sapiens
tgtaatgcagtccacaaatattcattcaatcatctgttcaacaagcatgtacttagtacctactatgtgccaagcactgttttagatgctgtgcaagtggaagtaaacaaaacagatttaagaccccgcttacaatctgatgtttgtttggctcagtgttctttaaaaatttgaacatgttgccaccatttaaacatcaaaatatctcacataaaaatactgatttccattagttcttcaaaaaaaaaaaatctgatagcactggcctgaatttcagtctaggcacaattatctaggacttaactgactaccctcattgacagggcaagcattctcttcttggccacagtcccaccactctctgtgt

SEQ ID NO: 163104 - DNA, 459 bp, Homo sapiens
agcatggggggactgcccccatgattcaattacctccctctaggtccctcccacaacatatggggattatgggaactacaattcaagatgatatttgggtggggacacagccaaattatcagtaaaatattattaattctgttttgtaaatacagatactaaggctcaaataggttaaaatggctactccaaggtgacagaaatgttaagtggcagagtggggaagtgtagacagggtttctaactccaaattttgtgctgtgtcctccagaacacagacctcctaccacattggttgctcctcaggttcaggaatgtttcttcaaggtaagaaacgtatcctcagggtcagaaacatgttatcaaggtcagtttatgtgtttttttttttattctctacactctgagcatgtgacatagagccttatcctgagtgaggaatggtgaagaataaaatgc

SEQ ID NO: 163105 - DNA, 558 bp, Homo sapiens
attgtatgcactccatacattcacagaaaccgctgctgactcgttggagtacccagtgtagatgttaactctccccctcccctcttctaaagcgctcagtttaacaccatgtccataaagacatccactgtatattagttttttttttttaactttttgagatttctagtattgaatttttaagtctcatttcccagactctgtaaatctagatgaagttatcaaattcccttagttcccagaactctttgggaaatgtgagtgcttgccagctggtcagataattggtggtttattttcatcacagataggaaatgttaagagttatgagaaagaaggttctgaaactggaatgtgttcttcctttaaaagaaaatcttacagtatgggaattcttccacaagttcttatcctttggtccatttttataatgttctatttttccaggctggagtgcagtggtgtgatctcggctcactgcaacctccgcctcccaggttcaagcaattttcctgcctcagcctcctgagtagctgggattacaggagcgggccacca

SEQ ID NO: 163106 - DNA, 293 bp, Homo sapiens
aatatatgatatattagaaatgagtgctttggaaaaaaataaaggagaaaagggggttgggaaagtagttgaatttcagataatatactaaggaaatcctcactaagaaaacatttgagtgaagacctgaaagaaatgttgtgtgtgagtcatgcacttatctaaaagaagaatgatacaggcagatggaacaataaatatgaaggccttgaggtatgtttgtgcttgtcatgttcagcaaacagaagggagtgcagggttgttggagcagaatgagtgaaggcagacataat

SEQ ID NO: 163107 - DNA, 488 bp, Homo sapiens
acttcttctttcttttatcatcctttaccatgtatgacagctttggccttctgtccaagccactgacagcaagtgaatttggcatgtgtgattgggaggaaatcagttcccttactctatttatgaaagaattattagcaaatcattgtcctgacccaagttcattattagagagtttaactagccgtatgagtgaatagctttttatgctgaaggtagagggtatagaccagattcaggccagaaagcttaattacttgattttcttatttgataatgatttatgggctttggggagatgccaaaaccaagcttatgaatgacaaccaagcacacatttgatactacagtactaagaaagatttggggctctctaagcctacagtgaatatcacaatttacacctaggtggagaggaataatgctgaaatgcatttgtacttatcaggaaacaataaaccagaaacttaaaaggcatacttcattga

SEQ ID NO: 163108 - DNA, 640 bp, Homo sapiens
tgtgactgtaggaggaattagaagagttaaagatgcaaattatatattttgacctcttcagggatttggacttaaaatttaaaaataggactccaggctcaatcccctgccttgtgtttaaaaacaaaaacaaaacaaaacaaaacaaaaaacaaacaaaccttagtctcagatgttctgattttctctttgtgtttctgtgtattaaagaacttatccgtgtattcagtccatgtattaaagcatttatcccatgtgttaaagcatttgtttacatatctatctcctgctgtagactgttggttcttcaagtgcagagactatgtttaatttatctatgtattcccaccttccagcttctctttctagcacagtacctatacgtgctagatatgtagtcagtagttgtggcatgaacagattgttgaaagaaaagaaaagattgttgaaagatactgactttagaacatacctaaataagtacttggggataacttgggcatcacccaagttatatactagtatttattataattcatacccataaaacacttgatacatttttcatcagtacaggcttcccacataggtgcacacatctctcttaaacattttgccaaaacctcacacacagaattga

SEQ ID NO: 163109 - DNA, 665 bp, Homo sapiens
tgaattctagtaggagtttattttccttataattttgaaagcattgctcttttgttttctagtttccagtgttgccacagtgccattctcattcttaatttaatcttgaaactttttccactctgactcgggagtgttttaatattttttcttttctttggtgtttatgaaattacacgatggtattccttggtgtgagtttatttttattcattggtctgggctcttcattcattgggcttttctaatctggaaacttacgtccttcaattcttgaaaattttattacttttcttattctattttcttagtttctaggactattaaatgttacatttatgaccttttagtcttcttttctctcctattttccttctgagccttctattttctatttctgctgtatttctaattttcaggaactctttttggttttctgaatattccttttaaaaaatagcatactgttcttgtttcatggatgcactcttttctttcacttcttcaaagatattgaagacaggtttctttgttgtttttttaaagttttcttcttgcatagtgtctgctttctccacatttatttatttattttactctttgtttgggtctctgtttttctttttctcttttttttttgagtcagggtcttaccttgtccccca

SEQ ID NO: 163110 - DNA, 435 bp, Homo sapiens
gtggtttggctggtcacgaagttttccttttccctaggcaatcaaaacagattttctaatctattcatctacaacaatgttttaaaaatggcaggcatgcttgctggcttactgaaaaagagctaaaggtgttttcaggtgaagttagaggtcgtaggaacaggggcagatgttgcagggccttatagatcattgtacagactttggtttatactcagagtgaatttggaagccatttccagattttgagaagagaagtggcatgatctgacttatgtttttaaagaatcacttaaagtgttaagaatcagaattaaaggaacaaagaaaagaaactgaattggaacttcttcagtaaatcaggtgaaaggtattatggcaagttactctgtaaccaggtagttacggtggtgacagtgaaatgttaaggtagaa

SEQ ID NO: 163111 - DNA, 333 bp, Homo sapiens
tgcgtcagctcagctcctctcagctgcttcgggcccttgtgtcttttctgtcggttccagctctgacggtcttcttagctttgacaagtcagcttttatcatactatcccttttattttaaattctttttttttccaaacgggaaaataggtcccttccatagctaatggtgattgtcattcacaaaagcattgaacttctggttgagattggaaaggaaggggaactaatagatctgtgagtgagcccatgatttctagtctacatctaggacgctcacggatacattatttggccagaacatgacaaagtaatcactggatatagaagtgc

SEQ ID NO: 163112 - DNA, 593 bp, Homo sapiens
ccaacacaagcaccacactcctatcagctccaccccttcacacacactgttccctctgaacaaatgcacaaatgaattagaggaggtggaggagaaatcaacttctcatagccaaatagtttcaaaagcaaaataataagaatccttccaattacttttataacataaagaagtgtttaaactgcatgtgagcataacatacctaatataatccagggtagggtctccagaagtatgggtaccccaaacctgccacagtctaagggggaagtaaggacaaagctaataaagccaaaggatttgtccctgggggcaggagtggaagcactcactgactgccactgcatccaggaaggaggcacacattggcctctgagcctggcgagagcagcaatgtaccacgggctcacccactacttgggaggctgaggcacaagaatcacttgaacccaggtgatggaggttgcagtgagatcgcaccactgcactccagcctgggggaaagagcaaaactctgtctcaaaaaacaaaaagaacaagtgctcactgatttgccaccatgtccccacagcaagaagccccagttacacaac

SEQ ID NO: 163113 - DNA, 510 bp, Homo sapiens
acacaacacatccgttacagagaactagcaggtgagctattttccatccgaaattgggtataagcaaaaaaggcagagtggcacagcgcatccactacacatcaacttataaggtgaggactgtagctgggcgcggtggctcacgcctataatctcagcactttgggaggccaagatgggtggatcacctgaggtcaggagttcaagaccagccgggccaacacagtgaaaccctatgtctactaaaaatacaaaaattagccaggtgtggtggtacgcccctgtagtttcagctactcaggaggctgaggcaggagaatcacttgaacctgggaggcagaggttgcggtgagccaagaatgcgcccctgcactccagctctgggtgacagacgtgatctagatcgcagactctgtctctaaacccaacttcactttacctcaacccccaactcagccctagagaacacacattcacatgccagtcggtgatcctcaggaacagctacac

SEQ ID NO: 163114 - DNA, 674 bp, Homo sapiens
acacaacacatccgttacagagaactagcaggtgagctattttccatccgaaattgggtataagcaaaaaaggcagagtggcacagcgcatccactacacatcaacttataaggtgaggactgtagctgggcgcggtggctcacgcctataatctcagcactttgggaggccaagatgggtggatcacctgaggtcaggatttcaaaagcaaaataataagaatccttccaattacttttataacataaagaagtgtttaaactgcatgtgagcataacatacctaatataatccagggtagggtctccagaagtatgggtaccccaaacctgccacagtctaagggggaagtaaggacaaagctaataaagccaaaggatttgtccctgggggcaggagtggaagcactcactgactgccactgcatccaggaaggaggcacacattggcctctgagcctggcgagagcagcaatgtaccacgggctcacccactacttgggaggctgaggcacaagaatcacttgaacccaggtgatggaggttgcagtgagatcgcaccactgcactccagcctgggggaaagagcaaaactctgtctcaaaaaacaaaaagaacaagtgctcactgatttgccaccatgtccccacagcaagaagccccagttacacaac

SEQ ID NO: 163115 - DNA, 301 bp, Homo sapiens
tccttttaaaacaacattagatgttaacataaaaataaatcaaccagagagcctcttattaaatttcactgatccttttgctaccatcatcttacatacttcctgatttagaaggagcattttaaaaactcatagattgaaagagtttaatacatttgttaaatggtttcttaaaaaactcaaaatggctgggtatggtggcttatgcctgtaatcccagcactttgggaggcagaggtgggcggatcacctgaggccaggagattgagaccagcctggccaacatggtgaaaccccatct

SEQ ID NO: 163116 - DNA, 408 bp, Homo sapiens
caaatgagtaaatctggcacatagtaacactatcactaactaacctgttggttactatgtgccaggcacgaagtgttttctgttcactatcccacttatttctcctttaactcctattatcctatttacagatgggaaaaattagaaacaagtaagttttgtaacttgttcaagagccacagtattaggcaggatttgaacccaggtctatctgaaggcaaagcccatattcattacctctactctaaaaacctccaattagaaaaagtagttttaaaattattttcaaagtatttaccatgcacatgtgaaactggatttatcagtgtaataagtgtgagcaggggatcagcctgcattctggttaaacagaataattaatgtgaaggcccagattagtttgccaag

SEQ ID NO: 163117 - DNA, 458 bp, Homo sapiens
caacccccagtctctctactcacctgcttccactagccccagggcccttgcacaggtgcttgccctgtcctgaaatgttctcctctgcccctctgtgctgctgttagaaccaactggcaggttccttatctcacccacagcagatccggctgcatgtcccagagtgtgtgtgactgcctccagaatcacctagaatcacaccttcagccaatcctccccaatcacccagaacttccaaccatgaccagggaagtgtatccatccacagatacccacctgctctccggggctgccaaggagaaaagagagaggctgacataggggaggaagaacaccagcctttatctgtgcccaccgtatgcagagagttctacatacacggcctcatcgagtcctcactgtgcagatgaaaccactctggttcagggaggttacaggaaccagtcttgaaccaagag

SEQ ID NO: 163118 - DNA, 413 bp, Homo sapiens
aacatattgattcataacactaaatgtggtgatgtgtcatttcaatttgaataggccactttacctcttgcattgtcaaactgaagcagcattacctaaaagtgtgtccttattctaggttaaggaggttaaaagttaaaggttaaggttagcttagaagcatcatctgcctggctgcttgacttgaaactgatcaatgtaatgaaaatctgttttacagatgttgtttttaatatatttggcaggatttaggcagctttaacattagatgtatgctagtaaaaaatatttatttatttaaccagaacaacacctttccttttatatttaaggtagaaggcttgtgggttatggtattttggcaaagaacccagaggcagaatgtgttgatgatctttccatatggactcaaa

SEQ ID NO: 163119 - DNA, 160 bp, Homo sapiens
agaagtgtggaatgtttgttcttcttgtggtgtgttagggaggagtgtgtccatctgtcagtgtagtacagccctccatatgtggattgacagccagctcattctaatatgtttttataatacttgggagaagtgactgtggttgttatggttgaaggat

SEQ ID NO: 163120 - DNA, 365 bp, Homo sapiens
atacacgtgatgcggctgctaccataggagtcgtcgactgtgggtaaaaaagcaaccagaattacaatgcttttccttcttgtggtctgtactttctcctcttctctcgtgaaactggaatgaatggggcccagagaaaacgaagcacagaacaagagaaggatagcaagaagggcccaaacaaaacaagagcctcaaatgggcaaagcttttgttttggggaaagggatctcggttaatgctcctgtttggtagaaatcagacataacaggaatgaggttagggagtggtaaagtggtaaggggcttggctccacttccaactcagtgtttttggttaacatgaataggtaaaccctaaaggat

SEQ ID NO: 163121 - DNA, 395 bp, Homo sapiens
aatccaagttcaatgtttaagtgacttctggatacttaaatcagtagactgaatgtcagttctacaaggtcagagacacagtctcttggggtcttttcttcttcctttttctattcagtgctgcagccccagctcctagcaacatgcgtggcacacggtaactgatgaacaactgctgactacaggagtggcgtggctcactcacagggccacagagcagcagcggatttgacaacttctggtgctaagtgtcatgtttgtgataaagcagtagagaaaaaaacgaattaaccctaagtaaagtgcagggctgaggagaagacagtggttaaagcaccaaagtctcctcctagagagagaaaagctatttttttattttctttatttatatatct

SEQ ID NO: 163122 - DNA, 545 bp, Homo sapiens
cagcttcagtgtctttatctctgttttctgttgttacaaggaatggtggtaatatttgccaagtgactagcaaggtttataaaggggtcattgatattgtcattattattattaattacttactcactgctttggcagtttatgtcagcaaggctgtctgtaattgagtcaaccataatagtaaggagatccatgctttttgactttggagatgctgctcagtgttccagactgagtatgctgatgtgggaggggactgtctgagttcatcctggccatgggctccagttctttaatcgaaaataaaaaaaaaagagggggaagagagagagagagagggagggagagagagagacaaaaaaccgccaggaaaactgtctacagaggtcatttagaaatacaatgccacgaacaatatcacaaaactggtattatttaaattctgacttggccagtgttagactcgcagtgttattttagcaatttgaacaggcccaggagtgcaaatatttgtaattaaaggcttccaggagcagccctgtcaa

SEQ ID NO: 163123 - DNA, 400 bp, Homo sapiens
tgagaagataaaatttgagcaaaggattggaggaggtagggaattagttacatggctatctaaaggaaggacatttcaggcgtggggaactgcctgggcaaagatcctgaagtgggcgtatgtctggcatattcaagggatagtaaggaggccaatatggcaggagtagagtgaaccaggaggaaggcagtaggagatgaggttcacaggtaatggatgacagatcaagacttctgggctactgcaagggttctttctctaagttagggtttctcagtcttggcactgttgacatttttgatcagatgactcttggttgtgggggaatgctgtgtgcattgtagggtgtttaggagcatcggtactggctagcatccaatagatgccagttccaccctat

SEQ ID NO: 163124 - DNA, 534 bp, Homo sapiens
ccacctcggactcccgagtagctgggaccacagggaggtgccaccgtgcccagctaatttttgtacttttctgtaggacaaggtatcatcatgttgcccaggctggtctcgaactcctggactcaagtgatccacccaccttggcctccgaaagtgttgggattacaggtgtgagccactgtgcccagcctaagcatccgtttttaaatttaaaataagatggtctctttttataaaaggaatcataattataaacaaaaagttcattggttagtatgggattgcagtttgcctagaagacgttttatatacccctgactaaacagtagaattgtatgctgaccaagatcgtcctcatctattcagtgcattatgatatgacatttatggttcctggcaagataggtatgttcagctgcactggagacatggctttaaacttattcggaaagggaggtgtccagaatgcaaacagctcttaaaaagtatttggaaataatttattcaatataaggtcatctgatcatttgatta

SEQ ID NO: 163125 - DNA, 278 bp, Homo sapiens
ccacctcggactcccgagtagctgggaccacagggaggtgccaccgtgcccagctaatttttgtacttttctgtaggacaagggtttcaccatgttggccaggctggtctcaaactcctgacctcaagtgatccaccgaccttggcctcccaaagtgctgggattacaagtatgagccaccgcacctggctgaagcttttctttatagatgtcagcatctataaattggtaacagagagatagcacctactttataggagtgtgggtttctctgggtt

SEQ ID NO: 163126 - DNA, 237 bp, Homo sapiens
gtggaggctacacttgtcagagtggctctggctgggatgagttcaccaaacatgtcaccagtgaatgtttggggtggatgaggcagcaaagggcggagatggacctggtggcctggggtgtgggggcaatgaatgaagcgaacagattttcgttcattttggttctcagggtttgttataattttttatttttatgggctttggtgagggaggtaggtgtagtttgtgttatatttc

SEQ ID NO: 163127 - DNA, 404 bp, Homo sapiens
gtggaggctacacttgtcagagtggctctggctgggatgagttcaccaaacatgtcaccagtgaatgtttggggtggatgaggcagcaaagggcggagatggacatggtggcctggggtgtggacctggcctcagtggagcagcacattaacagccaccggggcatccacaactccatcggcgactatcgctggcagctggacaaaatcaaagccgacctgcgcgagaaatctgcgatctaccagttagcctcctcttcctctatccacttaaaggcacaagtgtattccctattttccctaccaaaagttgggaccccttcttaactaattccactttctcatcctcctaatctacttgttggaagataattctggcatttcttcagaaatgggtaaaagaga

SEQ ID NO: 163128 - DNA, 474 bp, Homo sapiens
agctgagcatgtgagggatctaggttgtgcccttcttatgagactctaatgcctgatgatctgagggtgaaacaggaacaggttcatgctgcaactatcattcccctcttccaggtccatggaaaaattgtcttccacaaaactggttcctgataccaaaaaggttggggaccactggtgtggcacatacagtggacacaaatgtactgtgtgctaatcatgggagaccacaaagaactgctaagtgtttaaagggcatggcaaaaagagaactctactatcccaaatctgccttgaaaccaaatgccagtcacagtaaacattattcgtcacagattttgcttgggatccataacctaggagtgctttgtaggatgatctagatagcctaggactttttaacgctgttcagaggcacttttgtcttcccctccacgagtactctgtagcgagcaatagagcgctcatccccag

SEQ ID NO: 163129 - DNA, 578 bp, Homo sapiens
tacaaaaaataaaaaaattagccaggtgtggtggcacatgtctgtagctccacctactcaggaggttgaggcaggaggatcatttgagcctgggaggttgaggctgtagtgagcccagaccatgccactgcactctagcctgagcaacagagcaagacctgtacctaacaaaataaaaataaaaaaaacaacacagatgtattattgtatagatctggagatcagaagtttcaaatgggttggcaaggctcctttccttctggaggctctaggaggagaatccatttccctgtctgtctcagcttctagaggctgcccacattccttggatctagcccccacatcactctgacctctacttcatcacatcaccttctctccctttgtctcacatttcctttttttataaagatccttgtgattacattggggacatcagataacccaggataatctcccaatttcaagatccttaatcacatttgcaaattcccttttgccatataacgtaacagtggtaggttctgaggatttgcatatggaaataatggaggccattatttagtttaacacagtca

SEQ ID NO: 163130 - DNA, 425 bp, Homo sapiens
aagtgagagcgagggaggggtgcttcctggctgcctgtgcccacctgctgccatccgaattcctttgatgtttggcctgctgagtcatctgcaagtcattaccccgcaacagttgctgtttttcctttttaacaatgcatttgtttcgtaccattgagccattatgttccgggccaatggattttgtggtgtttccccagctacacagtcctggggaatattttaaatgccatttaataaaaagttctacacaatgccgttcccgtgacatgttctgctcaaagccgtcacgagctggtattcaaggggatggggttcggctgaggacccttttaggtgtgactgtgctgggcagaacgccctggcatggctccccagggcctgatgggactgtgcctgtgctgggcagtgccccctcccttggg

SEQ ID NO: 163131 - DNA, 412 bp, Homo sapiens
tgatgttgataaaaacaaatttaatataaaaatgagatacaatgtatagagacctaaccctgtcaacagcaactaaactttactttcatgttagaaagttttgtgccatgtagatttatggaaaatgtgcttaattgcctctagaaaataatgaagaggcttcgtcacctccatagaagatcctgtgacactagcctaattctgacacatggctcctgttttccattttgtttgtttttttatgctgatcctctctccagagatgtgatgtggattgattaacttgtaatataaagttctatggtttctgaaaatgcagagcaaatagagatgaagagtggtttgtgatttgttattaaatgatcttcccttctacatttaggactgatttttactgtagattttttttttt

SEQ ID NO: 163132 - DNA, 134 bp, Homo sapiens
tttttcagcccagggctgtctgatgatgcttctgccaggtgccagtgttctctgccagtgctgccagacacaggtgcttctgaacacttgactggtgattattgcaactgggagctgagtctttcaccttttaa

SEQ ID NO: 163133 - DNA, 246 bp, Homo sapiens
tgtgtttagagatgatggacatgtttgaatgctggaggagtgggagagactgaagatgcagaaacaagaaagccgtttcctcacggggtgcgaagcaagggatcctcagctcagaggtcctcgttcacccagcaagtgacttctgagtcagggcctgtgctggggcagggagctgtagcccagaactcttcctgaaggtccagatccactggcctgagtcaccactctccttgtccaactcataga

SEQ ID NO: 163134 - DNA, 348 bp, Homo sapiens
gaaactagataattccaggtatgtgaaagatagctcactgtgtcctcgtaattctctcatcttgctaattgcattgtatttgtttcatcatcctatccctcagattagttccttaccctggctttactatttattaaagatagtagaggcatttcctatattaaaactttttgaagtcaaaatggaactaatataccattcttccctatgaagcagtcccttgccaagacttcttacttttacgtctcttcacagcctctcatgtcatccctttctttccatttccattgcttccactctagtacttacccttatgcttgtaaacctgaaataggatagtaaccttga

SEQ ID NO: 163135 - DNA, 304 bp, Homo sapiens
ggtttactctgaagggtggtcagggcttaagcagattgggaggaaggacaagggcgtttcagggctattaggctagtgaagaaggctggagagggcagaacttgctctcagcatcagcaagtaaaccatctgactggttcataacaagagcacagggtaagcctgggaagctaggtttgttcattagcagtaaggtcaacttaaggtttgaaaacaactatttttctttttaaaaaatgagcctctattgtcttccagccttatgccccagaaagaaggtggggaggaagaacctaatgaaaaa

SEQ ID NO: 163136 - DNA, 167 bp, Homo sapiens
ccgcctctatcttcctgggattataggtacgccaccaggccctgcttactgtttgactttgagcaagtgtttgactttgccaagccttagtttccttcaatgtaagcctactgtctagatgataggcagttgggtgctgtgaaaactaaatgagggtaatttgtatg

SEQ ID NO: 163137 - DNA, 640 bp, Homo sapiens
tgcaggtgtgcagggtctggtctatatgaccacgggacaggtcccaggtatatgactgacaggcctgagggaccagaagcccttctccttacccaagcccagatggagaaaacttcaactgtgagagccctcctttattcccaaacggccatcattgtttcccttccctgtggctctttataaagaaatctgggggagtaagaataaatcgtttctagatcaaagagaaacagcgaaaaccaggagaaaaggcggtagccaatgtacccactccattcagatgaatgcagtccaaacagaaagacagccagtcatacatcactcagtgacagtgcaatgcaatacttccaaagatctgattaggcacttctgtttttcttattttaagcttatgctttacaaagtaagttgttgtttttcgttttgttttgttttaaacgaatcgcctttaaagtagtgggggcaaaacaccagagcttaggcaacccctggtggaggcttttataattcctctactttttggctttgacagcatgagggttgcctgctctaagccctgcctatccatccacccagaactgaagtggctgaatcattgcctggcatgacaggaaagtcttgggcttgaggggaggaaaaa

SEQ ID NO: 163138 - DNA, 499 bp, Homo sapiens
ggggttctctggcgctgggctcttcggtctaggtagggatgtgataccgacccaggaaaggtgtgttcatcagtttggttttgcaggggacacacttcagatcatagcagaaggtgtagccaagttaccattttgtgatttagtttaatataaagtgtgtctaattatggtttcttaaatagtcagttgacagatgatgtacataatgggaaaatacttaaaattgatttatgattcacagtacatccagaatttgctgttagaatagctctttgaggactttataattctcactgtctttgtaatatgtgaaaggtcaaaatggtggttcttaattggtattattgtcttagctatctgaaaccagcttctgggtttcctgaggcacggcaggaatgtttccctctgcaaaccctgcttctaggtgatggagctttgccacattttctctttcagttgtgggatagccacatctctttgttagttggttttatctgta

SEQ ID NO: 163139 - DNA, 297 bp, Homo sapiens
atgtccatttctctccaaccatcggctcaagtgacaatgataagagtaagtagacgtggtacttacaacccgtcacttaaaatgaccctcaggagaattctgagcataccttctgaaaacagccatttgcattctgcatatttggagagcagacacctactgtcctcagccaagagatcggaatgcacatcattctcatcctcctcctctgaacagttaccgggcagtgtcagggggaccaaggacagcatttactttccagtgagttatccaaataccatcagccaggcctcagga

SEQ ID NO: 163140 - DNA, 904 bp, Homo sapiens
cagagctcatcaggtaagttcaaagacacacctgtcttcccagcattgggaactggattggggtctactcagaggcatgatgttgaccagattttatgaaacacccaagaatgtagagaacattctgtctttaaaaccttgaattcaaaacatatcagagagagatttacttcccttatatggatgtctgtgttctcattaggagagaaacaatgaaaaatgacttttcacaatgcctgccttagccgtgaggctcagccaacccccacttctatgtctcagcatttaaagggcaattgaagtcccactccatgctatatactctcaagaggttttctcatttacccttcagaacagctctgtaaagatggtatggtcagtcccatttcacagatgactaagctcaggctcacagagcctaagtcacccctccaggtaagtggcagggttggaatgaggttctattcctcaccctccctagagaaccctgagcagcttccgttttagaagatgggtttccagggcttgagaaatggtcagattcccccctgatattgtggccccacaggtcctcactccacaacccctctgggtgatgaggaagacagaagaggtgaaatcctgcgctttgtgccatgagatctgggtgtagggccacaggagttagctaatccttgaagtggtgagtgggctcaggcagaagctcaagtgttggccttgggacaggtgagctggagagaaggaaagtaacatgcactgaaccactgtaagcaaatgcaatttacagctcatctcctttaatcctaacaaccatttaagatactcatcattctgaccattattcagatcagtgtgctgtctttaggggagtttatgtaagtcagggaaacaacctagttgtcct

SEQ ID NO: 163141 - DNA, 533 bp, Homo sapiens
tcgtttccgaagggctttgtatttccacagggcttgctgtccttttatttttgtcatctcaggtctcatcattgtcatcgtggttgtcttttctgaggtgaacgctcccttgtttattttttcttcctgtcatttgcaatgtgaatcatgctgtctttgttggggttattgttctattgctttatagatttgttcattccagttttattctcagacacacaacttctgcttagatagttcagagttcccataatcctgtcttagaaaaaggctgtggtcttagggaagtggaatgcaatttcaatttagaaaatggttggaagcaaatgctcccaagaagctcaaatttcagggtgcttttaaacaaagttcaagagaattctcaggcctctctgctgattgaattgtctttcttggctaatctatttactcaatcaatgtcagatagtgcaagggtaattttgagtttgggataaggattaaacgatcaatccatgtcctgttttccctgtggaaaagtaggtaccgggagg

SEQ ID NO: 163142 - DNA, 501 bp, Homo sapiens
gctaaagtagagcctggggtgatggtcagggtagccacttgagcggccaaccatctcagtttgttgggaaaccggcagggctgggacaaggagttttcagtgcttaaactgggaaagttccaggccaactgggatgagctggtcaccttagtgaccacagatgtgtacttgtggatgtcccctgaaaagaatcccattctacatcccccaatcaaaggggtcaggatctagaaccgtttttagacctagataaggattccaaaaggtgggggcagagaagtattggggaacgggctaggaatagctagcagcatcttagaaggagcccagacttggcaaagagaaaaagaatatgtggcacttctctgaaaaattattcctgtcctctaaatattcctgccattcctcataccccaatggccaacctccaaacttccctgactgagtgcttgctcctggctccttttcacgtcaggtggcctttgcagggaggatcagatg

SEQ ID NO: 163143 - DNA, 1852 bp, Homo sapiens
aagcgtcattcagtcattcgatgctgcaatacttcaagagggcggctgtgggccatgcaccaaccccacccacgttcacccgggcccttccagctccaatccagggggtctggaggatgcctgcaatgtccccttttacactaaagaaaacaagcgccagtcaggtggaagtggcctctaactagtcactccgctgggcacatggtctctgtagtcagagactcccctttgaccttgcccttcactttagaaatgcatatcacaggctacttcatccagaccagaaaggactccagtgttttcagttgggagaaaaagccctcatcagaaatgggatcattttcctggccccatcagcccttcgaaatttggcccagctccctaaaggtgtgtttcaggaaagggtgcaggcacgcctgtaacctggcccacacctacaagcttggggctccaggctctgaatatctggggacgtgcagtgtcgggtgacttcttcgtcaccacgctgtgttccttctccgagtgcccacctactctgtccagcttaaaggatgaattgcacagatgcaaacatttcccacagaggagagtgaggggcatgccaggatcactgcaagggtccctgcagccaggtttctagggatcaaggtctctacaggactctcccagcaaaagcaggtcccctcgtggaatgggtctctgagtgccctgttgaatatattctccatgcctgctttgaaaaaatcccctttgtctctctttggttcatcgtgatgaaacctcttttaattataccttcactggtgttctgcacggcgcatgctgcctgataaatggagattgctttgctcttttgtttatagagaaaaattaaaacatttcttctgagctttgcatatttttctctaatgccttttcaaggagacaagatagaaggttttacatattatgtgcttttctccctctgacttattctggacggaggctggtgaaagaattaagctgcttgtctctgctcagaaagttgcacatgtacttccggctgccttctgccaccccggccacctctctagacacatggcgctggagtgatgcctgtgtctctgagagccacttgggacatagcatctcctccatgggctagtccagacaagccttccagaaagagcttctctgcagtgttgatttccttcttttttaaaaatatgaaacaccaacggtcattatttctcctaaatgtgagccagaaacttatttctcagcaaagggctaaggtcatattctgtcctcaacagccagggtggccgagggccctggggaggccttttttgtttcgtgttaactttgacattagcaaaacttaaccaaggctccgatctcccttcaggctcttgagctcttctccccgggtccactgagcagggcatgcccttgacacccatccaccgttccttacttctgaccccataagtgcaatgaacattagaaacgatcattctagcccacagctgagctgggcttaaagaggcgagccctcctagagtttgcaaagaagctgagtctgggctgggcacagtggctcacgcctgcaatcccaacactttgggaggccgagatgggcggatcacctgaggtcgggagtttgagaccagcccggccaacatggtgaaaccccgtctctactaaaaatacaaaaattagccaggcatggtggcaggcacctgtaatcccagctactcaggaggctgaggcaggagaatcgcttgaatccgggaggtggaggctgccgtgagccgagatcgtgccattgcactccagcctgggcaacaggagtgaaactctgtctcaaaca

SEQ ID NO: 163144 - DNA, 452 bp, Homo sapiens
ttggtttttaccagaaagagaaggaggtaagaacatccttatcggaaaacccatactgaacaaagtaagatggtatggatgaaaagaaattctctgtttaggtaaagctgacaagacagctgttgtggtgtgagctttgggtttgttggagccttttatgactatttctgtgtctttgcaaacattcttgttagtacagtgctgtgggtataagtacaggctctggtgtctgatggtctaagttgacataatcaagctgtgtgactttggggaagagacttaacccctcttgtcctgaagtaggtttgcctttcacatgaggattagcatagtagcacttggggcagccgtactaactgcagagctccatgtgaacacttaacgtcaagcctgctaggaagctgatgcttatgcttctgtccccctagatgtggccctgggtctccctgtgt

SEQ ID NO: 163145 - DNA, 715 bp, Homo sapiens
  misc_feature (1)..(1): n is a, c, g, or t
nctaggagcctcctaatgcagtcttctgcacagtcctggggactgactgactgaatcacacctctggggctgggggctgctgacatgtgtgcctttccttggctgcttcttctcctgctgctccaggagggcagccaaaggagactctggagatggtgtggatccgaggaagtggttgcggtccttcaggagtccatcagcctccccctggaaataccaccagatgaagaggttgagaacatcatctggtcctctcacaaaagtcttgccactgtggtgccagggaaagagggacatccagctaccatcatggtgaccaatccacactaccagggccaaatcctaactatgcttctgagaagccttcaacagccttctgcctcctggccaagggattgctcatcttcttgctcttggtaattctggccatgggactctgggtcatccgagtccagaaaagacacaaaatgccaaggatgaagaaactcatgagaaacagaatgaaattgaggaaggaggcaaagcctggctccagccctgcctgactgctccttgggaaccccagtcctgagcttggtttcttcccagcacccagagaatccttcctcagctctcttctttccaggggaaggaggtgctcaggggtgggtatccagagagccatacttctgagggaagactggctggcaataaagtcaaattaagtgaccacaac

SEQ ID NO: 163146 - DNA, 988 bp, Homo sapiens
  misc_feature (1)..(1): n is a, c, g, or t
nctaggagcctcctaatgcagtcttctgcacagtcctggggactgactgactgaatcacacctctggggctgggggctgctgacatgtgtgcctttccttggctgcttcttctcctgctgctccaggagggcagccaaaggagactctggagatggtgtggatccgaggaagtggttgcggtccttcaggagtccatcagcctccccctggaaataccaccagatgaagaggttgagaacatcatctggtcctctcacaaaagtcttgccactgtggtgccagggaaagagggacatccagctaccatcatggtgaccaatccacactaccagggccaagatggctgtcagagccccagatcactgtgaactttgagagttctggggaaggtgcctgcagtatgtccctggtgtgctctgtggagaaggcaggcatggatatgacctacagctggctctcccggggggatagcacttatacattccatgaaggccctgtcctcagcacatcctggaggccgggggacagtgccctctcctacacctgcagagccaacaaccccatcagcaacgtcagttcttgccccatccctgatgggcccttctatgcagatcctaactatgcttctgagaagccttcaacagccttctgcctcctggccaagggattgctcatcttcttgctcttggtaattctggccatgggactctgggtcatccgagtccagaaaagacacaaaatgccaaggatgaagaaactcatgagaaacagaatgaaattgaggaaggaggcaaagcctggctccagccctgcctgactgctccttgggaaccccagtcctgagcttggtttcttcccagcacccagagaatccttcctcagctctcttctttccaggggaaggaggtgctcaggggtgggtatccagagagccatacttctgagggaagactggctggcaataaagtcaaattaagtgaccacaac

SEQ ID NO: 163147 - DNA, 1124 bp, Homo sapiens
  misc_feature (1)..(1): n is a, c, g, or t
  misc_feature (463)..(463): n is a, c, g, or t
nctaggagcctcctaatgcagtcttctgcacagtcctggggactgactgactgaatcacacctctggggctgggggctgctgacatgtgtgcctttccttggctgcttcttctcctgctgctccaggagggcagccaaaggagactctggagatggtgtggatccgaggaagtggttgcggtccttcaggagtccatcagcctccccctggaaataccaccagatgaagaggttgagaacatcatctggtcctctcacaaaagtcttgccactgtggtgccagggaaagagggacatccagctaccatcatggtgaccaatccacactaccagggccaagtgagcttcctggaccccagctattccctgcatatcagcaatctgagctgggaggattcagggctttaccaagctcaagtcaacctgagaacatcccagatctctaccatgcagcagtacaatntatgtgtctaccgatggctgtcagagccccagatcactgtgaactttgagagttctggggaaggtgcctgcagtatgtccctggtgtgctctgtggagaaggcaggcatggatatgacctacagctggctctcccggggggatagcacttatacattccatgaaggccctgtcctcagcacatcctggaggccgggggacagtgccctctcctacacctgcagagccaacaaccccatcagcaacgtcagttcttgccccatccctgatgggcccttctatgcagatcctaactatgcttctgagaagccttcaacagccttctgcctcctggccaagggattgctcatcttcttgctcttggtaattctggccatgggactctgggtcatccgagtccagaaaagacacaaaatgccaaggatgaagaaactcatgagaaacagaatgaaattgaggaaggaggcaaagcctggctccagccctgcctgactgctccttgggaaccccagtcctgagcttggtttcttcccagcacccagagaatccttcctcagctctcttctttccaggggaaggaggtgctcaggggtgggtatccagagagccatacttctgagggaagactggctggcaataaagtcaaattaagtgaccacaac

SEQ ID NO: 163148 - DNA, 839 bp, Homo sapiens
ccaagcctggccaaaccctgtgtttgaaggagatgccctgactctgtgatgtcagggatggaagaatacaccactgtctcaggtgaagttctacagagatggaaaattccttcatttctctaaggaaaaccagactctgtccatgagaggagcaacaatgcagagccgtggccagtacagctgcactgggcaggtgatgtatattccacagacattcacacaaacttcagagactgccatggttcaagtccaaggcagccaaaggagactctggagatggtgtggatccgaggaagtggttgcggtccttcaggagtccatcagcctccccctggaaataccaccagatgaagaggttgagaacatcatctggtcctctcacaaaagtcttgccactgtggtgccagggaaagagggacatccagctaccatcatggtgaccaatccacactaccagggccaaatcctaactatgcttctgagaagccttcaacagccttctgcctcctggccaagggattgctcatcttcttgctcttggtaattctggccatgggactctgggtcatccgagtccagaaaagacacaaaatgccaaggatgaagaaactcatgagaaacagaatgaaattgaggaaggaggcaaagcctggctccagccctgcctgactgctccttgggaaccccagtcctgagcttggtttcttcccagcacccagagaatccttcctcagctctcttctttccaggggaaggaggtgctcaggggtgggtatccagagagccatacttctgagggaagactggctggcaataaagtcaaattaagtgaccacaac

SEQ ID NO: 163149 - DNA, 492 bp, Homo sapiens
gaatgaggtcccatgcacagttgaaggatggtgaaggtggagaattttactgaacaattaaaatggctctcagtggagagggttgctggagaggagactggaagggcaggtagtcttccccatagttaagttgtctcttccctgaagtagggttgtttccccatctactgactgagtctggggtctttataggcacagtctggggagtgcatgctgattggtttgtgagtatgcaaaataggttaaagcaaacacaccactcaaaggtgggcataacagtgtagaaaaccaattaggaaagagtaggtatatgtaaaataggtaaagggtgggaatcaatcagagaaaagcacgccaaatgggagaacaagttctaaatctggtctgaggattaaacttgtagcttggctttcaggctttggcttggaggtgggctgttgctgtgtactcgcccctatctgcctaggcacttggctgcctcctgtcactgtc

SEQ ID NO: 163150 - DNA, 417 bp, Homo sapiens
gtttaatacatttttattaaaacacacatatcttccacactagcacctgagtaactggaaatcttgaacaacatggagtactctcggaatagctgatattcgatagttaaaaaggcacataaccactatggtgacatatgatgaaataaatactgctcctgcaagaacacttataaaatgaaggttttatactcattaggacatttcctggcctgccttcaaaataacaaagccactgggcttctaaattcagtctaagtgccattactgcacaaaagtgaagaaaggaagggtgtcattcccattgagttcccatcaagcacgacaggaccaaatgtgcccacatcaagcgtagatgaacatgttacttgagcctcttcccctagagccctcttcccctagagccaggagtcaccc

SEQ ID NO: 163151 - DNA, 502 bp, Homo sapiens
agaactttggcatttatccacttacactgagtaagcttaaggtgaaagaagaaagatcttttttcttaggggtaattactaaatttctactgtcataatacaagtcatttttttcctccaagataaagctaaacagttataggaaactgatccaaaaaaagattcttgctcttcacattaaaacatatatctttactgtactctgtggcacacagtatcaagacatgaggactctgaatcatagtgcttatttaggaaacatcaatgatgatactcaacatgatgataaagtctacagaatgcttggggctatcacactagcatctgtaaaacatggtacaacatttagaaacatttaattaatgccacataatagcacatatttgccttattctcttgattccaaagatttccacggagcaccacatctactctacacaacaacacctctttttggattttctgtggcaatgtgtgtttatagtaaagttcaggaagggat

SEQ ID NO: 163152 - DNA, 203 bp, Homo sapiens
cggaagcaggaagagatacgataaggtgcctaagcctaattctagcatcaaacctcttcgtagcagatttgtctctgcttctggaattaacagaaatttaatattagctgattttcttttatatatgacctttgttcttcttcctatttggaactttctcttttgagggtgacctatttttaatttgaagcatttgttttgtc

SEQ ID NO: 163153 - DNA, 967 bp, Homo sapiens
cattcatttaaaaaagtcttttaattttatttatgtcattttcaccaggaaaatgccaacccactttgatatgatagtgtccataagttccatatccaacagctttaactggtttcctaacctctgtcagagaatattaggactgcccctatcatgttttcctgtgttctttcggccaatggaaaaatgtaatttcaaaacatgtatctattattatttttgctagacagatgtcttcttttctctcttcaaatggccaaatttcatcaggttttgacttcaagaaatacagctacactaagttccctctcattaaacctgcattaatgttgtgcctagtgcagattaagaagagaaaatccaaaaataaataacaccatccttaccctctgggagctcagtctcaaaactaaatttcctcttaaaacaacaacaaaaggatgatgcattgtctggatttctattttttctttacatttctgtatttcccatattttctacagtgaacatgcattaaaacagaaaaaaactatatacacataatggtggaggtgaaaaaaaactcaccagaaagtaattaagtctcagattactcaatggaaatgcttgtgaaggtagcacgatttctaaaacactgtcacatacattgtctcaacgccaagtaactctgtggaaggtaggaggaaacatcctcaatttaaagacgaagaaacaaattaaggcacagagaaattacatgactttgatttcctcagggtcatgatgttaggaaatgacagtagcagcatacaacctaaatcttaggaggtccaatagacttaactcatccctctagtctcaatgatcagactgacaccctgctaaaagaaacaatgggagcctgggagggtaaacgggaagctagaggattgcagaaaacgaaacagcagtaaaaataaacctttagggacttggatagggggaaaac

SEQ ID NO: 163154 - DNA, 602 bp, Homo sapiens
gagatccaatcagggagaacttatttcaataactgagaaagaagaactaagacaataacacaataggtaatatacaatttctgaagtattcttgacatggataattttgtagacccttgagtttttttaaaataaatataaggaaacgggaaaaaattcatcttccaatacccactggaaaagaaaataccgaatatatatttatgccaaaataaaactttatcaacattttctggcagagctcataaaaattaattatttaatgccagtgtacactcccacaaataaagataaactcttcagtgccaacactacatcaatgagaaatcaattaatcaagaaaggcttttaaacaaagatcagataaggttatgtcacaggacatatactaagcacagagaaattgctgaagaaagtgcctctgttttgatagcaggcttttattctcaatctttggcaatgacgtactaacgtaaaaatgggcttgtccttgtttattggcatttgctatatttgaccttaggcttaaaaaaaaacactcacccatatacctgaaatctaatggcatataaagttggatggctggcaaaggttataatccc

SEQ ID NO: 163155 - DNA, 569 bp, Homo sapiens
gccagaagatcatgcctcaggtactctagcctggcatagacatattcgtagactctggctcataaagtaagaacaccggggattctctatagatctaactgtaaggatgcgaggcatatgagatccgtccgccgttacccaccgtcgtgaatggtaccgaatatatatttatgccaaaataaaactttatcaacattttctggcagagctcataaaaattaattatttaatgccagtgtacactcccacaaataaagataaactcttcagtgccaacactacatcaatgagaaatcaattaatcaagaaaggcttttaaacaaagatcagataaggttatgtcacaggacatatactaagcacagagaaattgctgaagaaagtgcctctgttttgatagcaggcttttattctcaatctttggcaatgacgtactaacgtaaaaatgggcttgtccttgtttattggcatttgctatatttgaccttaggcttaaaaaaaaacactcacccatatacctgaaatctaatggcatataaagttggatggctggcaaaggttataatccc

SEQ ID NO: 163156 - DNA, 215 bp, Homo sapiens
caaaaactcttaaaatccttggaatctccaaactggtgtctttttgttcactattagcttgactggtgcctggggactcctggatagcctcaggagccggggctggtttccaggggaaccaacctcctgattagagggttggactgaagtcccaactctcaacctccagggagggaagaggggctgtaggatgagctgaacactgtattagtcca

SEQ ID NO: 163157 - DNA, 455 bp, Homo sapiens
ctggcttagctgaagtggggggactagcatgccaggcagagagcagaaaatgcacaggcctggaggtaggttcaaggacctgtgggaaggccagaggaggtgaatcagagagtgagtcgggaggccagaagagggttggaaggaaaggataagtcactcctacctgcacgccccccttagagatgtggaatcacccaaaggcactggggaaaccactggagatgctgaagaggctcagggatgtggacagagatttaaaaccacagattgggcaacggagtgggatggggcagacatgggtgtagagatgcccgctgggagataagtgccaaagttgaggggtagcactggggacagacaggtggaaaaggggaagatagggtgtggggactgactgggagcagagactgtgggagagagagggggcgtcaataacagacaccatgcttctggcc

SEQ ID NO: 163158 - DNA, 479 bp, Homo sapiens
taaaagcaaatccagttggtaatataataccagagcagaactagtccaagagactttacaacacagtaatctgacagtacatccctattgtgaaatacccttaaaaactgaccccaaaatgtggccaaaagaaaaatcttaactattttcgtaatcatattcttattggacaaatgggtactgttatgctaaggctgctgggtcatagtacgtgagaaagcaatcagttaagtatgtcagtgtttgttgggacccaggactttgtgcataggaaaaaggatgaaataaacttttaaatcttatagtccagaatacaaactggaagaataaaagcaaactcactgaattttttatctttaaaagaatacggccaggcgcagtggctcacgcctgtaatgactttaacagtggtttaattatatgcacatatagttgtcattaattttataattataggttcagtggtaaatgtacaggtt

SEQ ID NO: 163159 - DNA, 233 bp, Homo sapiens
gcccctccactgagcgagggagctgctctgattcagcaggactccctttccaccctactctttgttttttgtgtttttttgagacaagttcttgctctgtcacccaggctggagtgcagtggcaggatctcggctcactgcaacctctgcctcctgggttcaagtgaatctcatgcctcagctaccagagtagctgggattacaggcgtgcaccaacataccgggttaatttt

SEQ ID NO: 163160 - DNA, 155 bp, Homo sapiens
attagatttaagaaaacaccatttccagattttttttctcaataagacaatatttgaatatttctcgtgtgtgtgtgtgtgtgtgtgtctaagggacttaccccaagtatagcatggttgcatcatgaagctaccatgctatacttggggtaagt

SEQ ID NO: 163161 - DNA, 311 bp, Homo sapiens
cggagtgtgctgggtgtctagaggatcctataggcgctaggtagtggaaatgccatactgaccttgtggcacagaaatgaagacctcacggtggggtggaagggcaccctctctggagtgagagtgaagagttctgagctacccttaaagggagaagggaattgagtgccccccagggcagccgttctgcaccaggctcctctcctatcccctatcctgttccagaaaggacccccccgcccagggtgatctcacacaggagacttccattcacatggaatcagatacacagcgtggcacaccaacaccag

SEQ ID NO: 163162 - DNA, 513 bp, Homo sapiens
gttcaaaatgatttgattatcatctggattcagaaatcttttcattgtacagagatttcattgtcattgtcgttgttgttaactgatttttaatgatattgatttagaggcatttgtcggtagtttttaaattactatatagggttgaatgtctaatttctataatgtgtggatgcccatcagatatttagtgcattctatatttagcccaagtgtgatcacaatttattttataactttttatgtgttacttacatgactcaatatgcatcttacttaagaaattatgttgtgatctggagtgacacaaatggattgagataccacatccattaaaaatataagtgaatattttatatttaagttgtttaaatatttgcacattattgaaaacatagtactaggaaatgaaggcaccatttaacaaacgtgttctgaatcataattttcatgagtttgtacgtgaaatgttaatgtttaaaacacccattttgaaattattaaatacaggta

SEQ ID NO: 163163 - DNA, 687 bp, Homo sapiens
attttcaaattgcctctaaatgcctccgttggaaaatggcactttaagttgttttacgtgtcggagacagaatacttaggcttacactcggggcaccaaacgcaaaacgctcagggcttgcagtgaacctggtgagtgtgccctcgggtgtcatttacagaattggtgccctcctcccaattggagtttgacctctatcagagataatctcttcactcctttaccccaatgaggagctggtcgtttgagatcttttcatccaccccaaaggcacgtgggcgcgtggggaactgggatagggtgagggctggggtggctgcatcactatgaggagacgctgatgtgcttccctccttcccctccagcgccttgtactgagctggtgctcggcgacaaggagcagatcggtacctgggctatttcagaggacacgatgtctcctatgtaccatctataacatagatgttccgtttgtattatatgctgtttaacatataaatatgtattatgtggtttcatatcataaattaatatttaacatccagttccgatataatgttgttatattacttatctaacaatgttttatcatatattattatacaatgtatgttgtatacaattctagatgtgtgtgtgtgtgaatgtatttgggagagcctttaatctccaagtatgcatttgatc

SEQ ID NO: 163164 - DNA, 607 bp, Homo sapiens
tccctcctgccacagtccagggtaggagatacttctccgggctctcacttatgggggctttcctgctggctacatcactgaaatggaatctcctagtggcccttctccctctacagctctggtgttacactgaaaaactagaagtttcaaaacagacaagggaaaaagagaaacatcagaaagtctgattaaagtagaagcatcatatttctatcaacgtatccactgtgcttggacacaattgcaggcccttgacatcttttgcctggattattgcaacagcctccaaaaggactcgtctgtctccatgatacccctccatcctcctctgcatcatcaccaagggaatctttgtaaagcaaaggcatgatcatgcttatcacctggtggaaacccttcagagactctccactccccagagcaggcaccacatcgttagagtctacagaaggcaggaggaaacagaaatgagtgccgggtccataggtaggcaatggggagcagtggggattgcggtgaaatggagattggctgtctaaaggcatccaaactcagaattctgtaaaaccttctatgggccaaataaagtttgtcctgagattccatg

SEQ ID NO: 163165 - DNA, 414 bp, Homo sapiens
tccctcctgccacagtccagggtaggagatacttctccgggctctcacttatgggggctttcctgctggctacatcactgaaatggaatctcctagtggcccttctccctctacagctctggtgttacactgaaaaactagaagtttcaaaacagacaagggaaaaagagaaacatcagaaagtctgattaaagtagaagcatcatatttctatcaacgtatccactgtgcttggactctgtaatattcaccggcaggaaaacccaagggaatgactactatgacatctgatgagtctcacggtgttgcccaggctgaatacaatcgtgcaatcatgactctctgcagacttgacatcctgggctcatcaagcaatcctcctgcctcagcctcccgaatagctgagactacagg

SEQ ID NO: 163166 - DNA, 271 bp, Homo sapiens
tccctcctgccacagtccagggtaggagatacttctccgggctctcacttatgggggctttcctgctggctacatcactgaaatggaatctcctagtggcccttctccctctacagctctggtgttacactgaaaaactagaagtttcaaaacagacaagggaaaaagagaaacatcagaaagtctgattaaagtagaagcatcatatttctatcaacgtatccactgtgcttggcaggggatgggcccttctgctgcagcataagagggg

SEQ ID NO: 163167 - DNA, 578 bp, Homo sapiens
tgagtcaccaacatctcagggccctctccacaacacatgaagccagctctgcaaacccagagcagctctgcacacttcacacaacttggcaacacaagcactgggaacccaagagcagcctcaagggcaactgagccatcagaaacaaaatccagctctgaatggcactccggggccatgcaaatatttaacaggcacatctagagaattctcagtctcaattaggagaggaccaccacagtcagaatgaagggggctgcctaactgcctctcaagtctcgggcaatcctcactcagtaatattgcagaggactacagttttgtgtgtgtgtgtgttttttttcttattttagaaacacgatcttgctctgaaacccaggttggagttaaagtggcataatcacagctcatgcagcctcaaactcctggactcaagtaatccccccacttcagtctcccaagtagctagaacaacaggcacacaccaccacacccagccaatttttgtattttttgtagagactgggtctgcctacattgaccaggctggtctcgaactcttggcctcaaatgattct

SEQ ID NO: 163168 - DNA, 469 bp, Homo sapiens
taaggaagaattagaagaattacaaaaggagttactagaagatgatggaaaaaaccagcaaattataaagttgctgaagtgatccaaggagtcaaattcttggataattaaatttcttaacatggtccctttatggaattatgccctgactagtagaaatacatgtagaagttacttcctgcacaaaaccatgtataataaagatttgttctaaacatgatcatctttattattattgaaggagctttaggtttttttttttttttttttttttttttggagacggagttttgctcttgttgcccaagctggagtgcaatggcatgatctcggctcactgcaacctctgcctcccgggtaaaagccgattctcctgcctcagccttccaagtagctgggattacaggcatgcaccaccatacccggctaatttttttgtatttttagtggagacagggtttctccatgt

SEQ ID NO: 163169 - DNA, 452 bp, Homo sapiens
aaatatctcatgtaccccatgaatatatacacctagtatgtactcacaaaaattaaaatgaaaaaaggaaaacatagacaaattggacttcataaaaatttaaaacttgcacatcaatgagcactctcaacagagattagaaaaagtaaacacataggtggggtgcagtggctcatgtctgtaatcccagcactctgggaggctaagatgggagaactgcttgaggacaagagttcaagaccagcctgggcagcacaaagaggcgccattgctacagaaaaattaaaaattagccaggcatggtggcaggtgcctttagtcctaactactcaggaagctgaggcatgaggatgaggatcacttgaggctaagaggttgaggctgcaatgagccatgatcatgccagtgcactctagcctggtcaacagagtgagaccttatctccaaaaaaa

SEQ ID NO: 163170 - DNA, 427 bp, Homo sapiens
ctagtgccccacttcctactatatgaaacttaaaatctagtcatcactgggccccaaactaccttcttttcagaatctctctaatcctttcccttcatcaagtcccctacattattattattattattattattattattattattattattattatttgagacagagtctcaccctgtcacctgggctagagtgcaatggcatgatctcggctcactgcaacctccacctcccaagttcaagtgattctcctgtctcagcctcccaagttgctgggattataggcatccaccattacactcagctaatttttgtgtttttagtagagatggggtttcaccatgttggccaggctggtttctaactcctgacctcaggtgatctgcccgccttggccttccaaagcactaggattacaggtgtgagc

SEQ ID NO: 163171 - DNA, 326 bp, Homo sapiens
tatatgttggaggaggaggaatttgaaagcagcatcagtaggtggtttaccgatatagctgctcaccgtgagcattaaatactgggtggatgagtgttgcaaagcacagcctgccccaggttcctccatatgcttccttcctccctggctgctgacttccagccttattcatcctggccctcagtctttcagtcgacgtccatgtgggcttatagacatcagatgaattagacttgccccctgcctgaaagttcacattctattggacaagactgattaaaaaaatgacagattttaagttcgtggtaattgcaaactagatatgg

SEQ ID NO: 163172 - DNA, 294 bp, Homo sapiens
gtcaggccagggctgcttgagtccttgctctgctatttaaatctatcactcgttggtgacagctttctgcttaagcagtggcagcatgtatgctacaggtttcagctcattacctctgtagggctgttcctggactgctggctgggggaaaggccagccatacagactgaggcaccagccccaaactctgtattggatgttgctgagcctgggtggagagtggggccgtgctacctacagtgcctgctacctgtccttcagaggacctgtctgcagcagggccagagcctaagg

SEQ ID NO: 163173 - DNA, 259 bp, Homo sapiens
gagagcccaggcatctgggacagacctgcttgcggtgtgctctgggtgcttctcaaagccactccagccgcctctctccttattccccaggcttcaacggggccactctcacagcactcatcagattctgctctggattcgatttagctacctgcatatatgcctcatatcctggctacagtgttgttccttcagggtggagcctaccatgggatccctttcggaccccacgcagggcctaatacaatgctttggatat

SEQ ID NO: 163174 - DNA, 396 bp, Homo sapiens
acactttaagaacaaacatagaaaacattctgaagaggactgggccaatgaatagcctgtatcctacagcacagctgtaggaaatgaagacaaataatccagattgtgggcacagtgaatgctcaacgtttgctggatgaagtaatgaaagagaagaaaagggagggataggtgaagaagagatgggacgttacattttaaaatatttgtctggcaagggaaataggtattaccttagtcccagatggctttggggaacaatggatacatgttacagggagactattcagctcagtacactcaatacaaagagaaggtcaaagacccaaatgagttaccttggaaggtgacatgacagtttcagctttggtgagtcactcctttcagttcaagatg

SEQ ID NO: 163175 - DNA, 127 bp, Homo sapiens
ccagactaggttaagggcagtgtccagacatttattagcaccccttattaacatgggtgccatctccagcaccccttgcctctccttgcttctgtgtttctctgccttcccctcaagttttgtggtg

SEQ ID NO: 163176 - DNA, 533 bp, Homo sapiens
gttcaaggctgcagtgagctctgtctcatcactgtgcatgatagagagacctatctctaaacaaacaaaaacaaccaagtaatgtcaggtgtgaaaggattaaacaatcccatgaaatgggcagagattttcatactgaagggaaaaacagccttggcctataggctgtttacaggagacagactttggattcaaagatgcaaataggctgaaagtaaaaggatagatgaagatacaacatgcaaatagcaaccatagtaaagctatcgtgcctatactgatttcagacaaaatatactgaaacagtattgctggagatacatagggacattctataatgacagaagagttggtgcctcaggcatacaaatcataaacatatatgcacctactaagagagcagcaaaatgtatgaagcaactattgacagaattgaaggaagaaatgcacagttcagtaataattggagaattcaatacaacactgtcataatggatagaaaactgaggaaatcagtgatgagacgtagaagg

SEQ ID NO: 163177 - DNA, 454 bp, Homo sapiens
tatttgctgcccaacagatctgaaattatgaaagcaaaattcctctattcatccaaagaacatataaatgagaagtactcagcatagtggaaagggtgctctctttcagaagaccagagtgctaatgccattcaaccttggaatagctgtggaaccctggcaaatgcccttcctgggcttcacatgctcaataacaacgtttgggagtctcaatgtttaaaaccaacacatcatctacccctatatgatgcacatcttaataaggatagtattatatggaatatgatataaatcttacaaagttaaaaaaaatcttgatgtttaggttactaatttggcttcagaatttaatgaaaactatagcaataagcctgggcaacacagaccccctctctacaaaaatttttaaaaatagctgggtgtggccaggggcggtggctcacgcctgtaatcc

SEQ ID NO: 163178 - DNA, 338 bp, Homo sapiens
gggcatctattgctatataacaaatcactccaaaaatcaacagtttaaaacaactctcttactttgctcatgattttgtagttacaatcagatattggctggcctgtgatcatctgacctttcatctgggctggggagcccacaccagcacagctatggctgatgttggctgggggattagctggggctatatattggagcatgtatttgtggcctctgtagcatgacagctgagagggtcttcatctcagacttcttacatggtggctggcttcctccttaagggcatccttagaaaaccaggaagaactgagtggtcttttataatctagtgtcaa

SEQ ID NO: 163179 - DNA, 479 bp, Homo sapiens
ctcattgcatccattgggccctgtgctttcctccatttcctcaagtccttaccacattcctcaatttaaaatgggtgaagagctgcccaaggccccacagccgggaatgcccagggccaggttaaaaccaggtctgccctgatcttctcatgcaggagtgggtgtgaggcaggctcccacttggagggcacagtgggtggtatgagggctgagaactgccattgcaggccctggctaagtggcccccctcacccaggtgagaacctgctggcagcactctcaaggaggcatcccagacagaggggtctcacatccagagcccctccacctctagcccacctatggagcccagagaaattggcccagcaactccatttttagatgtaggaaaccactcgaggcacccatgcacaatcaggtggccaaacttgggggagggcaaagcattcaactggtaaagttcatccaagtggcgagta

SEQ ID NO: 163180 - DNA, 435 bp, Homo sapiens
ctgacagagcaggagcatcgccatcttggacaagcccctcattctaaagttcaccttaataaaaaaaaaactgcctaaatccaaagggcatcagtctaatgactaaggtcggcatgaccataaaccacaaataacatctctaaccagaaacattccaaactcctccccagccagagacaggctagccctaagataaaccccctccagctgggaagatgccagtctcgagatgacatccctctggccggaaagatgcctgccccaaggcaaactcccctccacccagagacattccaaccccaccataaaacttctccctcaaacagtaacattcgaagcttctgataagccccctcaccctaaaactaatacatactcttaatctgtaagagaaagcactcctgatagaaattggccaggagtgtctctcaggtt

SEQ ID NO: 163181 - DNA, 404 bp, Homo sapiens
atttgcctaccatactatgcagtgtccttcttacaaccacctaacctttctccctcccacaatccctgaacctgggtacaattgcatgtagataaagattgacagatggttagcacatatattgatctaggcagataatctcacagatgtgatatgcgggaaataataacatcaaacagctttggaaaagatgtgtaaacactgtgaattttttgcttctatcactttaagagttggactgatttgggaaggactcaaactcttcaagtctagagtcttcatagataaaatagggacattttcaacttcctcctagaatgatgctttcttgtggggactgaatgaatcaatacacatgaaagtgcctctctcccttgatatctacaaatacatgtgcacacaca

SEQ ID NO: 163182 - DNA, 339 bp, Homo sapiens
tctttgtattagttagaatttttttggtagcaaaagacaaaaaactcaaattgcttatacaagtaatgtaaactctttttggtcggttgtaaagtctctaaaagtaaggtggactttcaagtgtagtttagttaggactccagttctctttctctccaattgttctcaacttgtcttcttccttgtatcatgtcatcatggtttcacttagggtagcaaaatcatgtagcaatccccaattttatatctgcatcccacaaaacccagaaaagaaatattctctttgctacttactgaacaatagtgctaggcatctttctagaagcacttgggtgtcac

SEQ ID NO: 163183 - DNA, 265 bp, Homo sapiens
catgagaagaatcggagttgtatttcagaggtcagtgccatcatctattatctaaatctctcactttcagaagactagaaatcaaaaattgggctgtcaggagccaaggagaatgataactaccactggggcaggcaaaaagttagggttccgatccccaagcttcaggcttctctttcaaacaggaaaaaaaaaaaaagaaaagtccctgttgctgctatttttctcccttttcacataaatgcaaaggcagccacataggaga

SEQ ID NO: 163184 - DNA, 536 bp, Homo sapiens
ctaggagcattgtgtatgtgtgtgtgtccacatgtatacaactagttgctcacacagacgctacctgaacaatcacacaggcaagttgtagaaattgagcctggagagtgctaagagagtacctgagagggcactcacagaaggctatcaagggcaaatgaagtggccttgactttgtcagtaatttgtctcctctcaatatttaaaaatagatttgagtcaatatataacatcagaatgttcattaatcacctatctggatggttctggtcataacatgtatttatttcaaactcaagttgttaataagaagtactaaaacaaatgtagatgtggaatggttttcattattctagagtatggaatcttatgtataaatgtagtaccatgtaaattcacactccatttcacaagtcattgtccctcactatatgtaatagtgttttcctagtaatatatgtttaagttaaatagttttaaataatgtcatactttcattgctctaaaaaattaaataaagcttttaaacatgttta

SEQ ID NO: 163185 - DNA, 429 bp, Homo sapiens
atagttcaaaaggaaaacaaacaggtttctttcttggccaaatggcttattactctcaccctgggatctgatttcttactaagaaagttcagggcaccaaatccaaccagaaattcccaggacaccaatggctacttaactatgaggggatggatgctttaatctttctatgaggggagtcattctcctgggattattatgcccatcagtagtcccaggagaggtaggtgggaaggagggtgaatgcaaaagctaaagggtcagagaaaagaatgaggctttcatgaacaacccataacaaggcagaatggtcgttttacaaaccaaccactacaaactccaaacatgcacacccaaaactagaggggaaaataaagagctcctgggggatgagaggagacaaaacatggcacatagaacagcagactc

SEQ ID NO: 163186 - DNA, 511 bp, Homo sapiens
tagaggatctctcataggttcgcaggcgctggaacgtggggaaggggatagaggcggcactcggataaggagagtccagcttaggccaaaggctctggggccgcagttcagacctccctgccctgagcggtgggaggaaagctggtgtggctggacggctcctctgccactcaaggcacaagaaggagagggcgcgagggctgaccggacggggcgcctccagctctatgacacgctgtagctgttgtagtacatggccagatctcagttttggaaggaatgctttggcctttgagatgaaggtagaccagaagagagcaagatgaggaatcctggcagagagttcaaattctgggggttcagaggggagaacttaggggactgggttgtcagaacgctgggtttttcctcctgaagccatgtggagactcagatcttggagacctgggcccctaagcgacctgggtgatgtccaacatccttccccagttaccttaagacaggcacacag

SEQ ID NO: 163187 - DNA, 365 bp, Homo sapiens
ggccctggatgagattaacagtggaatcaacgggctctgagtacagcagatggccctccctaatgtgggtgggccccatccatgcagttgaaggcttgaatagaacaaaaaaacacagctttccctcaaggagtgggagaactcctcctgtctaactgccttccaactgggacatcagtttttttcctgccttgggactcaaactaacacatcggctctttgtgagtctgcagcttgtccgcatttaggctggaccttataccatcagccctcctgggtctccagcttacagatggcagatcttgggacctgtcagcctccataatcacatcagctgattccttacgataagcctctctctctct

SEQ ID NO: 163188 - DNA, 401 bp, Homo sapiens
ggagttcgaagctgcagtaagctatgactgtgcgactgcgctccagcctggacaataaagcaagacccagaaaaaaaaagaaaaaaaagaaagaaagaaaagagaacaaaagaaagaaagaaaaaggacacggaacgtgacacgcacggaaggcacggaaggacagaagacgacgagagagagaaagaaagaacagaacgaacgaccagaacgcaacgacacgaacgacgacccgaacgaaagacagaaggaacgacgcgacaggaagacacgaatgagaaaaacggaagaggcaggtcaaggaaggaaattgtgtattttatgttggttaaattgattactgtgaattctattggagtgatttctatcgttgcctgaatttgggctctgcttactttatg

SEQ ID NO: 163189 - DNA, 278 bp, Homo sapiens
ttgtttggtagtctcaccagcagccattgacattactgtggttaactacacacttagaaggttaagctggttccctaataactgcaagaaataaaacagcagtggcaataagaaatggtgaattaatgttctggaaaacataggtcttactaccccaaatgtcccaggataaagcttagcaaacataccttcttcatcacttgtgtgtgttggccttcaggatcacgacccgccattggtaagattctaattttctgtgtctttgaacttctattagc

SEQ ID NO: 163190 - DNA, 272 bp, Homo sapiens
gtattttttaattagggtatatacactgcttttttagacatgatgctattacatacttaatagactacatagagtataaatataactttaatgtgcattgggaaaccaaaaaatgtgtgtgcctcattttattgcaagattcattttattgcagtggtctggaaccagactcactatctctaagatatgcctgttatgtaagtcattgagaatactgaagaagatgttgatgttcaggtcatttctggatcagaagacatattccctttgtt

SEQ ID NO: 163191 - DNA, 699 bp, Homo sapiens
tcctccactcttatcagaccagccttcctgtggaaccccacacggttctcctgtcccatgcttttctctagacttcactgtctgccaaacaacctccttatattcctccttcctgctacctctcttcctcccatgaatgtaaacaaccctcccctccttagcatcccagttccagtcccctcctgagtggacccacatgttggcactgtctctgcctgagtcttcccaagcagcacgctttgccaacaatgacttgggttgaactaaagaaaatttcttagcatttatgctgactatttaaggagaatttgttgatgtattctttccaagataaacactcaagaatatggttgattagtagaatatgctcaaaattctactagtggtctgcattttaccttgcaacaagttctcaaagggggaaaaaattcttcatttaaagaactttagtacatttgagagcatggatagagtttccaaaaaatgagatcttcctgaatgaggtctccagttcaaacagccagcagcctttatctttgcctgctcatgacaggcttggtgtgcactgaattctagaataccaaggttggaaggaaccttcaatatcattttctccaggagctgacagattcacaaaaagttcttaggacacaaaccaagtgtttggaacattcttaaaatttattttgttggtctgta

SEQ ID NO: 163192 - DNA, 470 bp, Homo sapiens
actgtaggttctcacctacttcgactcctctccctgtcccagggaggggagaaaaggtctgggattcattgccaggaggggcttcccccaggatttcctacttctttctttactgctgtgcttgaagctcacaggagacccctcaagaggtggtcaccggcccacagcccaccccatcccccacccgccacccccaccgtaccaaatgctagctctgccctttcttctgtgtttttcccatcaagagagatggttgtggtcatgaagttcttccgatgggttagacgggcttggcaaaggattatttcctgggttttcttctggaggcaaaaaattaaaccaaccatctcaggacaccctgactccaagaaacactcattgaagaagatggagaagactctccaggtggttgagactttgaggttggtcgagctcccaaaagaggctaagcccaagttgggtgagtcccc

SEQ ID NO: 163193 - DNA, 354 bp, Homo sapiens
ctactactatcaccaccaccaccaccagcaccaccgtccctaataataataatggtaacaaacagctagcgtgggagcacttcccacatcttattcattgtgcacactctccaggatttgcaattgaagaatatgacattctggccccagacccctggtccctggccagctgagatgcccttgcattccagcatgggtggtttcccaagggcattttcaaggaccattttgcttttccaagtgagatttttttttttttttttaatttgagacagagtttggcttttgttgcccacgctggagtgcaaggggatgatctcgactcactgcaacctctgcctcccaggttcaagc

SEQ ID NO: 163194 - DNA, 826 bp, Homo sapiens
catgtgaacctaagtaaacacataccaaaaaaaatggcccaagaaaaatcatgccctgaggggaaggcactcagatgaaaaggaccttcttcccagtggtcccctgaggaggtgatttccaaggtctcagctaagggatgagcaggaatgtgtgggtgcagggggtaggggtgagagctctcggcatagagagagcagcacatttcaaaggccctggagtggggaaggaggtggcaggtgcagctgtgtggtggctacttccacttctggagtgcagtagcatgatctcgactcactgcaacctctgcctcccgggttcaagcaattctcctgccacagtttcccaagtagctgagattataggtgcaagccaccacgcctcgctgattattacatttttagtagagacggggttttaccatgttggccaggctggtctcgaactctgtctcctggaacctcttgatgagcccctgtgaggttccccagcccagggcatccccccaggtattcaggagagacccgtccccaagagactgcctgctacttcctcttcctatgaatgtcactgtgaggggaataaataaggatagaccagaaaagcaaattgtaagaaatttgaaaccagttgtcagttttcaggtgcccaggagcatgacaatatgcccgagggaccgtaacaggacttgacatggagctgggtctaaagcagatgacctggtggctgcagcgtgttccacacaggcgagcactgtgaggccaaaggactggtgttgagcagaatgaaaaagcacagtgttggttaatcctgaaaagtgaagcctgc

SEQ ID NO: 163195 - DNA, 599 bp, Homo sapiens
tctaaaagatatatttatgaaatattttggactttatttcttataatttatcaaaaattgtggacattctgcagttgtgttacactgtgtgttggctccacattccttttgtgaaaactgacttttaacgcaagcaaaaatatatcttctcttcaaacctactctacagtcggggcatttctggttacaaggtctactcaaactatgctattttagaagagtgtttattaaacaaacataggggaatcctaatgatgtggagaaactggaacccttatacacatattgctggtaagattataaatggtacagccacattgaaaaataatttggctaagttcctcaaaaggtaaacattgagttactatatgacacagcagttctactcctgggtggacacccaagacagctgaaaacatgttcacaaaaaaatcttatacacgaaatgttcataagcagcattatttccaatagccacaaaaatggaaaaccccaaatgtccagctaacaagtggataggcaaaatgtggtatatccatataatggaatatcagtcagctgttaagaggaatgaagtaccaatatatgctacaacatgg

SEQ ID NO: 163196 - DNA, 312 bp, Homo sapiens
ccttgtgtttgctcaaagtctggaatgaattacagcagccagggatcactcttattgccataggctgtgtctaagaaagcgaccaagtttcaccatgaaagcaaaccaaatagtcatggagggtatttctcaatctcagactgttagacaaagaatgtctgtgtatacgtcaatacattattttccacgaaaaaaacaacaggacaaaactggcttacaagactagttatctgagcctaaagcttcaacccccaggatgaagctccaccccaagccggaaggtgatgaggttccaaggctcatccccaaaag

SEQ ID NO: 163197 - DNA, 587 bp, Homo sapiens
tgcttcttgaataattgtatcaataatctctttgttccatagttccaattcatgtgcctaaagaaaagttcatttacttaagaatctcggccaggcgcggtggctcacgcctgcaatcccagcacttcgggaggccaaggctggcagatcacctgagtcccggagttcgagaccagcctgactgaccaccatggagaaacccggtctctactaaaaatacaaaattagctgagcgtggtggtgcatgcctgtaatcccagcttctcgggagactgaggcaggagaatcgcttgaacccgggaggcagaggttgcaatgagctgagattgtgccactgcactccagcctgggcaacaagagcaaaactgtctcagaaaaaaaaaattgcaatattaccagaattcctttgggactgtctcctgaaatttgaggtcagtcttaactttcctctagaactcagctcaagaaggctgggtgaggtggctcatgcctataatcccagcactttgggaggctgaggcaggaggactgcttgaagccaggagttcaagaccaacctgggcaacacaatgagaccccatctctac

SEQ ID NO: 163198 - DNA, 232 bp, Homo sapiens
agattacagcccttgcctctcaaggacttcgagattggttaggttgagagagtcatgaaaactacatgcaattaagatgcaaatgctacaatagataaattattctgttggtgcacaaaggagagagttgctttattctggttgagttgggattgggaaatgaggaaagcttcatgagaaagatgttacttatggttaagccctgagaaatgaatgcatgtgaacttacagg

SEQ ID NO: 163199 - DNA, 489 bp, Homo sapiens
aggatgagaggttggctatggagagacaaataaagatatctagcacaccccacaaaagcaacccacaagaaaaagggtcaactttgaatgtctaccaaaacaatgggggcaccaaaacagcaagatcatgacagtcccagccaagtaagctctttcctgcctctcccacttcctctatgctccagccaaccctacagtgttcagaaactgcagttagtaagtcagtagattgaggatggggtgaggaggtaccaagcaggatagtagagagctcattgtgcctccttttcccagtgcaggcttttagcctgacagaccacagctggagagcgtatcagttagagtgtgagaggctgcagtaacaaaaagtcccaaacatgcagtgactcaacacagtacaagtctgtttcttgctcatataacagtacaggaaagtgccaggttagggtagtagggaaagcagtgggctttgcttcatccacgcagtta

SEQ ID NO: 163200 - DNA, 608 bp, Homo sapiens
tgtcatggggtcctgctaacttatagctaacacaagtggagatgcccatcagggatttgagcagaaatctagaaatcggcagagaggtgggaccgagagctgtatctttgggaggtgttggcataaatggctgctggaggcctgggcagtagatgagattacccaaggggatcggtagaaaaagaaggcaaacaggctggagatggggcctcaaaacatttcagatgttttaaggtcaaccgtatatgccctgagaagtccctgtgtttaccactaggaaaacgtttgtaggaggcacagaaatagcacagcattaagccataagggagtgactaacctgaaaccatgatgctttggggtaggatggtcagagggggctcacagatccaaagtctgtaatcgcaggtgtctggactctcaggctacatatacaatttcctaaggaatgtcctgctttgtctgcgtcccgaatctgtgttgaaagatagtaaactggggtgatggagtacatcctggcagaggctatgtggggagagcagagatgactctagggaagaaaacgtcttttaaaaaacaaccctgtctgctcccaccaaaaggaagaaaga

SEQ ID NO: 163201 - DNA, 648 bp, Homo sapiens
ttcactctctgccctcctggcctgtacccgctggcacctgtcccctcactccctcaaggtttgcagcacagactgatgacatacatatgtgactctagccatgtctgggtcacttttggttaggtggtcaccattgtctgctggctgaccttgttactcatctttggaagactcctggctggtgtattccaaccatggactttccatgcacagactccttgcctccttaactcatttctggtttgttttttgggatttgtagccttttgcatgccatgctctctctcaaagcaagttaagttctctttttttctctctctctttgtttgagtcttgacttggttctttgttgagggcttctcatttgacctcagttgctggcttatatggacagcagcatgtatgtaggagatagttgaagagctcttgacttggataaaaccaccccatgtggtctaaccaatataaagcctgctaccaacctcaaaacctatttctttggagtggagcaaaatgccccaatttcctggtcctactgcttttccaggggataatttattatgtcattccaggcaggagcttctacagctctgatcaccacattattactttggaggtgatgttctttgactccccgacctccacaat

SEQ ID NO: 163202 - DNA, 895 bp, Homo sapiens
  misc_feature (773)..(773): n is a, c, g, or t
tgtgctttaaagtgtttctaaagcagttcctaacagtatttagagattccctgggatgtttgtggctcaacttattctggacaaagtgtgtgtgggggtggtcttactgagatttgcattcttaatgcaggacaggctctaaatttcatctgtactctaaatttgtgattgaatccaagaagataacagagacagtgctcctgttgtaatgtttctggcaagtgctccctaaaatgcacatcgaattctgttttctgggccttttctccaatggtgctaggagataccgttgatttctgcagctcttctcagtggtgggaagaagtctttgggattgttgagcaaggggcagctggaccatccactaaatttttttgttcaagacacattagagaccctcctgtatatctagtaagtcataataaaggtgcttgggaaagccttaaatttgaagacacatggaggcggtagaaaattaaacttgtaagaggagaaaaacatgccattaggtaacgcagagttgtaactactggctaagactcaatggaacttccacttgctctaaaaccagggaagggagtgggacgataagtcttttgaagacatcagctcactgtgctgagagagggaccaaactcaaggaaacctctgatctatacattcaactgctgcatttttttataaatacatgtaaatgtcctgttgtaatatttgatcttggaaataaaaacaaaaacttttcagtagaaaaaaaacaaaaaaaaaaaaatttngggggccggcgccaagaagtttcaaccacatgtgtggggccggcccaggtgaaggaaatggcaagtggccaagaaccggccagaaggggggtttcccaaaaaacgcgcgggcgcgcgtttga

SEQ ID NO: 163203 - DNA, 1106 bp, Homo sapiens
  misc_feature (984)..(984): n is a, c, g, or t
tgtgctttaaagtgtttctaaagcagttcctaacagtatttagagattccctgggatgtttgtggctcaacttattctggacaaagtgtgtgtgggggtggtcttactgagatttgcattcttaatgcaggacaggctctaaatttcatctgtactctaaatttgtgattgaatccaagaagataacagagacagtgctcctgttgtaatgtttctggcaagtgctccctaaaatgcacatcgaattctgttttctgggccttttctccaatggtgctaggagataccgttgatttctgcagctcttctcagtggtgggaagaagtctttgggattgttgagcaaggggcagctggaccatccactaaatttttttgttcaagacacattagagaccctcctgtatatctagtaagtcataataaaggtgcttgggaaagccttaaatttgaagacacatggaggcggtagaaaattaaacttgtaagaggagaaaaacatgccattaggtaacgcagagttgtaactactggctaagactcaatggaacttccacttgctctaaaaccagggaaatcttagataactgggtgtgatctacctatagatctacctagtctataggtaataatttccagaaggaggatcttgctgtcagttggggatcctctggtttggtctgtaccaaattgtgaatactcttgctgtgttgtacccagttgctttatattaatactgcaacttgaaacgggggagggtggggggacaatggggtgggggagggaagggagtgggacgataagtcttttgaagacatcagctcactgtgctgagagagggaccaaactcaaggaaacctctgatctatacattcaactgctgcatttttttataaatacatgtaaatgtcctgttgtaatatttgatcttggaaataaaaacaaaaacttttcagtagaaaaaaaacaaaaaaaaaaaaatttngggggccggcgccaagaagtttcaaccacatgtgtggggccggcccaggtgaaggaaatggcaagtggccaagaaccggccagaaggggggtttcccaaaaaacgcgcgggcgcgcgtttga

SEQ ID NO: 163204 - DNA, 354 bp, Homo sapiens
cgtaatgttgcaaactgtcacaggcaagggttattagaccaatgggaattggctagattaacgtaatcagtagagtggccctcagtacttaggaaaagaacagcctgtgtttgcttgccaaagccttacatatcatgataagcatagaaccagccagttacaaattctggagatggcttattttaaatgttgttctcttccaccatctctatcataccagcactatcatcaagcacaaaaacttttcagctgcacaatttactatgctgaaaattcccagacccagaaatcctatcagacatactggcaccccgataaggacagacactaagctaattacattatcttctagtt

SEQ ID NO: 163205 - DNA, 311 bp, Homo sapiens
tccttccggcgggagaaccagcacgaaggttactccaagtccccgacccctgtccctctcaaactgggctcaaggtcaacctggccgtctctatatgctctggaggtcccgtcagagggtttttgaggaagaaaccccgccggaaagcccgccggaaagaaggcctgaactaacaactgaggcgggagaaccagcacgaaggttactccaagtccccgacccctgtccctctcaaactgggctcaaggtcaacctggcctctctatatgctctggaggtcccgtcagagggtttttgaggaagaaaccccg

SEQ ID NO: 163206 - DNA, 542 bp, Homo sapiens
tcaatcatagggaagtatttcaatgatcttaagtgtttcaatgatcttgtaagtgaaaacagccaataccaattaagttttccccattacccttcacaaaaaaatgcttccaaaagttccaaatcaccctacacagccacccagtgtactcctgctccgtcaccaatccgctgactttttcccccacactgggaccgtgctgctcgtcgtcttctaccatgagattggtgagtagctctaacaccaacttcctttctgagctctctgtgagaactcactctcctaactctcctgcatgttaccaagccagtctctgtctcttccttctgtaccctaattgtgcagtctccaagttgtccttgccctggtaagtactgctctctacaccaaacagatcttcatctctactctggagacttgcaatgtcaccagcagccctacttctaacctctatcctaaccacctcaaattgagtcatggtctgcttctactcccactgaagcccccccgcccttttttttggagacagagttaccctctgt

SEQ ID NO: 163207 - DNA, 474 bp, Homo sapiens
atttgtctctggtgtgctccacaacttaaaattttcaaataagctgccaaaagagagagggttttttggtttcactggttcatactagatatggggccaattgtggaagatgaaaggtgacaccatttccctgtgactcagaggtgaaaacagaagaatgatttaacttgcatatagatgactccctttgggaatatgaaggacagttaatgtttaagacaattatttaaattgtctgaatttgataatctttgtttttgttttttttaaagcattagttgtaaacaaggaaactgttgatgtgccacaccatatttattgcaataaggagatgtgaaataatgagaagtgtatctgtgccctgatatggttaggttttgtgtccccacccaaatctcatcttgaattgtaatccctataatccctacgtttggagggagagaccaggtgaaggtaattgaatcatgagagcag

SEQ ID NO: 163208 - DNA, 401 bp, Homo sapiens
tctaagcctcggaaatcaggaggtcactgagaagctgatgaactggagcctatctctagccttttcccctttaggtgctgaggcgtaggtggcatgttgacagatgtggtgaaagaatctgagtgcccagacatgtgtcaggggagcgtggctactgtgctgagtaaattatgtggcagtgcagactagaagttgagactagacagatcagcaccgggacaactggaagttccttcttttcacaatggtatgcacacactgctgccttagcagttctaagagacacgcacaaagatgtcaagacctgctcataatactgactttttttttcaatttgagagcgcatactgtttattaactgactagattagaaaaataatcatgatagacgccttagttca

SEQ ID NO: 163209 - DNA, 463 bp, Homo sapiens
  misc_feature (154)..(154): n is a, c, g, or t
atgctgaggtgatctcagaggatttcagtgctacctccacaaacaggtggacagggagcttgaggagaagggctcagagaagggctatggtgagaatcttggagaaagaacatttgggctaagacttgaaagatgagaaggagtttatcagggngaagaatattcaaggagagggaatagaatatgcaaagaccctgaagggagagaggcaggacccccttccaggttgtgaggaccctttcaggcccaagggtctcattagtcactggggttggcttttgagagcagagggaaccctctaaggcttgccttgccttcgactggatgcaggagagggagaggcaagagagtagagtggctgggtgatgcccaggtttctggccgggcttgggggtggtgcctcacccccgtgttgggagtgagagggggacaaagttcaggactgttgaatatgaggtgtcca

SEQ ID NO: 163210 - DNA, 255 bp, Homo sapiens
caatattaagtttcacagacagcatctctttcagtaaagagatacgctgaagataaaggctaaacacaagtgaaatttcatgaatgatgccattgaaaagttatgaaaaataatagaaaaagaagctaaaagcataatcaacacaaaaggatacaggaaacacaataaacattaagactccaacaaaaaaggaccacaaacatgtcagaataactggaagaaaaatatggaagcagaatgttttaaaagtctaaa

SEQ ID NO: 163211 - DNA, 518 bp, Homo sapiens
ttatgaaacagcttctataaacatcagtgtacaggttgtgtgaacatatgctttcatttatcttgggtaaaatacttagaagtgagactgctaggtcatacagtaactacacacttaactttaaaagaaactgccaaactgtgaaactattctccaaagtgcctttcaccagccctcagtggggaccaggcaccagcgtgccaaagaagtcttccaggcaaggacagggttcaagagaaaggcaggggaggtgcaaacacttgagtactgcagacctgaggcctcggtgggtgccagggatgggaaggccagggcaagggcacgtgcctgaaaagaactgccacacaagagtcagtatgtgtgtgtgtgcgcgcgcatgcgcacgtgcatgcctgtgtgcatgctgtgtgctagtagggagctggagggagggtggaaatccctcttgcttccccatgaggaaaagcatgcactgaaaataccaaaagagactcccctagctagactcagatgagaac

SEQ ID NO: 163212 - DNA, 163 bp, Homo sapiens
tcaagggattccgatacacatagtcctttgataatatacttaaaaaacatggatctagaagaatgaattcaccatgacagcattttcagctcagagaagtggctagcctgaaaggaaatttctggtcctgagaaatgtttcagcatcaactctccaattgcag

SEQ ID NO: 163213 - DNA, 291 bp, Homo sapiens
ggatgtggctgaaaaaccttttctgaagagattaggtatgtgactaatgggtccaaatcaaccttttcagcagaagctagaaacagagatgagattatccaggaaagatctttgaagaattctcttatgatggcagagatcctctagacatacatgggagacccacacattttaaaatattcagtaaaccatgctataaacacatgtgctgtcacccaggctttgttgttctgtctataaagaacaggcagagtagctttagtataattcctaagggccttgggattttca

SEQ ID NO: 163214 - DNA, 421 bp, Homo sapiens
acttgtcatacttccaggactgtcactgtgtatactataaaataacctcttatgaaaaccatgctaaggaaaagataatctcctcttttggaatactgcaatagcctcctaactggtcactccacttccactttacccatcactcccatccattcttctctttgctgacaaagaaatgtctctaaaatatttgtctggctatcctatttctcagctcaaattctaatagtctcaaactccactgccattgctatcaccttagttctgcctttatgggctctaacttggacttctacaactatctatctaatggtcacctgcctctagctttgaactgcccaatctattctctttacagctaccaaatatatctgtttagaactcaaatcttaaaatatttttgctacacttttacttaaaa

SEQ ID NO: 163215 - DNA, 461 bp, Homo sapiens
aacacatttgtgtggtctagactagacaacctggggtggggaagaatacaaaagcaacagtcctcagttcctcaggcccttcactgttgactttgaagtgcagactaatcaatcattgcatgtttatttagttcctgtttcatggtgatgtgccttgatagataaggctgaaaattcagagaactgttagacctggttcctgccctcaagacatttagtctagttgggaggaaagataaaaacataatgtatggtatgtagtgtttcaatagcgtgcacagtagtttcacatatagtatctgttttaatccttgaaacaactgtaatctatcacattattgcagctgacatattattaatgagagactgtagcttagatgaagtcatgtcctgtagccctctttataagtaatgaagataacgactgcaaacaaggtctttggactccttggcaagatgcc

SEQ ID NO: 163216 - DNA, 101 bp, Homo sapiens
atcaaacagccatgtagtctgacgccaataaaaattcagggtcttcctctctcacagccaactttctgccttgtgcttgtctttggtcacatccccctcaa

SEQ ID NO: 163217 - DNA, 220 bp, Homo sapiens
caggaaacattgtaactgatagcacagaaatacaaaaaaccagaagagaccgctatgaacagttatatgccaacatataactgttggataacctaatggaaacaaatatattcatagacatctacaacctaccacgattactgaaacataatgaaatacaaaattaatacagaacagtaatgagtaagaaaaatgaacaagtaataaaaagtctctcatc

SEQ ID NO: 163218 - DNA, 321 bp, Homo sapiens
gcagttggttgaacagtgaatgaaatatatcacataacaacctcatacttagatattactaattgtaattcaatataattaacactttacaaattatccattattatttatttggaccgaaaaaaagcatgctctgaggctctttgctgtctgcctaggcatttttgtgtggatgataaaacgatgccacattctatagtaataaatatatatgtatgtatatatgtatacacacacacacatttaatttcctttgacagattttctccctgtatgaggcaaatgttccaacttatagattaaaacctgttagtgaaactg

SEQ ID NO: 163219 - DNA, 419 bp, Homo sapiens
ccttgttttcctaatataacttaagcttagtgaaagcaaaaaactacagagtattactctgtctttcatggtatatagtatgatgctggccatacaaaaaaaacactccactttccaactgtatacccttttgttttgttttgttttttttgagacagaatctcgctctgttgaccaggctggagtgcagtggtgtgatcttggcacgttgcagtctctgcctcctgggttcaagtgattctcgtgcttcagcctccggagtagctgggactacaatcacgtgccaccaagctcagctaatttttatattttcagtagctacggggttttgccaggatggccaggcgggtctcaaactcctggcctcaagggatccgcccactttggcctcccaaagtgctaggattacagacgtgagc

SEQ ID NO: 163220 - DNA, 249 bp, Homo sapiens
ataaattagtatataattaaatgatgcaaaaattattgtcacttagaaaaattgatcttacagtccaggcatggtgactcatgcctgtaatcccagcactttgggaggcggaagtgggtggatcacttgaggccaggagttcgagaccagcctggacaacatggtgaaaccccatctctactaaaaacacaaaaattaggtgggtatggtggctcatgcttgtaatcctagctacttgggaggctgagg

SEQ ID NO: 163221 - DNA, 181 bp, Homo sapiens
atcttggagtgggaggagcaggatggagtattttggcttgttaaagtctaacttttaaaggttaggaaaccagggcatctcctggaggggctctgctggcagggcccaaaagacagtgcctttgaaggaagctgtgtgttagaaaaacagtctctaaattcccactttcccctggctgaaa

SEQ ID NO: 163222 - DNA, 405 bp, Homo sapiens
ggtgacctagaggatcccgacggcttcaacggaactctgcatagatcagagcagtatcagtgcacctgggagacaaggacactttctagagttgatgggtgccctaggtggtatgatcacaaagggcagaacatgaccagggcacaggggcttaggcccatgttgttttgtttggttttgagtcagtctcactctgtcacccaggctggagtggagtggcgcaatctcagctcactgcaactgcacctcccgagttcaagcaatcctcgagccccaccctcctgagtagctgggattacaggcacgcaccaccatgcccagctaattttttatttttagtagagaaggagtttcaccacgttgcccaggctggtctcaaactcctgacctcaagtgatccatcca

SEQ ID NO: 163223 - DNA, 351 bp, Homo sapiens
  misc_feature (30)..(30): n is a, c, g, or t
  misc_feature (34)..(34): n is a, c, g, or t
cgtgttgtgggtgggaatggaggtgttttntccngccgaattcggcacgaaaaaaaacccaggtaaatttaatgtatactatttaagttccacgagagcagggcctatgtctgttttgttcgttgttgtactcccagggcttagtatagtgcatgccacattaaaaaacaaaacaagacagaacaaaatcttccttaacaccaccatcacaaacccccccattaataattaattgacattaatctgaaattaattattcattgtaccggttcagtagcagactatacacagcagaaggcaagactagagagcttgtggacagatcaatagaaaatatctagataaaagcac

SEQ ID NO: 163224 - DNA, 410 bp, Homo sapiens
cttcttccatgtgaaaaccaatgtgttccttcaaaaagtaatcaacaattcattttcacaaccactaagaaattatcatgtaaataattcctgcatcagctatgcatattacctggcttcagtcttccacagagctttgcctaactagatctgcctctgtggaggtataaatattctctcagtccttaacataaacgaagtcaggatagtaaactggtaaggtcccctccaactgtcctctcactcaactgtaagcaacatccccaattctccttcatggaatagaacagcacacaaattcaatctagactctggcatcaatttaaaaaggtatagcattaagaaccatctgccaaaaattactgatcctcgcatgatgggcagccatagtgcatagctcctaaaatcag

SEQ ID NO: 163225 - DNA, 345 bp, Homo sapiens
gttggtcacgggacacccacagactaatcaacagtggccagatgggaggaatcacctgggaacatggctgcctctggaaaccacataatgggaagatgggaacattctagaagcagataggcgctgcaccaagaaattgtgtgggcagggatctggcacataaaactgaaggtggtcaccatgggtgtacatctactatgtatcttaaaaattaatctaaagcccagtgtggtggctcacacctgtaatcccatcactttggaaggcccagctggacaaactgcttgaccccaggagtttgagaccagcctgggcaacaagacaaaaccctctctctactttaaa

SEQ ID NO: 163226 - DNA, 161 bp, Homo sapiens
caaagtgctgggattacaggcgtgagccaccgtgccctgcccagattgatctttcatggtatttctcaggtcagttctgtcctgagcccccaccccgacactgctttacatgacaggcagtgttcacgtacacttagtctggactctgccttctgagacag

SEQ ID NO: 163227 - DNA, 367 bp, Homo sapiens
aaccccagttaagattcctcacttaggcagtagagcaggcagcaggcagcaagagcacaagcagaaacaggagcaggggactcaccggcctggcgccccccatggcatggaagcacggagacactggatgggggaacgtcattatttttttcaaaatacaagttcacagaagagacacaccatacctgctcatccgtgcaagtaaacatgtactccaaatgcaaatcaaaggagctggcattgcttgcgtgtgtgtctctccctcacattaggtataggaagcgggagcttccagcacaacggatgagctgcagccactcaatgggtgaccgtggatatttctggctgtgtggcctgatctctccca

SEQ ID NO: 163228 - DNA, 456 bp, Homo sapiens
ttatatagttcttttaagtcctgcctgagagaatttttggagaagagcaaattaaataaagaggagaaagaagtacacagttctcattccttgaaggcccctaaagcaaactccttgcataaccaaaagagagagactcaggctttccaacttaaatgtttataaatcatacacagaatgattcaggagaaaattttataagggattaattcaatttacacagtctaatcaaagagcaaaaatgatctttgacaaagaattcaaaggcaaaactgttgaaactcacgactaccaaaatattgtttaaggttaaaaaaacggatctgaaacgtgcctaatctgctctgacactgccaccactgcttgtcacaaatgaagtttccacctgaggcaccactgaaagccaaacttcagttgctatatttgtgagtcggtgggggaaaaaaggaaaataaa

SEQ ID NO: 163229 - DNA, 152 bp, Homo sapiens
tacatcgagctcggccgcatttggctcacacctgtaatcccagcactttgtagggatcggtgagggaataaagtggcccaaggacaaaccacccaggacacactccagagtttacaggcttctcttctgcaaacactctgtaaaagtttctg

SEQ ID NO: 163230 - DNA, 386 bp, Homo sapiens
ttgatatattctccagcaaacattcattaagttttcttgatgcgctgtgctatatgctaggtgcctgggatatgaagattaataagaaatgggacttgctgccaaccaaattactatttagtggtaatacacagggaagatgtgcacaggggtctcagtggccacctgaatatgtatactcagatgcttacactcttaggtaacgctcctcaaactttcccagcttctactctatctttttttggggggagatgatgatgattataggttagttaattatctataaaggaaattgaatattatgtaataattataataacatatctcagggtgtgcttattgggacgggatatgtattactctgattgcagagactagggagaaat

SEQ ID NO: 163231 - DNA, 835 bp, Homo sapiens
gtaagcccacgggtagatttcagaccctgagagccccagggaagtcctgagcagaattctttaggagactcagcattccctgggtcgaatggcttaggagaaccagagctgacccaaggattgaactctagaattctgcacatccaccttctcttttcgtgttctctgcaaccaacagcaggtttcttttgaaataataaaacgttctgtagctcttttcccctcagttcaattgatttcactttttaatcctgcattccctgagcactcttatcagaggcagaacatcttctgaatttggttcaaagtgtttttattactgtgagcaggctttttcctggccacccacatccctgattgattgctgtttctgagcacccatctctactaaaaatacaaaaattagctgggcatggtggcatgcgcctgtaatcccagctattagggaggctgaggcagcagaatcgcttgaacccaggaggcggaggttgcagtgagctgagatggcagcattgcactccagccttggtgacatagcgagactccatctcagcaacaacaaacgattactctaccagaccaggtagtatggtttggctgtgaccccactcaaatctcatcttgaattgtagctcccataattaccatgtattgtgggagggacccagtgggagataattgaatcaagggggcggtttttccccatacactgtcttcgtggcagtgaataagttttacgagatctgatggttttataaggggaaatccctttcactggctttcatttctctcttcccttccccatgtaagacatgcctttcaccttccaccatga

SEQ ID NO: 163232 - DNA, 329 bp, Homo sapiens
tttttgagacggagtctcgctctgtcgaccaggctggagtgcaatggcgcaatctcagctcaccgcaacgtccacctcccgggttcaaacaattctcctgtgtcagcctcccaagtcgctgggactacaggcatgcaccaccatacccagttgatttttgtatttttagtagacatggggtttcaccatgttagccaggatggtctcgatcttttgacctcctgatccacccaccttggcctcccaaagtgctgggattataggtgtgagccaccagcccagccaaggccctcttgatgatacttctgagacaggtgaggcctatactg

SEQ ID NO: 163233 - DNA, 441 bp, Homo sapiens
tctttcctctactccagtgtttctgaaacttgtttcataagaattgcagacagcttgttaaaaatagatattcccgggatccttcctggaggtcaggaaatcatacttttaaaatgtgcctcttcctcaaggaattttcattatcagacaactttagaaaacaactgccacccataaaaggacaaatgttaggatagtgatttctatagtggaatcacatcccagaaaaattcaagatgacccactagaatatgaaagaaaatactgttctatgtatatttaaatctcaggtctcaaaaatattcctgttttaggagtgtattttataatgtacacattaaatcagtgcaatagtgcatgtaaatcattcctccctccctctgtaggatgtgtgaccataaaaaaagtagagaccactgctttaaggctcctgatttatta

SEQ ID NO: 163234 - DNA, 560 bp, Homo sapiens
attcatctcatgtttttagcctggattttagctccaggaggaccaagtgctgttcgtcttgtgaattgctatatccaagtactagcacataataattgctcaactaacatgatagagaggacatggtatatttcctcaattatggtggtcaactgaagacacctatgtttcataacttcagaagtcaaagtcatcttttccatactcataggccagatctctaagccccagagttgtcaatcatttgagcaaatctaaagccctttgttgaggaaaatatcaaccctgcttgtaagtacttcttcactaccttcacattgaggcaaggtcacctgccattaggactagaattcaagtaaagcactttaatttaacaaaatgtcatttcaacaactttgcctaaggtacctacagcctaaggaactcttcacagttgacacaaaattctaaaatgaacaataccttggcaaagcccagtggagctccttgatataagacagtgactaagagacgatttctctagcttttggagcactacctccagacagattacctggagt

SEQ ID NO: 163235 - DNA, 312 bp, Homo sapiens
  misc_feature (105)..(105): n is a, c, g, or t
caaaatggcaaacgtaggccagacatttgctcacacctgtaatcccaacactttgggaggccaaggtggaaggattgcttggggctaggagtttgagaccatccntgcatgacatggcaaggccccatctctataaaaaaaaaattttttttaaataaataaggcaaatgtattcatggtgggtggtagtcaaaaaagtttgagatgttgacccagggaacaagatctaataatctgcccaaacccaactcctacctcctctccacgctctattccatccccgttctggactcacctctgctctgtcctttg

SEQ ID NO: 163236 - DNA, 1641 bp, Homo sapiens
  misc_feature (1499)..(1499): n is a, c, g, or t
tccctctctcctcgcccgctgggtgctgaagttgggcggatggcagcaaaccggctccgctagaggaccgagccgcccagccccgctcccccggacccatcggcgcgctgcccacacctccaggcgaccggccaactgggtcctgaagtagctgaaatgcgaaaaaggcagcagtcccaaaatgaaggaacacctgccgtgtctcaagcgcctggaaaccagaggcccaacaacacctgttgcttttgttggtgctgttgttgcagctgctcctgcctcactgtgaggaatgaagaaagaggggaaaatgcgggaagacccacacacactacaaaaatggagagtatccaggtcctagaggaatgccaaaaccccactgcagaggaagtcttgtcctggtctcaaaattttgacaagatgatgaaggccccagcaggaagaaaccttttcagagagttcctccgaacagaatacagtgaagagaacctacttttctggcttgcttgtgaagacttaaagaaggagcagaacaaaaaagtaattgaagaaaaggctaggatgatatatgaagattacatttctatactatcaccaaaagaggtcagtcttgattctcgagttagagaggtgatcaatagaaatctgttggatcccaatcctcacatgtatgaagatgcccaacttcagatatatactttaatgcacagagattcttttccaaggtttttgaactctcaaatttataagtcatttgttgaaagtactgctggctcttcttctgaatcttaatgttcatttaaaaacaatcattttggagggctgagatgggaaataaaagtagttaaataacatcagaaactgagttcctggagaactacagtttagcattcctcaggctactgtgaaaacacaaccgttatggtctttgtctccatttttatcaaggttttccatggttaagtttggagaaaataccacacaaaacaatgaattgccaaattgtttgttttattcaagactcattctacttgcaagcaaagtgtatttgtagtcctatgaacagtctcctcgtgtatctccagagactgcatgtgcaaagtaaaatgcttcatttgccacatagttgttgtaatatttaatccagtagcataacttatatctgtatttaaggacttttgtgcaatatggtcttaagaaataattgccaaaaaaatcggccatggtttgcattttttaacataatctaagacagaaaaaaagcaatttttactatgtaacaatggtattcaacattctatatactgtgtttagtacactaattttgaagccaatatttctgtacatgaaaaagagctatttatctctgtttgttggaaaatcctaatggggattcctctggttgttcactgccaaaactgtggcattttcattacaggagagtttactatgctaaaagcaaaaaacaaaaaaaaaaaaaaagggaagaaggaaaaaagcanaaaacaatttgaagatatcctatctcaatgacaaatcaaaagagtgatattgcttttaactgtaatagaagaaaatgaatttatgtatatatcagatgtccaatactgtaattaatttattaaagactggctctccagtttt

SEQ ID NO: 163237 - DNA, 438 bp, Homo sapiens
tccctctctcctcgcccgctgggtgctgaagttgggcggatggcagcaaaccggctccgctagaggaccgagccgcccagccccgctcccccggacccatcggcgcgctgcccacacctccaggcgaccggccaactgggtcctgaagtagctgaaatgcgaaaaaggcagcagtcccaaaatgaaggaacacctgccgtgtctcaagcgcctggaaaccagaggcccaacaacacctgttgcttttgttggtgctgttgttgcagctgctcctgcctcactgtgaggaatgaagaaagaggggaaaatgcgggaagacccacacacactacaaaaatggagagtatccaggtcctagaggaatgaggacaggatctttgttatgtttttcccagggttgaccttcaaacttctggggcttcaagggattccttccca

SEQ ID NO: 163238 - DNA, 656 bp, Homo sapiens
tccctctctcctcgcccgctgggtgctgaagttgggcggatggcagcaaaccggctccgctagaggaccgagccgcccagccccgctcccccggacccatcggcgcgctgcccacacctccaggcgaccggccaactgggtcctgaagtagctgaaatgcgaaaaaggcagcagtcccaaaatgaaggaacacctgccgtgtctcaagcgcctggaaaccagaggcccaacaacacctgttgcttttgttggtgctgttgttgcagctgctcctggtatgtcatgttacctgtaggatgccacacccaggcttggcaggcactagtgtgaacatgcatgccaaatctcagaactgtagaaactgctcaacatgtctttttttgttctttctttgcaagtaggacttattgaagactatcattggtttaatgcaaatactttcacaaacaaaatatataatatttccccaaaatctacatttaaattgataataaggtaaaaaaaatgaagaggtgttttatatcatgtttttctccatccatgcttcttaaagatatgggtaaaaataagattttagttacatttgtatttatcaataagcaatattctccaatgttacaggcaagaacattaaaataacatctagtaatattgca

SEQ ID NO: 163239 - DNA, 1368 bp, Homo sapiens
taaagcattattcatactaatatcagtattttcaagtcaacactcccatcaactctgaatctctctctcatatgaatcttttttcaattagagtcacaatgaatttacagattgagtcttcctattcaaaagcatgaaatcttgtgtttaagtctaattttatgtaacttagtagtgttttatgattttgttcactaaggtgctttgaatttatagtttatttctagatgttttatcatttggctatcattttcaatggaatgatttattccactttattttctattttatcccattgtataagaaagtagttggtttttatgtatgaatgttataatcaaccacaaattgtgattcctacttgtttctaaggtatacttttgacttctcctttccaatgtgtctcttatttctttcttgtatctagttgatttgagatcagtgttgagtcacagtgactcaggtggcatgcttatcttgttcgtgacatcagtgggacgttttaatgtctcagcgtttaacttgtatgaagacatgtattttccttgccataataaaaaagtatctgtgtgttctcaaactattaagactctctggggaaaatgtagatgttagatttttgtcaaagccttctcagtgtccagagggattatcagaaggtcttttcctttgctctagtagtatgtttaattatattaatagaatacttaagaccaaatcattagtgtattcctgagatgttctttacttattagtatcatgactttggttatcaatatttataattaagattcatcattctacatcttgcttttatgtgttttttgtccagatttaactttatgctgacttaaaggaagaaatattataaaacaaaaacctctatattctacaatcatctattggttttggattattttctgcttaagtgtagaagaactagctggggctgtctgggcctgccgtggtatatttctggattttgctcatcaggcaagttaggtcctcgagcccttctagagtccattttaatgacatttttaaaaataaaattaattccatccacttttcaacatagttgcgtagttttgtaatatatgcacttcaggtgttttctttcctctgtatttgtggctttttctcctttttccgtttgtaattgtgtgcatttctcctttctcccgtgcctattgatttagcttgccatgagttttaccggtttatatttttaagacatcggacccttagactttgcagtccgaggacctgtctgcagggtcttgggggtccctgcgttgacccagccctcccaggtgacagcagtgggccagcacagcagaagccacagttgttgcaggtgcttctcca

SEQ ID NO: 163240 - DNA, 600 bp, Homo sapiens
tgtttgtcttattgcaaatataggctataatgagttaagtgaacttttatggggtagtcttctgagtagagcatctggccaaaatacctcatacccaccaaaaacaaaaacacaaaatatttggagagcacagtttatctttttatttggaacttctttgctattacctgaatttctagttaacctatattcgtattttgggtcaggtatcttaggagatctcagctcttgtctattaggattacttagcaaattatcttagtgaactttctgtacaggagataaagcataacctttaaatgcattattttatagatttttctccctttaatatttaatcatttgaaagtctctcttctacaagttgtttagtttcaagctgttcaggtatatggaaatataacctttctgtatagatgtgggacagtttacaaatgaatcagcccatactttcatagtttagttcaaatgtgacaaaattatatttggaagacttaggtgtagaatctctttttattgactgaaggcaaaacaattttaacttaagtgaatgaagtaactttgttatttttaaacatttttttgaggcggagtctcgct

SEQ ID NO: 163241 - DNA, 454 bp, Homo sapiens
acaaccccctcctagcctctatcacctgctccatcctgagtcacccccagtcacctgctctaatctgagtcatcctgagtcaacagggtttcaccatgttggccaagttggtctcgaactcctgacctcatgtgatccgcccacctcagcttcccaaagtgctgggattacaggcgtaagccatcgtgcctggccagttttcactttaaaatgatctctaataccaactcttggggtccaaatgggtccccactggtttcaaatgttgagcatgcacagattatgtggatgagaacttgccaggtgggcttaccgaaggagacgtggtaagaatcgcctacatttgccaggccctgaggacaggccctctccacaccgaggcttatttccttgggttgcagaagaggaaacgccagggagcccagtattctttggttcattcacttctttttta

SEQ ID NO: 163242 - DNA, 320 bp, Homo sapiens
tgcttcaactcaagatcaagtgctgggatagtgagtggctcttagtggagagggatgtgctctggaatattaagccacctctgagcatgtgtcctggtgctctggtcaagatgcctgttgtgtatgtggaggtattttgtggcttttcttgttctctctttttaaatttatttcaaggcacaagccctttgtgatggaggatgtctagcttgaacatgctggtaatgtgacactatcctcagctccccttggccctgggttcataggaggcaagtgtttctaaatttctcgcccagtgagttgttgcatgttatttttaa

SEQ ID NO: 163243 - DNA, 673 bp, Homo sapiens
catggttcacatggactgaaagtgaaaaagaaatacagtggccttgatagctaatctttgtctttggatctgtcaccatattattccaacctatagtatcctttctacttacttcttcccctctgttactattatccccatacgctaatttaaatgcactcatcaaaaaatatatacatttatatgtatctcaccaagaacatagatacactttattcatctaaaatcctatgtagggattattcccgctggtaaaaggcaagtctttgtagcttctctaataaaactagagaaaacgatgtaaaaatcaatagagcttgctgaaatatcaccactaactaacccaattttcttctgtcagaataacatgaggtttaatagatccagagagtaaacaatgtaatatatctacaatttaataggacttttacttttgccccatataatacacctatattaaaatgtgattcaggtttattgtgatgaggcacacagtctacagaggattgaagtgttgataaatggttgtttcagtcttgacgagtaaaatattccttataggttagactttgacctcatgtattagaaattatttgtatcttgaataatttgttttgtctgtaataatcacacgtttggaactcttcaaaatgtatgaaggactctatctctt

SEQ ID NO: 163244 - DNA, 381 bp, Homo sapiens
gcctcttggcggattctagaggaaccccccccttcccggggtattgaacaactaatgaaaatacaatacttttgattcatttaagctctctcaaatcacgcctaggctttttaagaaaactaatttttgaatggaagattcaggcttgtgggaagagccaagaagttggcacgatctaatcaggtcagttcttttttgatcaaggacataattttttaaacaatactcaacctaagggtcaagttacaatttttgctttcggagagtttcagtacaactggccaaaatttggctaagaacattttttcttttattacgatcttagaagatctaacacattcactagtatgcccaaaaagtaaaaacatgcagcaaaaagta

SEQ ID NO: 163245 - DNA, 258 bp, Homo sapiens
ctaacaaagacaccagtcagattggattagggcccaccctaatggcctcattttaagttagtcacttatttaaagcccctatctccaagcatagtaacattcttaagtacttgggattagggcttcagcatgtgaatttggggagaaggcatgaatcagcccttaacagcccataaagccctagacacactgtacgagctttgtaaaagttggttggtggttagtggttgatggtggttgcaggactctctgctccca

SEQ ID NO: 163246 - DNA, 712 bp, Homo sapiens
aggcgtgagccaccgcgaccagcgtatttctgttttccttcctgctttatttgcactcatgtccttacgtaccaagaaaaagtttgtaggcaaacctttaggccctcctacagcacaggcggggccagactcctcacacattcccagagctcttttttgcccccatcccatgatggcaccccaaactcccatttctttgctatctccactgtcagtaaccacctgcgtgaccttaggtgagtaacctaaacctccctagactgttgtcgtcacacttttcaagtgagggagttggactacatgaactgtaagatcctctcatcctgagtttctcgctttaggttttgcaagtacccatcattgccacagcacctcagaccctcaacctcccaccactaatcagccactatgggccttagtgtttcctgccttccagtttctcatcttcaaagaagtcaattcatatctacaacttgaggcaaaaatttcagatcatcaatacagtacctgttctatcaacaaaaggtctttcagtggggaaagcagaggtaacaaggcaacaaagccaaatacacaaaaggacagaaaaagaaaacaacttacagttcttggttaactaagttcaacttttcattattattttatagtgacaggcaggcctcactatgttgcccaggctaatctgtaactcctagccacaagcgatccttca

SEQ ID NO: 163247 - DNA, 260 bp, Homo sapiens
ctgggcgtggtgggtcacaactgtaattctagtactctgggaggccaaggcaggcggttcacttgagatcagcagcccggaggccagcctggctggcatgacgaaaccaaaaaattcatgtgacttcctttattgtgatattggttttatcgtagtgatgtggaacctaacctgtagtatttctgaggtatagctgtaatgactgtggtactggggaacgcttttttttttttttttttaggtcactgtattttaccact

SEQ ID NO: 163248 - DNA, 189 bp, Homo sapiens
ggcctgcaacataactttttatatgcactaggaaaccaaaaaattcatgtgacttcctttattgtgatattggttttatcgtagtgatgtggaacctaacctgtagtatttctgaggtatagctgtaatgactgtggtactggggaacgcttttttttttttttttttaggtcactgtattttaccact

SEQ ID NO: 163249 - DNA, 262 bp, Homo sapiens
ttcaaagacatttttgtaaatcattccctaacctctgaagtgttctttctttgttgctcccagagtcccctggtctttacatattaaaaatattaggctgtcctggaaatgttgtcttatttgtctgacttcaccactaaagtatgagtcccttaaggttgtcatttcatttttgtagtccttatgcctaaaatagcaacaagagtagcccctttattttttcaaatgaataaaaactaatgaaattaacattttatttgag

SEQ ID NO: 163250 - DNA, 221 bp, Homo sapiens
cagatatggcctatggctccacagagtataccatttacctagagagacaggcattaatcatatgctactcaaataattatagcatttcaattgttaaaaaaatgttatctaggaaacattaactacaacagtatagaacagagacccaatctttggaaggattagtggggaaggagagggtcaggggaggcttccatagcaggagtctttggagctgagtt

SEQ ID NO: 163251 - DNA, 416 bp, Homo sapiens
ggtgttccatgcacacgcgcggcacgacgtgttgctgggcacttctctcagctttttacaaaaaatgatgcaatgaatacgtacctggttttcacagttgtgcaaatgtatctgtaggcaaaaaccgtgttagggattgctcaacgcagacttaatgcatgagacctatgggcgtgtcggtcctctgatggccacgaagaaccggtgactccaccttcctcgtatacacaaacaccattagctatttgcctcacatttgagatacgtgatttatgtgttctcttccaacaggaagacaataaggcacagatcgccctcagtctgctcactgtcgcagcctgtgcagatttagtatctggcacgggtttcagagacctagctaggtcagcccttccctgcacacgtgtacacgaaac

SEQ ID NO: 163252 - DNA, 914 bp, Homo sapiens
ctctgtcgtttcttcaaggtgtgtctcctctgtctccattggaatgttctcctcgtctttcttctcctcacctttgtttggtgcttgttcttcctcaggaatgatgctgccctgactgcactcggcttgctctgccgcctccttctccctttcctcctgctttttgccggtctgttcctctgcctgtgcaatctcagctgcaactttctccatatccacttctactgtcagaccgcacaaccttttaagttcattgttaagtgaatctgtgctttctaggaatttcctcttctcctcctgtatttgaagaagttcagcttctagttttcactgaggaaccattaaggactggacctgtcgtttaaggacctgcattctagctgttgcgacaactgaccgaacgtctggcaccacactctcactaaggatttcactgaagaggtgatggtttcactaaaaacccatcatcataatcatctggatcttcagcagagctgaatgctcatatatggttctcctttctccatgtgagactgtctctgtcgactttcttcctctaaagcagcttctgcacgattttttgcatttacgtaagcaaggtatgtgggggaattatgatagaccttcataaattcattgtactctttctgcttcgtatccatttaaatattcttgtttttcttcatcagtgagatctcgccacatgccaccaataatcttgccagtctccaacaactttaggtcagggttggaagcctttacttggtcccagacctttcagctgtacctcatgtagggcatcagcagcttatctggtggctttgggggttttggaattgtagtaccagaggatgccatgaactggctgttggcacccgggttccctcccagcccttagttgttgtaggcgagat

SEQ ID NO: 163253 - DNA, 582 bp, Homo sapiens
gaaacttgagtgaggatgtgcggggacgatggatgcagtataatgctggtcgggcccagaagggaggagggctggggactccttaaaacctactgagggcctgggcccggtggctcacccctgtaatcccagcactctgggaggccaaggcaggtggatcacctgaggtcaggagtttgagaccagcctggccaacatggtgaaaccttgtctctactaaaaatacaaaaattagccaggcttggtggtgggtgtctgtagtcccagctacttaggaggctgaggcaggagaatcacttgaacctgggaggcagaggttgcagtgagccaagattgtgccactgtactccagcctgggtgacagagcaagagtccatcttgaacaaaacaaaacaaaaacaaaaacaaaaaagaattaattacctgaaatcattaggtctatcagttttagatttagatttgaattgaaatgtcacttaaattagatacaatttaaaaatccatatcatgaacttagtttggaaaaatctcatgacaattaaactttcaaaatcttcaaaagaacttccagtgttaataatg

SEQ ID NO: 163254 - DNA, 531 bp, Homo sapiens
cacaggggaagtgtttaaaggaacaaggaggtcgtggttcatgaaggattggccgtgtagatctaaaaccatttctcactccttctgaggggagcaaggctgaagaggaaggaggggacaccatggcagttggtagaggtcatgtgcttcgatggctgaacctagcagccttttaccatgcagagaatttagcttattctctagagacacacacacacacacacacacacacacacacacacacacacacaattttgtttggctttgatccacacaatgtgtttttaaagatgaataaaaattgataatatcaggtattttttagcctcgtaggccaggaaaaagtaaaatattttgaaagagtaaacaggagcgtctcagcagcatacatgttacttttcatcttaatcatgtgagcctctcatgaaagcctccaaggaggaggttaatggatgccccaattctgtacctttatcaggtttaagcttacttcagtttccctttagtttgttgcctgcagtatcataatta

SEQ ID NO: 163255 - DNA, 591 bp, Homo sapiens
tacttccccaaactctgcagactattatactttctcatcaggaaaacaaaaagacatcagatggaattacctcaacttcctcctgccacctcggctatacgcatccttgtttatagcacgagagtaggtaagagtacaggctctaaggcagatgcctaggttagaatcctggctctgccacttactaaagatttgatctgggcaagttgctcaatctctcagtgcctctgttccttactgtaccccctaaaaagccccttcccaatggcattcaaaatcatttacaccatctacctcttctgtgaagtatttccggtatctcctagcttcaaaggattgttgtgagttaaatgagataacacacatagactgcttataacagtgcctggcacacagtaagctcccaattaatgttagtcgtttttactactatcagcatccacacctattcttacctccaactgcaatgcaagaggcattctcttcttctaaggcaaatccttcaccgaccttctagacgccaccccttcaagagacttgaacatcaattattcatgtataaacatgctcaattctcaccatcttaaaaat

SEQ ID NO: 163256 - DNA, 128 bp, Homo sapiens
attgggagaaaggtgctctaggtcaaaatgatatagtcctagtctgtttcagagaaattcaagaaaatttgacataatcacaaataatatatttaatcaactacaatctatagttaagctaaaaagta

SEQ ID NO: 163257 - DNA, 195 bp, Homo sapiens
gtggacatttccacgagtcactcttcagacgtgatcctttgccacgtaaggaaatgtgatgccctgctcccaacctccaccccagcacgtcccccttacctgcctagaaaaaagaagaaaagtttagtagccaagaatcccaacaggataacacatactcatgccaactactcccgcgactcgtggaaatgtcca

SEQ ID NO: 163258 - DNA, 245 bp, Homo sapiens
taaatcaatctcttaatctcaactaattactaattcttaatctcaactaattatttttatccttttatctctagcccaggcccagcacttgtagggttgcaataaatatttgagagagggaaggaagggagggaaaaagaaaggatgggcattccttgaagtatagcaccataacttcataatttgtggtttgttgtttttgttgctgtttggttggtttctggtttgttttgtggctctgtaag

SEQ ID NO: 163259 - DNA, 213 bp, Homo sapiens
tccctaagccaaatggggtggggattggtgtcaacttttttcatacaagttgtttagttgcaaatatcgccaacgttttatctctactctgtgaatttgtaagggggggagggaaatgtcaaactcattgaagtaggattgaagatctgggatgaaaatactttaaatttttattttctacttatatatcagccaggatgttaggagaccttg

SEQ ID NO: 163260 - DNA, 717 bp, Homo sapiens
gacacattcagatcatagtagcacgcatgtcagatgctggggttacttaatttttctggcacatgaggacatttcagccaagcgtcccctgccaggatcttctagccactcagagagggccagcagacacgggggtgggggaagttgcagtttagccagctgtgccttcctaccccaaacatgcaccttctcttccccactgcccacatgagaacttgaagttattgtattaatggccacgtgtgttgttcttaacagaagttactctatttgtcaaaagactaagaagaaagacgtacctttccaacatggctaaggtaggcttcagccaagcagataggagggaacaaagcagtttcctgaaaagaggtgaaagctctaagtccctgttaagagtgagtggttgctctgtccatctggagggcagagggcaggcagggtggccttgcctggccactggcagaggagtccaggtgggcccccgtgactcaaagctagaagcctgccccctttccacccatcctcaggaaggctccaatctcctggctctctcagggcaggagggaaggcaggtcaacacttaaaagatgcccgatggccaggcgtggggggctcgtacctgtaatcgcggcactttggaagtccgaggcaggcagattacttgatgtcaggagttcgagaccagcctggccaacatggcaaaaccctgtctctatc

SEQ ID NO: 163261 - DNA, 406 bp, Homo sapiens
ccatacagggaggcaccattctgcaaacgccagattcatagactcactagcagcttgcaccctgattgtggaaaagctataggtactccacaacagcccagcccatgagggcaactggggaggttagaccctgcaaagtcacagatgcagacctgcccaaggccttgggatcccaggcctcatacccttgtgctctggatatgggatctggattcaagaaaagtgatttggagctgtaggaatcaatgactggccagttgtgttgttgacttttatggggtctgtaagtcccaactgtgttttgtacttgtttctggcaaatttcttccttttggctgggaatacttacccatgcatgtacaatcattgtactttggaagtgcttgctttgtatttcagaggctca

SEQ ID NO: 163262 - DNA, 437 bp, Homo sapiens
tcaggcattccttgcagtaataatagtttggtgactctagttactagtataggggtatggctcttccacagatggaagattttacttagtcctcagattttggtatgcagtagtgccatctagaagtgttaaaattgcagactccagagctccatctaaaagagccagtaaatagagtgggtctcaggaaactgcatttttaaccagcattggtggtgattctgttgccactgattcagtgcagcaggtcaggaactggactgctcactgaggatgacatggaacataaaacagagagggtctttgctttactgttgtttatagtcttgtgggaaagtccagaaataaaaatatcagataaataactaagataattatggattatgataaatgagatgaataaattgaataactggttgagattgatgaaatgggaa

SEQ ID NO: 163263 - DNA, 423 bp, Homo sapiens
aatgtaagccttcattttctcccagaaatcttactttaattctatcccataatatttcccatcatttaaatgtcctaggctcaaagtgcatggcacatcatgtctaatttccagttctctccagttgttcatgtataccttaactcccaacccagactctaaatttctcaagacaaagctaatgcctgtcacttttctcttccacaggctgtggtgtaatcgggacaacaatgaggcaatcctaaagaggtatcccaaattagggaaacccactgccccaactttacattaccaaataatggttccaggatgaatcaagatgatatagatgtcacagtgcaatcatcacaatgtcaacatgaccacaaagaagcctattctagctagttaagtttctcagaatctcatctatacagttggagg

SEQ ID NO: 163264 - DNA, 330 bp, Homo sapiens
tgctgtatattacataacagaatataaaaattaccagcaatccctctataaaagtttatttgcggctgggcacagtgagtggctcatgcctgagcactttgggagtgactttgggaggccgagatgggtggattgcttgagtccatgaacccaggagttcgagaccagcctgggaaacatggtgaaaccctgcctacaccaaaaaaaaaaaaaattatttgctacacttttttaggcccttcatttctgcatacatttctatgttctctttttctatactccaatagactatccccttctgttaatacccacctgttttcagacaagtgt

SEQ ID NO: 163265 - DNA, 318 bp, Homo sapiens
gtgtaccagctcagtatgattgcaccctttttttatacctattatgttggctaaaactgaacaaaaactgtgtccttttatgaatgagaaaatataggagagaatttttaaaaaccttttgtcttctatgactaaagagacttgctttttttactagcccctgttttgagagccggtcagatgtagttttagtcatattggggaggacagtgtttaagcagataccagagctccccattatgaaattctttcctgacaccagccccaactaggtcccagtaagaaatagatgcagaggacaacatcctacaaaggaaa

SEQ ID NO: 163266 - DNA, 395 bp, Homo sapiens
gcctggttgttgtggtcccacaaaccacaaatcatacgagagaggatcccgaaggcgggagaaaagtcagtacagacttgttcctgccacctttggaaagaaaaagttcctcaccaggcgcggggcgtgctttgctctgggcagggtcgcgcttgcaggggcttgggtgacccccatccctccctggcggctcacctcctgccgaggagggccacctgcctcctcctggcccagggcgcagggcgcgtcctgccccggcactgcggacgcggggatcgcctctcccgggcgcgcgggcggggaaggaggaagaggcgggcggggaaccgcggggtgctcaccgccctggggcattaggggtgcggaaccgcgttggaggcctcgcggccccggct

SEQ ID NO: 163267 - DNA, 690 bp, Homo sapiens
gactcaggaaccaaattgaagtttctactgggacaatttgagcattaataagataactgcaatggtttgaaacgcatcaagtccatgagttcataataataaaaataaacttgtatcattggccaccttttaaggataccagggaattaactcattattttgaaaactggtaaataaagagactcaggcatttattttgtcttcctgtatacagcatctcagcataaatcgttgagaaggggagtttgtctttatagaatgtagctaataaattaagtaatggtagaatgagagtattattttttgcaactcgtaaatcattaatggatctaggcaatgatcattttgtgtttcctaatgggagtacataacaaccctgttgaaatactcttgcccaggttgcccaagttacaccaacctgaatctgatcaagccccgagatctgattaccagcttacaggaagtaaagaggacagagaaacaaattaaatgacactaccggaatacagaggatagaaatatctgataggcaatcaggaatatctgcttaccaatttacaggaagtacagaggaacaaattaaatgataccacaggagtacagtgagcaaaatccaggcaatcttaggctctgtaagataaacaacgtggtttcttcaaaagatacattgcaaggaaaagagagagagat

SEQ ID NO: 163268 - DNA, 378 bp, Homo sapiens
ttaattttcaagttaacataagtctgagtatatgagactgtcaaagccagtttgcccttgggcaaaattataaggtccagtccaaaagaagagatagttccctttattctgagtcaatcaagtaccacatgtattgtgttcatttaaaggtgccacatgtaaagagggatatttacaaacttaaaacacttgcatcagaaaatgaccagaaagaagtgaaactgttgagtcaggaagttaaatattttggttgagttcaaatgtctgacagccattgggaagaagaggaattagacttactctgtgatttttagaaagtgagacttggaccagtaactgaaagttgcaaaaaaatatatttcactttactcttaggaa

SEQ ID NO: 163269 - DNA, 387 bp, Homo sapiens
tgtattatcctcctagcttctgcgactgctaaggttctgacagctgcagcctgagagctctcctgctttttgacagtgaatgaaatcctgataataactgtcttcgcttcccgtctctattaatgatgacaggttaaatggggcagccaactgaatgctaccgacagctttaaatggcaacacattaaagcaaaaggtgcaaggtcagccttttatagctgtcgcacttaacaaggttaaaatctaatcttctgctttgaaaagtcagggagttcaatttatcaactcagcatggaatgatcaggttctggggcattcacattaatgaaattcacaaaagactgattcatcctacagaacaccaattgtcatggactgaaccatgtc

SEQ ID NO: 163270 - DNA, 484 bp, Homo sapiens
ttaatgttgaacatcacccactctcttgccaggatctctccagctccctatggttcttttgccacactagctagtaaatctctgaacgaggaggatcaatccaactgcctgcttcctctattcccataccacagctactgagtcctgctgaagaaaatcataacaggttaggaattcattccactacaaatttacagtttctaatcctaactgagattactatcctgttggtaattcatccacatgcctcaggatcagtgaccttttccatcccagacagtaatcaatgggtactctaaatctcaagccaaacactctatacatctcttctctcacaattgccctttaccagaaaaaataaatctgacctcaccccattttccagcctacactcttcgtcatacccatatccttcattctaaatgttaggcaaaggtttatctcctccttccctgagctagcacagtaatcccttcttgcctcc

SEQ ID NO: 163271 - DNA, 759 bp, Homo sapiens
gtattcttttggggtatcttttttctcccatagatttttggggaacaggtggtatttggttacacgagtaagttatttagtagtgatctgtgcagatcttggtgcacttttgggtaccaattaaatgggaaaaggaatcctatgggaatccacagttttgaatggtccctgagtttatggtttttacccgttttgggtagcttctacaaagggtcctaagggtaaaactaagtttcagtacttcacttctgtatagttttatcctgataataacttacctagcatatcttcaaagattttaagcagatattttcttacctataagcctatcattttagtagtcttcagcagtaaatatatgccaaaaacagaataaagcctttactcactctttggtccagttcaacatagcttctggatccaccaaaactctttttgcagaggtcaaaaatgagtactaaactgccctatcaatttggcatacttttcattcctatctaattcaacctgtaaagttgctgacacacctgattattttcttctcttagagccagcttttgacttccacaacaacacactttcctatacaactcctatatatcattcctcaaggctcagatgagacaggtcttctcacttctatatttcctctgccacctgtttgtcttggccgaccaattcatcttctatatggacagcctgttaactggatttcttctgccaccttatgctaagaatggggaccctgagtcactgagc

SEQ ID NO: 163272 - DNA, 531 bp, Homo sapiens
gccctagaagtccaattcttcttgtcttcctctcagagtaaagtgaggtgggaagagaatcccaagtgcaatagggtatctagtctcaagaggcagcaccaccccctgaagcacagcatcttcagtgacctttcctggcttagtaactatgtgaatgtctgttattcagagttaccagatttcaacaaccagagaaaaaggcacaagcatttcctatttccattctctagagatttgctttgttaggaaagcaagactcttagtttctgtcacatggtgtattaagttttattgttgaagaggacgttatcttgagaccaagaatgcaaacaagattctatattagttctaaattgtagatggcccagtttatccagtctcatgttttaaaaatgaacacagctcaatggcttgcaagttgctacttacagatagtttcttcccattgtttgagagccttatgtcacattattaactaaaataaattcaagatagattaaaagagttacatgcagaagagaaaaccataaa

SEQ ID NO: 163273 - DNA, 1011 bp, Homo sapiens
taaaggggtgtgctggtgccttgagagcatccgtgtgcaggggtggggagtctgcaggtggggcagcaccctggctgctgagcctgtcctgtctccatgttcatagcatcccagggcttaactctttcccagttgggttgtagcatatgacactgaaggagcctgtaggccatcctgaactcaccgagagaggcaaattagcagctcctgggaagcaaggctgcctggccaggctggcctggattgggggaactagttgctactcgagaactccagcttcctatctgcttttgggatgaccctccctggaaagtccctcccactgctgtggaattttcaggctaccaaatgtgcccagcctgcctctcaggacagacagacagtgagaaaaagatctccagggcccactaagtcttccagagggagctgagacattcagccttccctggcagggctcaaagaggaaaaaagggattggaaatggggcccctctcagagccacttcaaagcaccctcccctgtggtcatgtgtttcagttccatgtgagtagtttttcttgacagtatcggtaattttggggaacagttcctgtgacactttgggtccctaaggccctgccctgaccctgtgagtggatatagttgggcacagagtgtattttgttgaggagcagatattggcttcctggtttgccaaagagctctagattgggagacaagaacttgatgttccagtgccagctctacagcaaatcactggtgactttggcctctcctggtcctcagtttttctgtatgtacaatgagattctcaagtctttccagccctgacttggtctgggatcaccctctccactccaataatgggaataatccaaagtaattttttggggattcagaagcctcttccaacaaaggatgccctaagattggaaggacaataaaaatgagtttgtgggccggccacggtggcccatacctgtaatcccagtaccttgggaggctgaggcg

SEQ ID NO: 163274 - DNA, 337 bp, Homo sapiens
tatcttaaagtagtcatgttatctccctgctgaatctctgatgagcctactgaaaaatgtgacataattagggatgaatttttcggctttgggtaatttacttaatgcaccatctctgaatttgacattgaacgttcattgttcactcattcaataaaatgtcatctatgcctaggtatgctgtgctcattcatttgaaccaggggtcagttgcaaattgaagggctaagagccatatctggtccccgccccccgccaaccttttttttggcttgcacattgtttaaaacaaaatgaaaataggtttttagttttgctaagatgtagcaacactggg

SEQ ID NO: 163275 - DNA, 172 bp, Homo sapiens
tgaatatacagtttacaaaatagcacagaggtgacaacgctaatgacacaaacttcccgcagcgtctgtgttcaggaacgtcagaaatccatggtaggcagatgacaggaacacaggaatgagagagaccagaaaagcagtggatgtgtgagaatacctgctctctccaatg

SEQ ID NO: 163276 - DNA, 628 bp, Homo sapiens
acagtttcgaggattacaagcggctgtggaactatgttcataacttttatgtgggtctgaagattttccagtgcccaggctgggcactctgcttagctttgcgcgtggattatctcatttcatcctcagagcagcttggggatgggagagctctatcacacccattttccagtggagaaaacagaggcacagctagttgtaagcccaggccacattatgcccccaccccctgttttgtgaaatttagtactaaagatactacatggctgtgtgatgtcgggcaaatcacttaacctctctgtgatctgtttccttttttcttttttttgctacgagtggataattataatatcagaaggttgttctgatgggtattatgatatataaagaacttagaacagggtttggcctaaagtaagcgctgagcaagtgtctgctgttgctgctgctaattgtatttgttgctgcagtcgtgatcccagcaccctcaccttggccagtgatggggaaacctgaagggtgttttttcttctgtacccagggcgtgcttcatgggtttgtgatctatatggtcacacagggtcccgtgttcagaagatccccccatgtcactgacttgcaattcgta

SEQ ID NO: 163277 - DNA, 116 bp, Homo sapiens
accagcagaggaattgacagttttgggtaagaaatgcaactgacttttggatacaaagcatccagcttaatataagggagcagaagtgtgaagttgaactagatagttaaccatta

SEQ ID NO: 163278 - DNA, 104 bp, Homo sapiens
ttcactctattgggtttctttatactttgtaaactttgtggtttcaagtaatatccttatgcttttatttctagttttatcagtaatagctcatttcttccatt

SEQ ID NO: 163279 - DNA, 340 bp, Homo sapiens
caatgtccactgcccctattcaaatacactcaacccagtaacctaggatctctgcatactaagaagtattgagaagatagcaggggaaataacaacaacaacaaaaaaatcctgttaaaccttccagagaaattgctgtgcccttgttttaaataaacctatctagtgaggccactgctataactctcctccaaaacaaggaccatctgttgcaagctggaagactgtctacacctaaataaagaaaactcacaatttttttttttttttttgagatggagtctcactcttttgtccaggctggagtgcaatggcacagtctcggctcctgggttcaagc

SEQ ID NO: 163280 - DNA, 580 bp, Homo sapiens
tatagtttgaagttggatagtataatgcctctggctttgttctttttgcttaggattgctttggctattcagcctcttttttggttctgcataacttttagaatagtttttttttctatttctttgaaaaatgttgttgatagtttgataggaatagtgtagaatctgtaaattgctttgggcaatatggccattttaataatattgattctattcttgatcatggaatgttttccatttgcttctatcatctctgatttctttcagcagcattttataattcttgctgtagagatttttcacctccttggttagctgtattcctaggtttttttttttctttttttcttaatggatattgtgaatgacattgcattctcgatttgacttggacattgttgatgttgatgtattgaaatgcttctgattttgtacattgattttgtaccctgaaactttgctgatttattagatcaaggaatcaatgagctttttggcagggactgtggcgtttcctaggtataaaatcatatcatctgtgaagagagatagtttgattgcctctcttcctatttggatg

SEQ ID NO: 163281 - DNA, 406 bp, Homo sapiens
gaggtcaggagtttgaggccagtctggccaacatgatgaaaccctgtctatactaaaaatacaaaaaaaaattagccaggcctggtagcatgcaccagaaatcccagctacttgggaggctgaagaaggggaattgcttgaaccagggaggtggaggttgcagtgagctgaggtcactgcaaaaaaaaggcaaaccacagaacaagctgtgatggcacttaaggctgccacatcaagaatggaaaagtaatcttcccaccaactttccaattacagatatacagtgtttacttgctataaaccacctgatattatgcagaaaccaaactaaatccataacttaaaaggtcatggttaaaactgttacaaaagccaggcgcggtggctcatgcctgtaatcctggca

SEQ ID NO: 163282 - DNA, 636 bp, Homo sapiens
ctagatgatagaaatttttcagctccattataatcttttgggaccactgttgtatatgtagttcattttgaccaaaatgtgactgtatttggaaaaggagaaattccatatgttcacaatttggccacataattacaacagttcaattacatgtgtatcacggagtgtgcttcatgcattcagtccaggaacaaatacttaacgagattatccaggcccaggttgttgtagagcccagcattaggtacagtggacaattagataactaatagttggtttgatatatttttgaaagccagtggaaagtttttggtgatctactcacctccccacaatctagccctgtgtttgataggaattaccccatcttcttccctacctcctagctaggccatgggattgggccttctagtcccaaccaatctaagtgcaaatatggattctagttttagcagcaatggtaagatgacagctttcaggaaaccagggaagtaagacctatatgaaatagaaatcatctgcatattttcatggtgtaaaaatttgttcaaacgtttctgcctctaatgtgatcccatagtcacgagtccacttgaactctgatctcatccttgtatagtgcctttggtactaacc

SEQ ID NO: 163283 - DNA, 232 bp, Homo sapiens
atctaatgatctagaaagactaaaaacaatggaatggcaaaataattaccaggcaaatattaatttttaaaattgatggcacagaattttatagccacaacagaggccagaacacagtgtaattatgttgatatcagacaaaaaagacttaaaaagtatttagggataaagaaagtcactgcaaaatgaaaacatgaacaattcactaggaatattcaacagttctgatttt

SEQ ID NO: 163284 - DNA, 346 bp, Homo sapiens
caattaaccccagaacattttcacacttcagatatggagctcccctacctatttcaatggaatcatgataaagcagcgagacaaatccgagtactggcaatgtctgttgaacagaaaaagaatccaaactgtcctgtaatcagggtgctatgtactggaaattggttttaacctgataaccttcaagctcaagaggttagccaactataacacagattgtaaaggcagcaacatttaatggtttaaaagtgctacttgtagttacccttgtacttctttactcatagttctgatgcaaaagatacttgcaaattttctataaattggaaacaaaaatagaggagct

SEQ ID NO: 163285 - DNA, 509 bp, Homo sapiens
agtggagttgggtcaaatggtctgtgcttttgtaattactttacctgttgccgagatctgcttttagaattcccacagccacatacaaggcctgtttccctaacctttaacgagcccagcgagttagcacttgctggttgcggccatacagttaggtggagacttgccctggtgtggtgtggttttatcttaggagttgataaaggttgaatattgtttcaagtaaacgatttcattgatatttggtgagttgtttgtctcctttgctcatctctgtttcaaaaaagaaaagaaaagaaacatggttcaaattatatctaaacaaaaaagaataagaaacaaaaaacacattaaaattttaagttgtattttctatgtttctagatacatcatttttgtttgatattttcctgatgcaagtatgtggtttatcacatgtagctcttttgcatgctaaatgaaaattcaaaacttgccaataaatgaatagcttattgcagaaaaaaaaa

SEQ ID NO: 163286 - DNA, 599 bp, Homo sapiens
tactaattggaaagcagtttccaggagttaactcagtttaattttcagtctcagttattttagcctgtggagtttttgatggcacacctttggagagatggccaggcctgattcccatttcaggggcatcagaccatacctttttaagaagctccgtgaatctagtcatctacccttcatcctgggcgaacagccaaaaagagaaggggacaaggtgtctttttctccttctcactggggtgacatgaattcttttagttaatggctgtttgcaaattctaaactaatgaaatacttagcagctaacatgttcaatctagtaatgatgagtttaaatctcaattgacagtaatgttttagataaacaggcccagtaattcagttgatgaactgtatatcttctcagtctagatttgtaaatgtttaatgaattcagggttataagcatagttctttaagtaagattccagatagttgatttgtaaccagtagtctacctatgaatgtatcccaaacctttagaagattggaaaagatttttgaaataatgatttagttttgtaggaaaaacacccccttgaaaattaattcggttgacc

SEQ ID NO: 163287 - DNA, 382 bp, Homo sapiens
aggatcccccttcgcagagctctaacaaaagagacaacagaagagggcaaggactgtctgctccagcacaactggacacctcagaccacaggcaccttccacctcctcagccccaggccagactcctgccaagtgcctgctgcatgcactacatagaaacgctgccaataaattaatccctctcacctgctttcagtacaaaatgaggacccattcagtgttaaaaagtaactacaaaaataaataaataaggagtaaccataaatagaatggcctagtttaatttgggaaaaaaatattttgcatcttatttgcaactcaatattatataggacaatcctaggaagaaaaggggagcagctggttttaactattagtttcc

SEQ ID NO: 163288 - DNA, 525 bp, Homo sapiens
ttaccacaatccagcgaatctactttctttctctcccttgttcccctaactctctcctctagttctttcactaaatagccttgtcccttttctttgagaagatgaaagccaattggcaggattcttcattttccataaaaatttctaaactcctccctgcacacatactctttctccctgcctcaacagcttgcacacatgttcccctcttctcaaacaccaggcctctgggttctgatcctgctccctccttccttctcgatggtggtgctcctgcaattctcttcccaactccagcatcaccaagctctcccttttctaaacatctctctacaataagcactttaaaatccttcagaatcttccatttaaaaattaaaaacaggccaggcatggtggctcacacctgctgtcccagcacattgggaggccaatgtgggcagatcgcctgagtataggagttcaagaccagccagagcaacatggtgaaacccatggctacaaaaaatgcaaaaaaattagcca

SEQ ID NO: 163289 - DNA, 280 bp, Homo sapiens
aatgtttcaaggagaaagatcctttccgttttttaagggtcagtcacgtactaaaacagaagaaggtggtgtttatgctgtgattctagtaaattcttcaagtaagttttaatttgttgaccttccctcttggccttttatgttctttgcatttggtagttgtagcaactcgggaggctgaggtgggagaattgcttgaacccaggagacggaggttgcagtgagccgagatcacgcctctgcactccagcctgggcaacaagagtgagactcggtctcc

SEQ ID NO: 163290 - DNA, 343 bp, Homo sapiens
ttctcattctttgccaaagctacatgtctctgtgccaactcacatgaggcttaagggagtgaaagaaatgtcagataaattctacctgtttagacaggcctaaaatgctgaaggcaacttccgccaaggattcctacagaattcaaaacatagcacagtgtcagaaaaagtaggagataaggaagacaggggagggagctcatgtaagtaaagacttaaaggagatggagataattatttactgggcctgttccaacaacaaacaagaagtcttcaagtgaagcattgtcgctgtaggacaaggaactcaggacagattctacccaacagatgttgtcaccaa

SEQ ID NO: 163291 - DNA, 268 bp, Homo sapiens
gtaggaacaggattcccccaactctcttttctttcctattttgccacaaaccattccatcccagactatcacttttagatgtttttaggcataagttgggcaccagtactagtgtccccaaaccccaaagagcacatatcagcttttcaagaggatcttttaagtgcccaatgctacttagtttgtaaagatagtaagaaagaagcacctctcattgccctatggggaaaatgagcagagataaagagagggtggatatcaatgcaca

SEQ ID NO: 163292 - DNA, 110 bp, Homo sapiens
aactgttccatctaaaatcatcaggcattagttagattctcataatgagtatgcgcagttcacaatagggttaatgttgccatgagaatctaatgcagctgacctgacag

SEQ ID NO: 163293 - DNA, 437 bp, Homo sapiens
atcacccttcccgtgaaagagaaccctgagaaaaacgcacaactgactttcctctactccccctttcccgtgtaaaatgcaggcttactgaggccaatcggaggctcacaacaatgtttaagcatctgcctcactgctccccagcctcccttttttcccctcctgcttgttctttcccctttaaatactgaacttctcaaagctttggaaaaagcacaaatgctcctgttacctggcacgtcctcaactgcagctacgtaaacctctatcgattgagacctgcctgaatcactttttagttagcatcaggtatattctggggaaggatggacatttggaaaaaagaacgggcagggcacctcctgctttctcaactattaagctaatggcagccaactttgttatgtggaacagctaaaactccaacaaaaatccac

SEQ ID NO: 163294 - DNA, 248 bp, Homo sapiens
gagttctcagactgtctaaagaggacactcatgatctaggaggggaagaggagatggaaatgggaaaatgagcaaggcagaggaccatctaagatgtgatcagagttcaggaatcaagggccagcctggcctagctgtgaactcttgggcaagtcaagaaacctctcagcagagcttcggtcaactctctgtgaaacagtagttcacgatctgcactcctgcaagctcacctgcctgccagcctatgg

SEQ ID NO: 163295 - DNA, 322 bp, Homo sapiens
tgacgggtacagtggctcaaacctgtaatccctgctagttgggagggtgaggcaggaggtttgatcccaggagttcaagggcaacagaaggagaccttgtatcttttatatctatatctatatccatctatatcttatgggtaaaggaaatattctatatttttatcatagtggttacatgactgaatttatttgtcaaaagtcactggaatgtatacctaaatatgtgaattgctgcattttactctatgcaaattgtacctcaaaaaacctaaccaaaaacagacaaatgaaaagataactctgagctcccgccgccatt

SEQ ID NO: 163296 - DNA, 507 bp, Homo sapiens
tcccaattcttaaaggcctacttcttcagaaaggtttccctgacctctctggatcgcttgtgtttttactgtgaatttccacacccatccatctattcattatccatttaacaggtagcttttgagtgtctaccatgtgtgatacatgggaatatattggtgaataaaacaaacacggtctggctctttcccactagagcttaccttctaattgagagacatagtaaacaagtagcagataagcagtaaatatctaactacagtagagtgcagtgagagagaacaacagggggaatgacttgatgtggaccaggaagatctctctgaggagttgtcataaaagctaagactgtagaacaaggaggcagccatgtagagtgtagctgagtctcactgtgcagcttggcatgtgttcattctccgggattttactctgtgctgctgttagatgtgcactgattttgtcccttcagctagattgcaagttccctgagagctcagaccata

SEQ ID NO: 163297 - DNA, 330 bp, Homo sapiens
aaaagcctattgtctggccagagccattggctggcttagcacttacttatttgttggataagctttttattgaaatgctaagtataaatacacaggaaaagttctctattcaaaactataagtacagcttgatgaattttcacaaagtgaacacagtcacgtcactagtactcagatgaagaaatagaacttgatcagctcccagaagccccttccagtgtcccctctctgtcactaacctccccaccgcagaaagaaccactaccgtgattgttcacaccatacattagtttttgtctgtttttagaaaaaccttatataaatggaata

SEQ ID NO: 163298 - DNA, 317 bp, Homo sapiens
gttgccaggggttagggagcagaacgaggtccccacagaacagcatccccacccagaacagggttacctcagaacagagtctcctgagaacagggttcccttcaaaatagtgatgggaagtgactgttaattgctgtgggggtttcactttggggtgatgaaaatgttctgaattcgacattgatggctacataaccttgtgaagatactaaaacccactcaattatatattttttgtatgtatgtatgtgtgtatgtatgtatatatgtacctattttattttattttatttattttattttgagacggagtttcg

SEQ ID NO: 163299 - DNA, 256 bp, Homo sapiens
atgagccaccgcgcctggccaagatgatgtttctaatgactttatttgcgaggagaactgcaaagagggtgtttttgtcctgctcagggtctacatcaacctatagggcagctttccccttatcctcacccctgacccactctcactttttctcttgttcacaaatacttaaaatgacagggatcttttcctaaatatccaaattcatttttgccaagttagagagcctagcctgcatggcatagtgggaggagtg

SEQ ID NO: 163300 - DNA, 219 bp, Homo sapiens
taccaactaacatcaacacatcaaacttactaagatttccagtaaatgactattagaatacacaggaagttcttatgttctgatgtgcggaagaaggaaaaagggagttctgagtatggtgttactgctagagaacactggcctaagtagtgtgtcatgagtaatttgagagttgcaaagggaaactctgcatttgagcagtcagtgatctgttaaaag

SEQ ID NO: 163301 - DNA, 404 bp, Homo sapiens
acctacccacctggaccaccccgctcacttgggccacaccacacttccactcttgtccccagcacactcccgctgcccccatagcatccagtaaccctttacaattaaaagtcctaacacacctttcccctgtccaggaagggcctctcaggccactgggagtcaaatctaaactgcccatcacagcccatcaggcttgcaaggaagaagatgacctgcagaaacccttcaccaagtctgcatgcaaaggagagaagaaacaggctgctgagtgaggatgagggcagagggggatattttaagttttgaagtgcggtggcaaggaggtgcggtatctcctgtgtgacagcctcgctaggctctatgaagtggaaaattggatcatctgtgaagaggaagcgggg

SEQ ID NO: 163302 - DNA, 299 bp, Homo sapiens
gggggttgtcaggtttggaggccaaggaccaggcagggacccagtggcaggtgggatggagggacctactgcaggagtgcagtgcatgggaaggcaaggaagaagatgacctgcagaaacccttcaccaagtctgcatgcaaaggagagaagaaacaggctgctgagtgaggatgagggcagagggggatattttaagttttgaagtgcggtggcaaggaggtgcggtatctcctgtgtgacagcctcgctaggctctatgaagtggaaaattggatcatctgtgaagaggaagcgggg

SEQ ID NO: 163303 - DNA, 173 bp, Homo sapiens
aattgataaaactctagaactttgggttccattcttatgatgacaataatataatgctagggatgccaagtgaatagcaagtttaaccaagttatcctgtatggggagccacagttacttaaaatgtctgataatccacagtcctggtgatgatgtggaatatcactctctta

SEQ ID NO: 163304 - DNA, 242 bp, Homo sapiens
gtaaatacagcagaggataccctaaaagagatactgaaggatttgatttttctttctccctgggaagatggaatccataagttgggtccccaagcccacaagacaggtgcaagaaagggtggctggaagattgtgagtcatgacagggaacatttttccttaggttccttgggtatataaagctcccgactatctgtctatcatggatagataaagagtgaacatggtcccctctccacaaa

SEQ ID NO: 163305 - DNA, 2837 bp, Homo sapiens
tagtcctcctgctacaccactgaccaacaggaaagtttgtgtctccagagtggacacatccataaagaggccaaacccagtcaaggtctaagcatctgatggctataactttgcttctttgaaagataataaaaagcttctgacctcccatcaacagccaacctgatttcaaagagccaagaggcctcagattcgtcaacattcctttaacgagctgagaaacttttcatggtaaactcagcagctgagtaacaggatgatggcaccacaacaggtagataatcaaggcaggaggtcaaagcattggagccaacacccgcccaggatggggtataaaagggctgggaggagaggaggcttcagtctcagtggttcagctttcccagctgatctgaagctcctgtgcagcctcagcccaacaccatgacctcttcctacagcagctcctcatgccctctgggttgcaccatggctcctggagcaagaaatgtctctgtctctcccatcgacattgggtgccagcctggggcagaggccaacattgcccccatgtgccttttggccaacgtggcacatgccaaccgagtccgtgtggggtccactcccctgggccgccccagcctctgtctgccgcctacctgccacactgcttgtcccttgccagggacctgccacattcctggcaacattggaatctgtggggcctatggtgaaaacaccctgaatggccatgagaaggagaccatgcagttcctgaatgaccgcctggccaactacctggagaaggtgcgccagctggagcaggagaatgcggagctggaggccacactcctcgagaggagcaagtgccacgagtccaccgtgtgccccgactaccagtcttacttccacaccatcgaggagctccaacagaagatcctgtgcagcaaggccgagaatgccaggctgattgtacaaattgacaatgccaagctggctgccgatgactttaggatcaagctggagagtgagcgctccctgcgccagctggtggaggcagacaagtgtgggacacagaagctcctggatgatgcgaccctggccaaggccgacctggaggcccagcaggagtccctgaaggaggagcagctctccctcaagagcaaccacgagcaggaagtaaagattctgaggagtcagctgggggagaagctccggattgagctggacattgagcccaccattgacctgaacagggtgctgggggagatgcgggctcagtatgaggccatgttggagaccaaccgccaggatgtggaacagtggttccaagcccagtctgaaggcatcagcctgcaggacatgtcctgctccgaggagctgcagtgctgccagtcggagatcctggagctgagatgcacggtgaatgccctggaggtggagcgccaagcccagcacaccttgaaggactgtctgcagaactccctgtgtgaagccgaggaccgcttcggcacggagctggcccagatgcagagcctcatcagcaacgtggaggagcagctgtctgagatccgggccgacctggagcggcaaaaccaggagtaccaggtgctgctggacgtgaagacccggctggagaatgagattgccacgtaccggaaccttctggaaagcgaggactgcaaactcccctgcaatccgtgctccacgtctccctcctgcgtgactgccccctgtgctcctcgcccaagctgtggcccctgcaccacctgtgggcccacctgtggagccagcaccaccggaagccgattctgaattcctgtggacccacaggggctggctaaggcgagggatacccaaagagagatgcttgttatacctttagaaaatctggcttctaactttctgtatgtataggcctgtccaaaggctatgagataccagggacagtggaatcttgatggaaatccttcctttcctgctcttggttttcccaggtgagctctatgccctcagtggctggattgcagccacccatggtggctcagaatatctggattggagaggcataaggttgaaaagcattttggagtaggaacacggcatgatttaaaattgcacttgcacttcaagaacaccaactttaacttgaaatttttatagtttatgacaaaggaagtgaagaacagacttcactgtctgagatttcccacatttcttgggttgtttctaacattggcagcctggattatggccctagggagagggaaatagaatcagaattgtacctgaccctgtcttttctaattcccttctcctatcctcctgcctccctatcttggaaactgattaagtggaaactttccttgtatcaaatcctgagttttctctacttcagggtttctagctttgacaaaggaccaggcttgccttttctgtggcaacacagcctcttacatatggcttccatagcttcttgctatgtgaaaggaactttcagattaagaaatttctctcttttttctctataaattctgactctccagacttgtctggctataacccctgtccctgtctaattctcccagtctaaaatctaaacaatgacttcatttttttctagtactttctcctgaagtattgaaacctattgattcaatgggtagagatttgctaagtatgatgtgcttccacctcttctcttcatactctctaccttccttaccatgattcagccacactggcctttctgttccttggacatgcctggagacctgtccctgctcttccttctctctggggtgctcttccccctccttataaatgttcaggtcagcggaaatgttccttcctctgag

SEQ ID NO: 163306 - DNA, 3023 bp, Homo sapiens
tagtcctcctgctacaccactgaccaacaggaaagtttgtgtctccagagtggacacatccataaagaggccaaacccagtcaaggtctaagcatctgatggctataactttgcttctttgaaagataataaaaagcttctgacctcccatcaacagccaacctgatttcaaagagccaagaggcctcagattcgtcaacattcctttaacgagctgagaaacttttcatggtaaactcagcagctgagtaacaggatgatggcaccacaacaggtagataatcaaggcaggaggtcaaagcattggagccaacacccgcccaggatggggtataaaagggctgggaggagaggaggcttcagtctcagtggttcagctttcccagctgatctgaagctcctgtgcagcctcagcccaacaccatgacctcttcctacagcagctcctcatgccctctgggttgcaccatggctcctggagcaagaaatgtctctgtctctcccatcgacattgggtgccagcctggggcagaggccaacattgcccccatgtgccttttggccaacgtggcacatgccaaccgagtccgtgtggggtccactcccctgggccgccccagcctctgtctgccgcctacctgccacactgcttgtcccttgccagggacctgccacattcctggcaacattggaatctgtggggcctatggtgaaaacaccctgaatggccatgagaaggagaccatgcagttcctgaatgaccgcctggccaactacctggagaaggtgcgccagctggagcaggagaatgcggagctggaggccacactcctcgagaggagcaagtgccacgagtccaccgtgtgccccgactaccagtcttacttccacaccatcgaggagctccaacagaaggtgaggtgtgggatcgcttgggtgtgctgggtctgagatggcagaggcaagacaggaggaatccatgtaaagctcagagaactttgggttcttggtttctcttggacatgatcatagacaccacacgtggagaaggagcctagggcatgatgctttgtgtgtgaactgtcttcctgttctcctcagatcctgtgcagcaaggccgagaatgccaggctgattgtacaaattgacaatgccaagctggctgccgatgactttaggatcaagctggagagtgagcgctccctgcgccagctggtggaggcagacaagtgtgggacacagaagctcctggatgatgcgaccctggccaaggccgacctggaggcccagcaggagtccctgaaggaggagcagctctccctcaagagcaaccacgagcaggaagtaaagattctgaggagtcagctgggggagaagctccggattgagctggacattgagcccaccattgacctgaacagggtgctgggggagatgcgggctcagtatgaggccatgttggagaccaaccgccaggatgtggaacagtggttccaagcccagtctgaaggcatcagcctgcaggacatgtcctgctccgaggagctgcagtgctgccagtcggagatcctggagctgagatgcacggtgaatgccctggaggtggagcgccaagcccagcacaccttgaaggactgtctgcagaactccctgtgtgaagccgaggaccgcttcggcacggagctggcccagatgcagagcctcatcagcaacgtggaggagcagctgtctgagatccgggccgacctggagcggcaaaaccaggagtaccaggtgctgctggacgtgaagacccggctggagaatgagattgccacgtaccggaaccttctggaaagcgaggactgcaaactcccctgcaatccgtgctccacgtctccctcctgcgtgactgccccctgtgctcctcgcccaagctgtggcccctgcaccacctgtgggcccacctgtggagccagcaccaccggaagccgattctgaattcctgtggacccacaggggctggctaaggcgagggatacccaaagagagatgcttgttatacctttagaaaatctggcttctaactttctgtatgtataggcctgtccaaaggctatgagataccagggacagtggaatcttgatggaaatccttcctttcctgctcttggttttcccaggtgagctctatgccctcagtggctggattgcagccacccatggtggctcagaatatctggattggagaggcataaggttgaaaagcattttggagtaggaacacggcatgatttaaaattgcacttgcacttcaagaacaccaactttaacttgaaatttttatagtttatgacaaaggaagtgaagaacagacttcactgtctgagatttcccacatttcttgggttgtttctaacattggcagcctggattatggccctagggagagggaaatagaatcagaattgtacctgaccctgtcttttctaattcccttctcctatcctcctgcctccctatcttggaaactgattaagtggaaactttccttgtatcaaatcctgagttttctctacttcagggtttctagctttgacaaaggaccaggcttgccttttctgtggcaacacagcctcttacatatggcttccatagcttcttgctatgtgaaaggaactttcagattaagaaatttctctcttttttctctataaattctgactctccagacttgtctggctataacccctgtccctgtctaattctcccagtctaaaatctaaacaatgacttcatttttttctagtactttctcctgaagtattgaaacctattgattcaatgggtagagatttgctaagtatgatgtgcttccacctcttctcttcatactctctaccttccttaccatgattcagccacactggcctttctgttccttggacatgcctggagacctgtccctgctcttccttctctctggggtgctcttccccctccttataaatgttcaggtcagcggaaatgttccttcctctgag

SEQ ID NO: 163307 - DNA, 243 bp, Homo sapiens
agggaatgggcacgttagttatggctgtattttgtctcatcatttctggttgatatcttttatcaaattcttctcctttgaattttgctgcctccaggaaggaaaaaaacccatctacctcatcttccagaacacttgcacatagttaccacgtaggactggctgtcagtcctgacatcgtcatatctgtaggacacagtgtgcttcagtggttcccttcccttcagggttgttctgtttcta

SEQ ID NO: 163308 - DNA, 385 bp, Homo sapiens
gaaatgcatttttttggtcaatgtgatgtgaactagggtccagaaactgaaactccatttgacatcagtgtagctgaattcccctaataaataaaaaggtcaactgtcagtaggaataagtatgttttctggttttcccctgaaataaaattggtcagtcaatgctgacaggccaggcatatgttcctgagctgatcacattaaatatacacaatttctctatcctgcgactactttcaaaagcacattgtttcatcaaggttatctcaaaacactagtacttgcatatagtgtatcatctgctctacttctgtactttctatattatacactgggttttgcttcccctaacacttgaataaaacatactgccaagttatagtag

SEQ ID NO: 163309 - DNA, 433 bp, Homo sapiens
  misc_feature (1)..(1): n is a, c, g, or t
nctcggcccagttattttctatgagaggttgatggattattaataagtcaattcctggaagttgagagagcaaataaagacctgagaaccttccaaaaaaaaaaaaaaaaaaaaaaagaaaaaaaaaaaaaaaaaaaaaaaaaaaaaaaaaaaaaaaaaaaaagcatgatacatgcagataatcttaagaaattcaaaagtactttaagatttatcacaaaaacattaatctttaatatcactgctgcccattcttcagtgtgacatcacagagggcaccacctttaactctgtaagctgttccttctggcatttccctctatatttagaaatgatatgttcatatttatatttattgtgatttcaattttaggtattatctattgttattttctgttatccctggtaaagaagttgaggatttaattttgtt

SEQ ID NO: 163310 - DNA, 1311 bp, Homo sapiens
  misc_feature (1253)..(1253): n is a, c, g, or t
tgggcgacagagcgaggctcagtctcaaaaaacaaacaaacaacaaaaacaggctggttggaggcctcctgtgtgagctgggcatgtggacaggtaggcatttctttggggttatcatgtgatcagccagctttttcactggggacttcctcatgttgatatgtgaaatatgctcaggagtagtttattttctccagagaagacactggtcgtgttctgcttggaggacatggtgggtgaagtctaagcctggttgctgacattacggggctgggctgaggggcttagggtctcagtgttcggtacttgctgttaatgtactgtgtggccatttcacaaaccacctcatccgtgtgagccctactcgtttctggtttggtgtctacaatggaagagggatgatggtggtcagatgctctggctttacaaactcttgatttaaatctggttttggtctggtggtctccagttcttgagctgttcaggttataccagctgtgttaatttgttccttctagttacccgatttcctgcacccctcagccagttaggattgaccttgcttttctcattcctgtgtttgctttccatctacatatattgttagcactattgtttccgtttacaaatcacttcaaaacttcattttattaaaacaatcattttttttacctctccccatttcttgggatcaggaagttgggaagggtggggttctggctgggtttcttgcacctggttgtggacaggcagtggctggagttcggaggggattcgttgagcgtctccaggaggtatcaggacaaaccttggagatgggaaacagcacagcaaggcatgctcccacagcagtccggtgcagctccagaatgagggagccatggcaggggcattagtttaataatcattggaactaattctctttccagcttctccttggacctcttcacatttctacctagatgtctcatcagaatggaattttcagatccttccttctgccccacagtgctctttgccatgctcttttaaggtaccagaatactgggaaaaaaagggcgttctggataagtgaaaatgtcctaggacctgcttggtgtttactgacttactaggaagttgatagtgaaatgtgaagggttcatgacagtgacttggtgttactagaaagcaaaagtaaagtgaggaacacaggaatctacaagtgcttgggtgtggggtagtgggtggggtgcagttgtggggtggcatcnataaacaccggtgtaatcgatgcactcttagatgtttggtatatctaccctcagatgt

SEQ ID NO: 163311 - DNA, 346 bp, Homo sapiens
cagtcaggtgattttgcccacacaaccaccccatgaggcaggtgctctttttaccaagaatctaaggcatagagagagaaagtaacttggaaaacgatttcatttgtggctttcttcccacagtagctcattagttatttccaattctcttgtgtttgacagtgttggccactccccttttcacaaaacaatcatgtcattatttgtttcttgtttctctcctggtgtccatcctcctcagtatcttccctcttcagcccattcctcatgggtgcccctcggttttgttttatgctcctttttcaggctgtattcaacacgagtaaactcatctaatcccatggct

SEQ ID NO: 163312 - DNA, 415 bp, Homo sapiens
tggtgaataatagacctttagaaaaagtatttctgctacactttgcagagttctgggaaggtgtatcaatgcctttctagtagtgagattcaaaagattgcttgtcactgttaccactgtcactgcctctaccactatcagcatcattgccatcagctccatagtgattagaactatgttcctaatcttatcttcctttgcataaagagttagttaaataaacataactggcaaaacgtagtaaaagttcagcaggtaataattaccagaggaaagaagatggcacagctattggcatttaaaatcaagtcagattactgttttgggtggagagtgagtctgtccctttgtctcttcccatattttttttctctttccttactgtgaaaggagttccttgccaaatcaagaaaaa

SEQ ID NO: 163313 - DNA, 429 bp, Homo sapiens
tagttcagtggcattaaggacatgcagacattgttgtgcagccgtcaccaccatccatctccaggactttttcatcttcccaaactgaaacaacatacttatcagatactatctccccattcccccagccttcctgcaaggctggcgttacgataggtgtgctcagcctggacaggacttcagtggaggaggacttgacaccaccaaatagtgtgaagaaaaacctagaagtctggggagaaacagagagggagagaagtaacattgatggagcccttcctgtgggctaggcttcatcatttgtgtctaacactgggcttaatccttacagctagctctgtgtggctgctgttgttagctccattttccagacaaacatattgaggcatggaggcattaactaccttgctgaaggttgcacagctgagg

SEQ ID NO: 163314 - DNA, 375 bp, Homo sapiens
agaaactggataagtggcagataactcactgcccaagccatgcactccagccccaacccagagggtgcaggggagtgaccattcactggtccatctcatgtgcacctgcgactgttggagtgaggtggtgtgcagtttcctctattctcagaagaagtacaaggatgaaaaggcttagaagcaaaagggaaaaaagattcttggtttgcatcttacccttcctcaaggcccatgtctgggcaccaacattttttagaattttctccttagctcagctaaaactgaattcttatcacaccaaggaaagattaggtttgcagacaccctgaagggtgacgagcagaatttattgggtaaaaagagaaaacaaaacga

SEQ ID NO: 163315 - DNA, 270 bp, Homo sapiens
atccattttgaattatgatgtcaggtaaagatacatgaggtggggtaaaggtctaactttattttttggcatgtggacatccagttgtctcagcaccatttgttgaagagactattctttcccccattgaatgatcttgacacctttttcggaaatcagttgacaatagatgtattggctttttttttctggaactctatttcattggtctatatgtctgtccttatggcagtatcatgaggtcttaattactgtagctttgtaagtaag

SEQ ID NO: 163316 - DNA, 168 bp, Homo sapiens
tgggtagaggccctggagtggaattgccgggtcacagggtaacacatgtctaactgctcaaggtgctgccggactgtcttccaaagcagttacagcatttcacattctcacccacaatgcatgagggctcgtttctccacgtcctcatctcctcatcaacacttgtca

SEQ ID NO: 163317 - DNA, 645 bp, Homo sapiens
ggaaaacctaatggttaacatttattaagtaaatgattgtacagcaagccccatgctaaatattttatctataacatcacacttaatactcataacaatcctttgaagtagttattggtgttcccctattttgaaatgaggaattcgaggggtaggacagtataataattgtctaatgtgatattgctagtaacagatcaagcctggactgagacacagtacagtctgattcagccccatgccctgcctaccactacatgaaggtggaatattcggcaactgttactaaacatgatttcagtgattatgtattggccaaaatatgttcacagaatattttgtgggaaaaggcagactaaaaatcaaagggtacacatattctcaattttaaaaagctaccaaaattttcagtccctggataggaagattaagggtaagggattttcttccttctctgcttccttttttcttctacccctcttcttcaccctccccactcctcttcatccctttctttctcctccccttccacccttctttctttatgtattttccaaatatttataatgtgtatatagcagtcttataatatgcaacatattattaaaggtttactttaataacacaattccaatatatgaggaa

SEQ ID NO: 163318 - DNA, 392 bp, Homo sapiens
gaaagaaagaaaagtaagcaaaactaacttcatgaattaatgtatcctggaaggggatgttacattgactctcattactataatatcattgtggatttcagtggttttcctggaatgctgaaaagaagtgctactggaagccccctggcagttaagtaaacatttacttgtggtgaaataattcctgaaagcggcatttattcaataaacatttattgagcaactacacacacacaattgcacacacacacacacacacgtatatgtaaacatatgtttatatactatattgtcacatagaaaatgcttggggatacaacagtaaacaaagccgatcaaaatctctgatctctctttttttttttttttttgagatggagactcactctgtc

SEQ ID NO: 163319 - DNA, 256 bp, Homo sapiens
aaaagtcaaagtgtatctttcccattccatataccgaacttcacttctgacatcagatatgtgggatttttttttccctcatacaccaagcagttctccagcagacaccagccaggtgatcctccaattcatttctgaaactatctagatcccacagattgaaggctccgtcctgcaagatggtccacccacttctgatgccaattgcaaactgtaggttgtgatctgtgcttctgactggctataaatcagggtt

SEQ ID NO: 163320 - DNA, 469 bp, Homo sapiens
gtgagccaccacacccagcctctgagtttcttttatgtgtaaatttgtctttaaatttaggaagtatttggctattattactttaaacatttttctgcctctttctgtccttaccatctggaaatatatacatatatatgtttccaggtacatgtcttatataataagtttatatttattttatgtatattttcaggtcaatctgctgttaagcccatttggtgaatttttttagataattttcagtttcaaatttacacttggttcttttttagagattatgtttctctgctgtgatttactaccttcttagtgagtacaagcatattttccctcagttataatagctgccttaaaatttaattctcatcatctggattatcctagggatggggccattcattgccttttctcttctgtatgggtcacagttccctgtttcattgtatatctactaattgaggatttt

SEQ ID NO: 163321 - DNA, 624 bp, Homo sapiens
caatcagaaattagaaccgtgcggctaggaaagatgagcaaaagatgcttagaaacaagacaagcagaaaacaacctccccagagctatcctgtgtggggaaacctccaaaagctagggaaagacagcgtatgttttgtatggtccaggaggagcaagctcatcatggctgcctgcaaatgaagaaatcatgtttctgtcatagcaaaatggttatgttttggagtgttctgtgaatgagacatgagaggggaaacgccaccacacaagtattccttacattcagttcttcagagaaggcttcagggatcattttcccatctcaaaaagcataaattgccattttataggagcttgagaagaatattctagaagtgattcagagccaggacatttggggatttgtttaggtaaacatgaaaattctatccatctttattcatccatcccagcagtcagccagcatccttacaaactcaaagggcaaagtaaaggtaaagaaataatttagaatatactattatcagtgctgtgataggttaatgtgcaggagagacaataaaggagtgagttctacaagtctggggacagggagtgaggagagatgggtcaggaaagtttttat

SEQ ID NO: 163322 - DNA, 210 bp, Homo sapiens
ggactggttaaaagatttgccacattctatatgtttcaaaggtttttttacagtacgtcttctgtctgtttgaatttgaaaattgatgaaagactttcacatatttatcacattgaaatattttgcaatgggtagttgtcaagcattggttaagcccattataacctcttttttgcaccttacactcatccacaatttcacatccttttt

SEQ ID NO: 163323 - DNA, 140 bp, Homo sapiens
cttatccacccctactgcccaagtctgttgtcctcactcctggaccatttccttctccttcactgcctacattgcctcccaacaaatcctatttcgtttacctccacactgtctccttatccacccctactgcccaagtc

SEQ ID NO: 163324 - DNA, 212 bp, Homo sapiens
gtgtgttcaacaggaaaaggatatggcataactttggctatggtctagccctgaggtttgtttcatatttgttctctgagtctggttctctagtcttctagtcatttctgtaagccaaccaatatgcttccaataaattccttttcttttggttcagctaaccagaattaatttctgtaatttgcaaccaagaatcctaaaatggtacctct

SEQ ID NO: 163325 - DNA, 476 bp, Homo sapiens
atcccaatataagcaattttacttttggagtaaaatccaatgacaatttacattttgatctcattatgtctaggttaggtaaaatgttatactgataccctcatttggatgtaaaacaaataaggcattcttgttctaactagtgaaggcaagataaacaatagatatcttataagaggaaagtcctgttcactgaaccagataagctttagggactcagttctacaagtaagccatagatttcttctctccttgtcatgaacatctaccactcatgttacaaatcaatactaatagaatagcatggtgttcttgccccctttagactacatgaatcattgcaaacaatcagatttgcatttgtaaaagccatggtgtactgtaaaagttaacactggaaaaattaaagaattcaaaagccacatgtaaaagaaatgcttttctagattatacttgaattatcatgattcaatagc

SEQ ID NO: 163326 - DNA, 300 bp, Homo sapiens
  misc_feature (39)..(39): n is a, c, g, or t
  misc_feature (78)..(78): n is a, c, g, or t
ttttggcccccccttctttttttttcccccctttttggnctttttccccccccccctttttgggttttcccccaattngaaaaaccattttaccactcatgttacaaatcaatactaatagaatagcatggtgttcttgccccctttagactacatgaatcattgcaaacaatcagatttgcatttgtaaaagccatggtgtactgtaaaagttaacactggaaaaattaaagaattcaaaagccacatgtaaaagaaatgcttttctagattatacttgaattatcatgattcaatagc

SEQ ID NO: 163327 - DNA, 584 bp, Homo sapiens
gcatcagaatctctaggattgacctaggggctctacatactcaccatgcgctttaggtaaatgttaggatcaggcaaatagagaaatattgccgaggaagaaaatggagaagtaattttggtaatcaaagattaccaaaaactgttatagaaattgtaaacctagaatcaaggtttcagaatggaaaatggctccaaatctgcaatagaactttaaaaaacagtaagaattaatgttttcctaagtgaccagagaactctaccttaaactggattttaaaatagtgtttactgctgttcatcccaaaaacttagtgtaggggtcaccttcctcaggaaactttttctactctgatttagaggcccctcctgcgtttctatagcatcctctgcagactctttcaaagtatttattatcctgcatcataattgtgggttgtattagcctgtacgcttgtggttgtagagaatgtgtctgtcatttccaaaactatcccagtgtctaaacataatatgttttacctagttttttattttgcatatatttgttaaggaaaagaaattaacttttctaatgaactgatt

SEQ ID NO: 163328 - DNA, 415 bp, Homo sapiens
ccctgcttcattgtatctaataaagcatctatttgaggccaacaaagccattttcccctaagtgaaacaaaataacaaaatagccatgaggatacttcttgtagaagaaacattaagtgtttagactgaatgaatttttcctccctgatttaaaaatcacagaaaagaacttagagaaaaacctgaaaaatataatacaagaacatatagaaaaggaaaccaaaatcacctttcattttgctattcaaagattgccacaataaatatttgtagtgtatcttcctagtaggactaaattctaattagatgaggtaggattacttcctttctaaaagatctactgaagataaaactgatttagttctgtttgaaaaattagctttaaagacaagaacataattatgaatgcatactt

SEQ ID NO: 163329 - DNA, 573 bp, Homo sapiens
tctctgaaacacatcaggattgtttttaattacctgttgattgcatttattagctcatcatagagataggcaggggccaaggaaccaagccttcctaatatttcatgggccacagtcagctggaagccacaccgctgtgatacacagcagaacatccctgcccagcatggtgcctggcaccgagcaggcactcaataaacacaagggatggtcatcatccttcaagtgtaccaggcatattgcctcattagtgtagatgtgccatgtttgaatatctatttttatccacaactagggcataaaggggacatcttgggagataaaaagagattagattttaaatattgactacaagcacatttctgaatcctttaggcacttacatatggtggacaaagtctttgcgggtcattgttttgcatctagtcaagtttatattcagtcagcgttctcaagctcatttatgccttgcttctcactagtgtctggaaaatgtctggcagggtcttgagaagggaagtaaaggtgggtccaatatgtagaaaggcacacttagaacaggactatttggat

SEQ ID NO: 163330 - DNA, 507 bp, Homo sapiens
agccgtggtggggtcctgcaggcctcggactcatcctgggatcacgcgaccgacgtgacagccgacactgttccatgaagcacggaggagcctcagtgggtgatggcagccagtgctggacttgatctcagacaactttgcaggctaagctcccacacaccatgctccttgtcccgcagttcagaaagcagaagataggcaactagatgaccactttacagatatagaaactgaggcacagaaagaagaaatggcaaatttgcggtcgcctagcaaattactgggaagactagaaatagtgtttcttttcctgaacacacacgcaatcactggctaattgcttggtgctgcagatgcaaagttaaataaatcacaataggaacccccaggactccctatctccagttagtaaaaagaataggggctttggaaacggaaagacccgaatacaaattctgtatcagctgcttcctggctacatcactcagaggacatcgcttaactttt

SEQ ID NO: 163331 - DNA, 537 bp, Homo sapiens
agactttaaaccaacaaagataaaaaaagacaaaaaagggtaatgacataatggcaaagggttcaattcaacaagtagtgctaactatcctaaatatacgcgcacttaacacaggagcaccctgttcaaacaaattcttagaaacctacaaagagacttagactcacacacaataataatgagagacttcaacaccctactgacagtattagacacatcacttaggcagaaaattagcaaagatattcaggaccttaactcagcactggatcaaatggacctgatagatgtttacagaactctccaccaaaaagcaacagaatatacattcttctcatcaccccatggcacatattctgaaactgtttcatggaggaaactgtttcatggagaggaagccacagggctgacaggaaaccagaccttaacctccctctgcacctgccctgaggctggctcttgtgctcagtgggtcctgagcgtccccaggtggtcctgttccctcttcagggaggcttgtttctgggctcatactga

SEQ ID NO: 163332 - DNA, 791 bp, Homo sapiens
gcctcctgggttcaagcgatcctcctgcctcagcctgtagagtagctgggattacaggcatgagccactgcacccagccattaagggtgaattttatagaaaataacatctataagcaataagcgtaatgcctgatacagtataagcactcaataagtattaactgttattgttaccctttgcaccaagcactgtatttgctaggtattggggaagtaatattgagtaagacattattcctgttcactgtctagtgatacatgtgagatggtatgtcctagagatatgaataaaacgtaatgtaagaagtcatataatgcacttatgacaaaggagcctcccataagttttggtgcttttggaagtgaaactccggagcttttccagtgtggctgtgttcgttctcagacttggcttcacattagaaatagtcattaaaaataagtcacacttgaaaaaaaaattagcagtgggctgctgccaggacatggtttttatttttaactttccccaggcaattctaatgtgcagccaggattgagaactaatgctttagatattttctcgttttctttatctttggcatttttaaggattatgtagtatcatagggtgattcttttctttttttattctatttttcaaaactaacataatagcatctgtacagagttttagactttacaaaatgcttttatgatctcattaaagccttacagtaatccttttagaaaagcattcctatcaccattcccattttgcagaaaagatgactgaggctcagagaagca

SEQ ID NO: 163333 - DNA, 356 bp, Homo sapiens
aaattaaggtttgcttgaaagagatactcttatcttttttacgtctagtaaggggtattgaaatacagcagatatggagaacaacatcgacttggaacagaagaatgacccctaacaacttagagcttagacaaatttgagagtttacaaagactgccagacaggatgttatgttagaaatacatttaagcgatattaaaataagtattcaaatacaaaattttgaagacaggaaacttcataatattcatgttaaattctcaggatcctctggaccggaaatcattgtataatgcctaagatatcgtggcaaacaaaattttacaagcaaataaaatgtactttagttctcacaa

SEQ ID NO: 163334 - DNA, 689 bp, Homo sapiens
tatttcactgatagtatctttattattttagagaacattaagaaaattatggagcctttcacatgttcactcctaatctcagagcacagctatcccatatttcccccatgaatttttaagggaaattctcctacgtgggttttcaggaccctaatccttggaggttaagggaaaagtcctatacagcaaaatgaaaattgaattctaatcaaggcttgaccacagatcagctctgtgacctcacaaatatttacatgactaggaccccatcccattatgaataatgaaaatggatagatgtcttcagaagtaccttctaactctactcttctgcaatcccgacaagatagaaagtagctttggtttcagagaatctagtaatgatggtgacctgtgtaagacccgataacacttaaatctgccacaaccacactcataagggcaacaacaaaacttagttcaagagtaaatatgcaacacagtcaagaacacacagggagagctctgctacatgaaatgctgcagacacaaagtgcagataaaaatggacagagtgtggttattttgtgtgtagcttatgaaatcacaatattttagtaacatctcatacagcattccaaggacaagtggcagtgatgagaacaaacctgaagtaaggaacctccaaaccttttaagcttaggatctgt

SEQ ID NO: 163335 - DNA, 500 bp, Homo sapiens
tctaattgctctagctaggacttccagtattatgttcagtaagagtggtgaaagtaggcacccttgtcttatttgtgatcactgtttcatacattcagtatgatgtcaactgtgggtttgtaatatatggcctttattgtgttgcagtacataccttctatatctaatttgttaagagtttgtatcatgaagggatgttaaatttatcaactgctttttctaaatctcttgaaatggtttttgtctttttgttaatgtggtgtgttgcatttattgatttgtgtatgttgaactatccttgcatccctgggatgaatccacttgatcatagtggatgatatttttaattgctgttgaatttggtttgcaaataccttgttgagaatttttgcatgtgcattcatcagggatactgacctgcagtttactttttttgcagtgtttttgtctggtttttgaatcagggtaatgctgccttcatttcctttcttctaccaatt

SEQ ID NO: 163336 - DNA, 217 bp, Homo sapiens
aacaaaacaaaacaaaagtacatagccgtgcttttcttcatttcatctgattctcacgccagctctaaggaaacagcttcactgaagtgaggaaactcttcttcagtcactgacttacaaaatggtagtgcagggattttcccagaccaccaagaaggcatccaagaagtaagcaaaaaagattacgacgtcgttcctataccgtggcagtggctca

SEQ ID NO: 163337 - DNA, 112 bp, Homo sapiens
acccttctctttgtgttgcttgcatagaatccaagctttgcataggagaaagtcagccatggacagaacccacacatggtagggcagaggtgggctaaggtaggctaaggca

SEQ ID NO: 163338 - DNA, 527 bp, Homo sapiens
aatatgaatgtactaatacccctgaaccgtacactcaaagatggttacgatggtcaattttatgttatctgcattgcaccacgataaaaaaagcctgtgctggacccctactgtgagggctggaaagagtcatatcacactgttaatgtcctttacgcgtgatcagtgtgccgggcgccattctgagcatgctacatgcagcaccttgtgtgttccccacagtgccctgtaagttgtgtgctctggttgtgcccattcacagatggccctctgcctggctctgtgtcctaggaggctgacctccacatagtgcgtcacccagctccgctgctctcttggctgactctttgagccaacacaaggcacgagcaggaggtgggaaggacggaggagaggccagggtattcattcctgctgctcattcggttccattaccactactacacacacacacacacacacacacacacacaaaagagacatactctttctagcttcaacttggatctactgctactgccagcatt

SEQ ID NO: 163339 - DNA, 832 bp, Homo sapiens
cttccaagggcctcagaggcagcattaccacaggcattaaagatggggatggggaaagaaggcccagagggaaagggaaccacatgcttacctgctaatcactgccctgcagctgaaacactgcagagctggctgctctgggataggagaggaaggcctcatttaatcaggagaagaaagagaaccaggggcctctgagatggcctgcaaggcatcacggtctgtgaactggtctgtgaactgcgggcctgcctggaaatgcattgtcagagtagagtgatgctttctttgtaaatcccttgtcttccctgattcctttttcctgactgaatcaggccaagatgctcacccagaagagcacagcatcaccctgtctttcaatccccaaagtagcccttacccctagacagcaacatcatctgttacaattgacagcatgaaggaaggcataacccctgcaaagtgactgccctacaactcaatttgattttgaatccgcaagtgcaagtctcattcctggtaactaatagtaacagaatctgctgatgtattctaccgcatcccagggagactcatgtagccatgaagactgaagaggattaagttaaccttccattttatagctgcaaattactgggttgatgtcaggtagggtgaggagtatgttccggttatagctggtagcaagatggctgcatgcatcatgaggctttggcctaaaaagcttgtcattatataaaaaagctatagagagcagagaaaatgtcatttccaatttagaagatcataatcgatttttaacacattggtccttaggtgatacagaattcaa

SEQ ID NO: 163340 - DNA, 476 bp, Homo sapiens
catggacaaggaaattgtattgggaagagacagaaaaacttgggggacttgactcctgatttacctatctctttcctagtcaggcaaatttcactgtctttcactactgtcaggcaaatctgatgtctggctcccttaagaattacacatttttaccaccaagccttgacaggggtataggaaaagaggaacagcactaggttagggctcagtaggcacagaataaaaaaaaaaatcccaactccattacttcttagtttctggaccttaagcaagttactaaagcctccctgagcatgcttccctatctataaaatgggaatgaaaatccttgccctggaccacctcaatgagataatggacaagacactttgccaaatacatcttgtagtgcagaaataccaagaagcctcatcatcactgcactcttatctgggtcctcaagcttccattcttctcttgccatgaattatgcc

SEQ ID NO: 163341 - DNA, 336 bp, Homo sapiens
aaaattaacctcacatggtggtggggcctgtagtcccagctacttgggaggctgaggcagaagaatggcatgaacccgggaggcagagcttgcagtgaaccgagatcacaccactgcactccagcctgggcaatacagcaaagctccatctcaaaaaaaaaaaaaaaaaaatccttggaggtttagccctgttagtcattcacacttcagtgggaattacacctatcctgctagaaactataacttcttaccctttttcactgatatataggagacacttaaacactccattttgcttggtaatcaaactatatgaggtaagagcctggtctcaat

SEQ ID NO: 163342 - DNA, 283 bp, Homo sapiens
tacattggctgacaggcaacacaggcctgtgatcgctaagaaaagggacacaaagtgagccctacgagtgtaccagtttactgcctacagacagttcctggatgcagtacagggagggggaatggatctcaccgagtcgaggtgactgagattagacatccaggagggcaaagtgactagaatttgtgggacagagaactgaagatagaacactctggagttctatcgacaggcctccctagagtctttgactaagcactggtctgcacatgcatgataggaa

SEQ ID NO: 163343 - DNA, 231 bp, Homo sapiens
tatgcaacgataaggataaatcacaaacacaatgtcaagccaaagacaccagaaatgaaagaactcataccgcttggttccattttcataaagtacaaaaataggcaacacaaatctctgttgttggacgtggggctagcagctacctttggggtgagggagtgactacaaggagacccaaggggcttctgagagagtgttatcatctgtgttgaagtttgcgtgatggtt

SEQ ID NO: 163344 - DNA, 532 bp, Homo sapiens
agtttgcctccatggcgataacgattacctgggaagccttgccctgtgctaatgcgcatctttagccgcagaatgtgcagagctttcatcagcttcccaaaggaatctggggccccaacaaggtcctgaaccccattccaagcggcagctcagttgctggtgaggaatgtgccaagcagggttcttagctttgttctctgtcatctccttcctcggagcacccacatatctgtgtcgcttcgggatagcaatggcgcttccgacctgtaactcacagctcccccagggccctccctcacgcagctggccgctgtgtgctcagagatccccacagaacaaagcctccctgaccagagtgtcctggggtctccacttctgcttcccaggactcaggggcagcgtggcataaggcctcagatgagtatatgtggcctcaacacccaaggaagacagacagggccttgaacggcctcaccatacatgggatccctggacctgtctcaggggccatggagcctgctaatttcaaagg

SEQ ID NO: 163345 - DNA, 380 bp, Homo sapiens
attgtaagcctcctgaggccctcatgagaagctaagtagatgttggtgccatgcttgtacagtttgcagaaccatgagccaaaatatacctcttttccttataaattacccagtctcaggtattccttgatagtgacacaaacagattcatacaatgcaacaacatgaattaatcttacagaccttatgctgagtgaaagaagctagacacaaaagaatatacagggcacagttccactcaaacgaagcactagaacaggcaaaattcatctgcagagatagaagtcagaaagcctttgcccctagggggcgacactgacaaaagggacataagagaactttctgggttgatggaaacgttctaaataaatcctgtttaa

SEQ ID NO: 163346 - DNA, 123 bp, Homo sapiens
acacataagagagaagatatcatcttgaccagtcatgttagacatgtcactagtttcagtagtgtaaaagaccatcggatgatgagaaccaaaacatagagctatgaaaaacaaacagatgtg

SEQ ID NO: 163347 - DNA, 160 bp, Homo sapiens
tgctgggattataggcgcaagccaccacgcctgcctgagacttagcattttgaaagacaagataacgtgctgagccagacagctcagaatcctccgcatctattttattattggcttttggaaaaggcactatggttgtatgtatggaaaggctgacttg

SEQ ID NO: 163348 - DNA, 632 bp, Homo sapiens
ccagcacttggggtcacacttgcatcgtggtctgccgccttttctcagggatttctggctcacttcccatattcccttacgggtgtgtccccttataagatgtcgcagactttaagctcatcttggcatctgctccttgaaggacttggactaaaaattatttccatctgcatatcaataactcttattccaacctgtaaaatccttctctttatccaacttctgccacccccacagaatctattttacttgtgtgtgtagtatctctttgagttaacagatatttgttctattaagctactaaattttgaggtagtttgtgacacagcacttgataactattaaggctttcttaagtttccattattccatggatattatctacatatcttttaatcccttgcattttaataacattagctatacttgctgtttccaactctttcctcctatttttgaacattttaaattttgtctttctctgtccttccttccttctttcctcctttcctccctcagagctttctccctccctccatttttttcataaactccaagtgtttaggccaaaaggaagcattatttgaactttatgctaaaagtataatgccgtaatttataatataaaagta

SEQ ID NO: 163349 - DNA, 671 bp, Homo sapiens
tctatcagaaggcgtatttgttcaccatcttagtagttcttaaaggggcagaaccactgcccagaggacattttggaaattttgttgtcacaatgactggaggtcactgctggtatttagtggcggaggtcaaggacctctaaacattctgcaatgtgtgggacagtcccacaaaaggaagaaattgtcttcaatatctaaaggtcccaccagacactcgggtcagaaatttgtctataattttctgagccttgagctcataaacacaaagtatttttgcccagtgttgacagtgcatgggcaatgcattcctgaaatagtaactttctaaggaaaggtcactatttttgaagagctgagggctgcagcaaggttgtctgtgatattaagtggcaatgccacccacctgcatcagcttgccaacctgtgtcctctgggggaaggtgggagaaagacacagggtcattccctgtatcattgcaacttcctgcaaatctgtaattatttcaaaattaaaagaaaaaatagagatgttgagtcatatggggctgagaaccatcaccatgaacttatcagctttaaggtaaggataaatgtcaccactccaccccaccaaggccaaagcaatcttcatctcatttacagcccatttctaacccatcacctacaaa

SEQ ID NO: 163350 - DNA, 356 bp, Homo sapiens
tagaccagggaaacatctagcatttttcttcaatgggactgagctgcgaaattcaaagctagaaggatatccaaggccgtgggtcacattgggcctggtgctgacctaactacactgcacagcactagagatttcagaacaggccccagctcaggatgtaacggttcccagctttgatgtgtttgatgcctcattataatttatctaataagccaaatgaaaagtttccttcctgatttctgcatgactggcttcagcttaacaagccatttggaacagttttgcaggcatacatctttacacaaagggatgtcagtaaacgcttagttccatcagccaattgcatgacccactac

SEQ ID NO: 163351 - DNA, 365 bp, Homo sapiens
ggggaaatctctatatgacattattgggataattggcaaaattttataaaggtctgtggattagatgaacagtactataacaatgtaaaatttacagcttttgataactgtgttttttttgtttttttttttcctcaccaaaggatttaatggggggccacctgtggcacaggttagaggacccgaattgctgtgtttgtggtggggggggacccacaaaccccggccctgccctcttgcttacataggctccccgcctaaaagcgcagccagaacatgccgctacggatccggttgtagtctgggagctgctcaatggggccatatccagccactgcggggcccgggccatagctgttcccggg

SEQ ID NO: 163352 - DNA, 303 bp, Homo sapiens
ctcgtgcctcagcctcccgagtagctgggacaacaggcgtgtgccaccacacccagctaatttttgtatttttagtagagacagggtttctccatgttggccaggctggtcttgaactcctggcctcaagcgatctgcccgcctcagcttcccaaagtgttagaattacaggcgtgagccattgcacctggccatggagacattttggaagttaccacttgtggcgaggggatactgcaaatggtaggtggaggccaggaatgccactcagtgtcccacagtgcacagcacggcccccacagc

SEQ ID NO: 163353 - DNA, 184 bp, Homo sapiens
ttctgagttaggacataatcactcagggtcctgacccactggtgaatggattgagagaggtagtgtggctgcacttgcatcaggagcaaacctgacatgactctaagctcagctgcttttctccttcttctcagaaaagctcagctgcagccaggtgcaggggctcatagctataatcccagca

SEQ ID NO: 163354 - DNA, 310 bp, Homo sapiens
gtttttgacatgcataaaatcttggcccaccatgagaaaaaaaatactttgttgatgtgtgtgtttgttttaaccagtaacttccactttctgtctttctaaaccattagaatgaaaaacatttgttctcacccttcctatgtttttgtttgtgtttgtttgtggagatggagttttacttttattgcccaggctggagtgcaatggcatgatctcggctcaccgcaacctctgcctcccgggctcaagcgattctcctgcctcagcctcccgagtagctgagattacagtcatgcaccaccatgcccgg

SEQ ID NO: 163355 - DNA, 289 bp, Homo sapiens
ggcagtgccctaagcaaggtgatccttcaatcagagggggtgcagggagacagtcaacagacttcctcttcctcagttgaagacaattggaaacaagattataaggaagcactttatccctatgaggctaacaaacaaaataaacaaacaaaaaactgtggtctttagggttagggatttttcaataaaaagatcagctctgtaaaacgtgttaggaacaaatcttctgttttactaaatgttatcaatgcaatcataggccaatcactccacagaaacattttatgta

SEQ ID NO: 163356 - DNA, 344 bp, Homo sapiens
gatggctgagaagggggagagtaggaaaatgtccgcagagaccctgcaagtgtatcctacccctagaaagggtggcgagggcctgaagagagaatgcagcaatagggatgcaaggggacaggaggggatggttgcaaagagattgccgcccaactgccttaatgtaatgcctgtttgggagcaaaggatgaaggagcttagatgctgtcattcaccaaaataccacatgataagttccgtttgggacatgatgcatttgaaagccttcatgcattgtgccctcctctggggaaagcagcagatgggactctgtaggaccaacagcctgcctgagcacccatgag

SEQ ID NO: 163357 - DNA, 284 bp, Homo sapiens
gggaaatccgtttaacccaggagacagaggttgcagtgagccaagattgcaccactgcactccagcctgggtaacaaagtgagattctgtctcaaaaaaaattagtttcagagttccaaatattaccactcctgtctcaaattaggtttaaggcactcctgtgaacaggcagattctataggtataaattaagatgtcatttccctagagaggctaagaaataaatacattcaacaaatatttgatgaattaaaggaatgagatgaagatatctggagaaaacg

SEQ ID NO: 163358 - DNA, 448 bp, Homo sapiens
cagcagggggttaaaggttagatttcagaaagaacttcctaaaggcaaggttgggaatgattgccaaactgtttccaagttaagcaggaagaaggtgggacttccttctctggagattttttaagaaaatatgagcagcttgctttctgtgattattgggaggcattcctaactagaggctggaaaggcccagtggtctgattagagacctctcagcatcttacaccagggcaggagcttacttgtctctcctcttcatttcctgccatatgctccctgcgtctgcagcctgcagtgggaaaggattctgggtccaagtgggcccttttctggtgaggctcaggagaggctgctgggccatggtagggacttagagtttgattctgagtgtgctgggaggccctcaggggatgtgatttggtttaccttttctaaatgctctctctgg

SEQ ID NO: 163359 - DNA, 382 bp, Homo sapiens
agactggaaattaagtgaaaagggaaaggttaggatgtaacttcagttttacagtgacttttaatgtgctttgtatctcaccctttgagggaaaggggtggtcacatccaactttaaacaacaaagatgaaataaatctacaaccaggtttgttacaaatgtaactaagagctctgtattttgaagatgctcaacagatgtgagttgaaccaagaacgtcatacttggaattgtcgttagttttgtttgttatgttatgactatttgagccatgtagtggctcatttaaaaggggctgctccgtggggattgtgcatatacaccatttgttgtagtggttgtggcaactagtgtaaatagatctgtatttttgttttctata

SEQ ID NO: 163360 - DNA, 264 bp, Homo sapiens
gctgaagagtatttgatttaaaataaaatccatacacttaaagcactatatatagccaagattaaatttccatgtttgctatagatctgttctcattcttgggctttcatccaaatgttttgttattgttggcaagaaagcagattctgaatccaccctcagtgatttgttttgttcagtcttggcttttggaacaaaataataaccacttattattttgccaaaaaatttatttctactaatatatttcttgacaattgcaca

SEQ ID NO: 163361 - DNA, 122 bp, Homo sapiens
gcctctctatctgacatctcgtctccgctggcagtgagacgtcctttctccccaagcttgtccatgggtgaaaggatcaaaggacattgcccgccaaaaggaagagtgaccagactgccccc

SEQ ID NO: 163362 - DNA, 441 bp, Homo sapiens
tgcagcttttaagaattccagaagctgggaagattacttagtgttaggagacaggtaatgcaaagggctgaagtgagtaatccaggaggggctgaggacagtaggggccctcctctatgactgagggacagaaaagcaacagggttaaacacaggtcctggtgccagggagagctgcagcacagccctgggtctaccatcacacatgccatgacctttggcaagttacttaacctccatctgccttagtctcctaatctgtaaaatgggaacaatagtaatactgcgtggggtcgttgtgaagactaaagctgctgtgagtgtacctgcacatagtgagcgctcagtaagtgttcggtgggtggcatacgttcttgatttgctcagactctctgcctcttgcctttattccttcctgttgggacgtgagagtctgctgatg

SEQ ID NO: 163363 - DNA, 672 bp, Homo sapiens
ttggatatagtgaggagttaatgtttggagatgcggaaaagtaattgaaaatttaagatgttactgcaaactgctgaagagttagggcggggtagcagggtggaggatttgagacccatacattaggaaaatgcaggaggaagccagtccctatagacagtgtgaaaaaatttagagcagcagcaattagactgaagtgtgtttagtgctataagaaactacctaaggacaccaaaatcaaactcaaattgaggcaggaaaatagggtctggacgcagggaacataaggcctattcaaacttcagctatgaaaggaaatacctactccatagggcgtaagccaagtaaatgattttataaccttacttcatcctctccttttacatagagtataccccaagtaaccaatggaatcctccagggggtatttaaactcccaaaaattctgtaacggggcctttgagcccctgtgctcagccccgcttgcacactgtggagtgttaaatcccttcattccttccttgctttgtgcgttttgtccaattctttgttcaagacgccaagaacctggaccccctccaccgttaacaaaatgcaattcttcttaaaactttctggtaccaaaaccacaaatcatgactgggcgtttctcactcatgaatcgctgtttgc

SEQ ID NO: 163364 - DNA, 421 bp, Homo sapiens
tgttcttacttaccccaaaagcccagacttgaataccctgttgtcctcagtggcgcggctgagaccaggctggagcttttcaacaagatgtaactcaagtggggaataacatgcaagtaacccttaaggtgactgccgcaccctgtggcccacacagagaggctctctgcccagccccacttgtctgcaaaggatatcctccagcctgtctagagtccacaaggtccaggctggagagaaagaggccaaggagccagatgtctctctctcacccacgacctactttctgagatcttacttccatactgaagacaggcctccttcccaggggataccagaagtcagagttcctttcagtgggtcttgccttattatattcagtaatgtggcccagcaaataaatatgtcaattcaacaataa

SEQ ID NO: 163365 - DNA, 401 bp, Homo sapiens
tacattgttaatgactgcattattacattgtatgggcagtcaatcatttatttaaccaatcctctgttgttgaacattgaggatatcttttgaatgtgttatctctatataacaaataatgtgcatatgaatgtgtccgtgtaaaggagaacttgtagttcattgaatgtgtctaggtcatgattagaataggcagagttgtgctgtatcagggaaaataagggtactgctattgataagagcccattttaggtataaagataactgtaacagctgggcacggtggtccacacctataatcctagcacttcgggaggctgaggtgggtggattgcctgaactcaggagttcgagaccagcctgggcaacatggtgaaaccccatctgtactaaaatacaaa

SEQ ID NO: 163366 - DNA, 499 bp, Homo sapiens
aaataaatagagccttaccacgtgatctcaccccctgtgcctgtttacttatctatgaaatggagataacttcctaaccccacaggggtgccaggaaaatgaatgcttgtaaatcataatatttaacattcatgtgacttttgcccaaagcattttgcttaataatttaatctactcactattccactgagaaagatagtctctatcactgagatgaagtgaaaggcataaagtgtcaaagggactagctccaggtcacacagcaggtcagacaaagctaaaataatggtgccataattatttgactattctgcctttggttcttcagtagtgtttctagaacactgatgctattcatatttttattatggtttgagttttcatctgtacttgcttaaaataacaagttactttttttaaagttacttactacagatctataaagcagtttattttctagtgcctaataatctttgactgataatttctcaataaatag

SEQ ID NO: 163367 - DNA, 264 bp, Homo sapiens
taatatttggaagcgcttagcctgcttaaatcttgattttatcatttctattagagaagttttaacttaaatgctctaaggtgggggtgtccaagggagaaaatacagtcatgggttcttagtttctgtttctggttgggccagaaaagctccttcctcatccctcttttccacttatcaacagagacagaagctaaaaaccatggcttctggctgctaaagcctaaaataaaacaaaacagaacaaactcatcaacaataaca

SEQ ID NO: 163368 - DNA, 305 bp, Homo sapiens
tcatggaaagctctttctgaatctttacttaagcgccgtttgttagcatttccaaatataaagtccaaaatggataaaatctgtaaaatcacaaaattaagactcttcaaaactaaaagtaattagtcaaggagaataaacaatatggaatttgtaaccccaactaataatctcaggaaagaggatgtattttctggccttacagccatttaggtaacagccatttaggtaacagccatttaggtaacagccatttaggtaacagccatttaggtaacagccatttaggtaacagccatttagta

SEQ ID NO: 163369 - DNA, 205 bp, Homo sapiens
gggtactatgtttccttttggtgtgatgaaaatattccagaaataaatggtggttatggtggtacaacattgtgaacgtactaaagtcattgaattctatactttaaaatggcttaattgtgaatttcatgtgatgtgtattttaccataattttttttttaggtagaatctcttgaaagttattgcaaatattccagttctgcc

SEQ ID NO: 163370 - DNA, 491 bp, Homo sapiens
caactctggaggctcaaggcaaggtccccatttccagacacgcacactgaagagaggctggaaattcctctcccaggctgttgtctgttcccactggctggccaggcgctcacacccttgccttggaattctaagcgattgttttctgatcccagcaaaaaaggagatggcacaggccacattcccaacagctgccctggcccctggcctgcccaggatgaaaacaagtgtcccaggcagaaagaaggagggtagagatgagtgaagggctgatggggctcgccagcactgcagcgggaggtgagagcaggggtggagcgagcagcgcaggtgccaccgccccccaagaaaggctgagacctcctgcctccctccagagggagctacaattccagatgtggtctgagaacagatgcgagtaccagggtcctctctgtccaatccctgcagcccccggctcccatggcttctcggacacctgagcgccacct

SEQ ID NO: 163371 - DNA, 627 bp, Homo sapiens
gattgtgacaactacatgggcatcaggccactcctcttcctccctactgaccaagaccttagagattaaacttttagtgtttttgaggatagtttagccactaagccaaggttcagattgctgaggaacaaatctatcctcaccatatcaacttccaggttaagtttttccatttttattaacattaccttcttttcacttctgtgactcctcagagattttgcaccagtgaactctggctagcatagaatagacatgtcatgatgccttagcttatgtagacacaacatacaaataaatgttattagaatggaatcatttacaagttcttcttagaggatgtgatgtatgatttttttggtagaatttctaattgaagtgtagccttttaaagtatattttaaaattaggctagtcattttgagatggtttcattgcagcttctttggaatcatttttagagtagaaatgcattagtataatttttatgtcacaatcaccacacttcattatgggcataacaacagcaatgcttgttttaatatattgtaaccagagtttagaaacatgtaataccacgaaaattcattactcctaatataatttaattacaaaattgttccttgg

SEQ ID NO: 163372 - DNA, 355 bp, Homo sapiens
ctagagatgacattttaatcctttcactgagtaagtctgtttcatattgtttaatagtctggactctgatttctttttgaagcttgttaattgatcttttagatgaattgtttgtggtaggttatataactgtctcctggttatatgatgaactgaacatttattaccatgccccttctgggggatgtgctcaactttttaggtaattgtattagtctcctctcacattgctataaagaactgagactgggtaatttttgaagaaaagaaatttaattgactcacagttctgcattgctggggaggcctcaggaaacttacagtcatggcacccaccaggcccctcccctgacat

SEQ ID NO: 163373 - DNA, 526 bp, Homo sapiens
ccacagggtaaattaaggggtaagtattaatactgggatttgaacattggcaatgtagatcttctgtcccaatcttaatcactgaagtgcagcattcttctagacatatagtttgcaataaaatgcactgttatgatttttgttgtcatccctatcatcaactctattagtgggttgttaaatggatttaaggaaatgtaaaacactgcaatattgactagcacataaccagtgctatacacactgattccttcttttgtataaggttgcatattatctgtttggctctattaaaactatcaaactcaaaaatatttgaaataaataacagagcagattattctttatagctgcatgaagcaattaagccttctacaacaggcattcatttattgctaatttttactttccctcgaataactcatatttattttcaaaagttactgtgaatattaagttagtgcctgaaagtcttcaagcagtttgttttcctctgatatctgggcagaggtggcccctgtagctg

SEQ ID NO: 163374 - DNA, 499 bp, Homo sapiens
tgctaacagaatcaacaaatatgacaattaattaggaaatgatttgttcagagtctatcttccctgataaactccatgaagtgcccatggctaggcctggcacacagtagtactcaattgtctttcaaataaacagccagagatggcacactgtatctaatatctccacatatctaaaatctatccatcttttaagacctactccaaaaagcatgaattttctataatccaaaatccaccacataatcttcccagttcctctctatcctcctgcctgcccagacaagaataatttctctttctttgaagtcccaaagcaatttatctatacctcttcttcagcacttctcaatttctttactgcattattgttatctaggcatatgatttatctcatctgttaagactatctgctcactaactgtatactacacatttttgtgtattctatagaaacttgcataattaagtactcaatgtttgatgaataaatggataa

SEQ ID NO: 163375 - DNA, 391 bp, Homo sapiens
tacaaactcacctgaaagggactttttttagacagagcttcatgacctgttcccaccccagttcatcctcacctcttttacgccaaaaggtctgcagggtgggttcactgtgtcttttctgccattttggggtggagagggtaatgtgatgaagccaataattcaggacttactcctttttgtgttgtgtttctttgcccttgcacgagagtatgaaatagcttccaggagctccagctgtaagcttggaagagtctgtatgattgtaatcacatgatgacaacactcagaatctaaactggacttctgtcatattctcaccactcaatttgttttttagcagtttaatgggtacattttagcgtcttgcattttgtgtggaattaattcc

SEQ ID NO: 163376 - DNA, 482 bp, Homo sapiens
cgcgaaaggcgcggcggtcccgcgggcgcccggcgtgggctagagaggccggccctggcctggctcaggtcgccctcgccccgctttcatcttgccccagtcgccctttacaattcccacaccgaaggcaaagcaagcaaggaaagaagccggcgcctccccaagcggaccctcccttccgcgcagcctcggccactcttccagagcgccccggtgcgtactgcggcgggcgcagggaatcgaattaaacgtctctgggcggttattgtctttctctaattgctccaacaatggcctctattaaaatggagacacccaattaaaggccccgccgggccgctctcggctgccggcaaagctctggcccccggcctgcgacgtgcagaccgcggggccgcggacccggctggtgcggggtactggcgccggcctcgacacctttggcctccacttcctccccagactcacagcgacagcggccg

SEQ ID NO: 163377 - DNA, 606 bp, Homo sapiens
gtggagaggggattggagagcaagccaagagagatgatagacagcacagttaggaggctttcccaccatgctggtgaagagggaaggtcctgagccacagtcgcaggagggtgatggagacatacatagagtcaggaatcacagaagcggtggggactggttggatgtgggtgattgtcagaggcaggagtcagggatgatgccaaaaaactagatgagtggccgatggttcattgaaatatggaattcaaaagagtaagaacgggttttgggtgcagtagaaaatggattcggctttgcgcatgttggttctaagaatacctgtgggctatctggatggaatgcccaacaaatacttagatttatgggtttggaacccaggagatagatctcagtaaatgataaagagttgagagtcattggcctgtagattcattcatctactcattcagtaaatattcacttactaacgtgctttgtctcaggcattaagtatacagtggtaaattaaaacattattttagttttcacaaatatcacagtctagactgctagttgatgacatggaggtagataaaataacttaggaaatagatacaccccccc

SEQ ID NO: 163378 - DNA, 385 bp, Homo sapiens
tctcaaactcctgacctcaagtgatctgcccacctcggcctcccaaagtgctgggattacaggcgtgaatcaccaagccggccccatatgtgttttttattatgtattatagtgctctttcagcttttcttcccaagttttctaaacaccaatggggaatataatttcgccccagaaggttttgagagtaaaggcaaggtagccttccttaaatgaggcacctttgggtccccttttatctatttaatgtaaaaatggatttcccccaaagttttcagggaaaatcaatattccatgaagatatactgtatatatccagtggctatatcttctgaagtagaattgcttatgtaggggtaaaattcctatgaaaaataccttaaat

SEQ ID NO: 163379 - DNA, 566 bp, Homo sapiens
caagtggctatatgactaagtgggaaataaacagcattggtgtatgtaacttctaggacaggttctgaaggtgaggaggcatgctctttttctttctgctggctagaatgcagatatgatatctggaagggaagcagtcatcatggactgagttagaaaccttgtgttgaaaatggccaaaaaaaccttgaagggacctgggtttttttttttttggagatggagtcttgctctgtcacccaggctggagtgcggtggcgtgatctcggctcactgcaacctccgcctcccaggttcacgccattctcctgcttcagcctcccgagtagctaggactacaggtgcctgctaccatgcctgggtaattttttggtattttaagtagagatggggtttcaccatgttagccaggatggtctcgaactcctgacctcatgatccgcccgtcttggcctcccaaagtgctaggattataggcgtgagccactgtgtccagcctgtgtgttgctattttaagtaagatgatctcagaagaacctcttaagtcctaccaccctccactctgc

SEQ ID NO: 163380 - DNA, 122 bp, Homo sapiens
ggcacgagttctttgacaactatttaatttcaacatcagaaagaattaatctcgcttgaatagcatacatagctaaatttaataaattacttcattctgagcagctctataaaataatcgtg

SEQ ID NO: 163381 - DNA, 388 bp, Homo sapiens
tactttaaaagaaaaaactagtgtaccttttctgacactttatatgctgtattttaaagctttgatagtcactttgatcccagaataaggtaaaaattagtttatcctcaaatactgtgacctgcctctcccttttcattgatcctaagcacagttctagtcaaatccttcgaacactgagatctgacctgcccattttgcaggaaaacattatcttccctcctgtcccgtggtaccctggggcttcactcctcccttaggccaaagacctatctccacattggtgtcattgacagccactcctgtggggtcccatgcatgcttacctgcagctgcagctgacgcggccccgcccaggcacttccagaggggttccatcctgggccac

SEQ ID NO: 163382 - DNA, 164 bp, Homo sapiens
gtgagttagagggtgtgggcgtggtggcggggtgctggccagaagcataacgtggcaccaggaaaatgaccggcaacaaatgtaaaaggactaatttaaatttctagtcctaatacttgtagaattgacttattattgagaattgacttattatttgagtattg

SEQ ID NO: 163383 - DNA, 107 bp, Homo sapiens
ccctacggacagcacgcgacggacggccttgcgggactccctgcagcagccaacacaccccagccagcccgtgcctattctgtgaactgaccacttcaggccactca

SEQ ID NO: 163384 - DNA, 358 bp, Homo sapiens
aaaaatgtggaagctttggtccaaaagtgaagttagtctaaagccaactaaatgcttttaaaagtgataattaccatgcactaaccacatcctgcatgcctgcttctccgccgaccgtatttcaactttggttcatgcaggtcccaggttctgtgatcgtactcattttgtagaggaggaagttgggtcttagggaggttaatttgtcttctttgcatagttacaaagtgtgggacatggaatcaaacccaggccagcggacgttggtgaatagactgttcatttaatttccttatgactctacatgtggctgctctgttttaggttcataatttcatagacttttctttacaaatgt

SEQ ID NO: 163385 - DNA, 689 bp, Homo sapiens
gcattatctggtgggcggccttatttacacacatatatataattgattccatattcctctcagacctacaaacagtacccatgtttgtttttaataaccagaattatttcagcttaaaaaaaggtgtagatttacatagacagtctgatgagtgcctcagattgttccattagtaacacagaggagaaacaatcttaagaaaaacattttgaatttgtgtgtggaggtggagagaggattgggttagtgaaatcagaaagcttccaagtaatgattattacatttaataataattagattagcgttccacagggactgttttctggaaattttggtaggacagtcactgagtaacacacacactcagagcaacctaggtttcaggccattgggtgggacatggcctatttgctttgttttggtcgcgtttaaagttaatccaaaatcaatttctttttcaagattaaaatgtcactactctgtcttccacttcaggcttctgcaaactttttctatgaagggtcatgtagtaactgtttagcacaaaatagacgtacacataaacaagtgagtgtgttgtgtcccaataaaatgttatttatggcattgaagtttgaatttcatataattttcacttgtcaagaaataatattcttcttttgattcttttttccctgaccattaccaaa

SEQ ID NO: 163386 - DNA, 976 bp, Homo sapiens
  misc_feature (372)..(372): n is a, c, g, or t
  misc_feature (639)..(639): n is a, c, g, or t
  misc_feature (806)..(806): n is a, c, g, or t
  misc_feature (952)..(952): n is a, c, g, or t
gaaaccagtccctgaggcttggcacagcaggagacctcctttgcagtgcttgggtgtccgggcgctgaggctccggcctgacctcttcatgggatcgacggcaacgtctccggatgccaggagtcacaaagggccgaccaggatgaggaaaccccaggcggagtccaggggaagcagcacggcatcccagcctcatgcctgcccagacggtgttgggagtgcagtgaatagaagacacttctctgcaccccaaaagctccatgctgattgcgagaaggaaatgctggatggaggagttcctggaactactgtgagggaaatggtgagagaactttggatgtggaatgtggagtaggaggaacacgaagtggngatctgcacttggggtggtcagcactgcggatgcccagcaaaggcactgcctggtccacatcccggagtggtctctgcgcccgagtcggcatcgcagctgatggtgaaacttttggtgtggcagaagagtgtccacaaactttggaaggtatccgctgcctcctccatagccgtgtatccctgccgagggcaatcatctcggggagccgaaagtccggctcatgggccagggctggctggctggagccacttgcgcggcgcacctgngcggaggttcaggcggccccggtgtcgcaagcggctgtgagtgatgcctccttggtgccggaggggtcccaggaagtctgcagaccagggctgaccagcgggcagcatggtggccgcgatggaaggtgacggggttcgcagcgccaggggacccagcagagccagancccgggcatcccgcatctccagcagcaccgcggggaggcctggcgctggtgacgtggcggccagtgcacaaggcccacgactcagtcccagaggccagcccatcgtcagctaacttcaggaaccccgggccagctgaggcccgggncccacgggcaagacaaagggcaga

SEQ ID NO: 163387 - DNA, 639 bp, Homo sapiens
cttcccaccccaggatacataaaactggggcacagagcagatggaattttcagctctgctcatcagcaggttgacctgcttgttccaagcaattttgtgaatttaagactctggtgcctggctggactcatagcacccgggtgctctgcaatttgtacagaattctaaaatttcaggctctgcttgttgcctagatctttagtaataacagcaataaaaaagtaataatacccacatgtattaagcatttatgaagctacattaattaagcatatgttgtgtttatgtagtttgcagttaatggcactggcttaatgtaatagggatagtattttttaaagaagaacttgatatatttccatcttcaaattgtgtttcactggaaactgctcctcttccagggctggacagggtacctaatgccctcacggaagaaaaggtgggttagcaagtcaatagacttaaaaatcagagtcctgctttagaccaatcagaatgacgtatgaagatctattgtatagacaaatgagaagcccatcccagaagagaaaggacataccagcttctgattctccacaacgctcagcctcaatctccggctgtctcttctccaggagcttggctaccaccatagcacga

SEQ ID NO: 163388 - DNA, 264 bp, Homo sapiens
agccccgctggcatagccactccaggacaggccaacaacacccaagaaaacctccccagttgtcaacaaaaatgcacttacatgtctcaaattccttagaaattataggacacacacaagaacaaaaagtaatggcttctgtaatagtaatataaatgtagatacagacaaagtaaatcctcaccaagaggagctcggcgtgctcaggcaccgggaactcctgcagaccagggcagtgttttactcaaggaccaactcggaggc

SEQ ID NO: 163389 - DNA, 468 bp, Homo sapiens
aggtggctcatgcccgtagtcccagtactttgggagactgaggcgggcagatcacttgagctcaagagtttgagaccagcctgggcaacatggggaaaccccatctctacaaaaataaataaataaagtgcatttcagcatatcaatgctcgggccaggccacaccaacagaagacacagtaagagacagacacttaggtctatccacggcgacagctacaaatacaaggaaaagggtcaagttcaggcactgatgatgttggcatgggattttccagaatggcaactgactctcagtgaagcgctgaaccaaagaacaatcttctctagagtcacacagatgggatattcttgtattagaacaacattttaaacacttgttaatgctttcatttaaaagcataaaaatctagaccaggcacagagtggctcacacctgtaaacccagcaccttgggaggctgagttg

SEQ ID NO: 163390 - DNA, 384 bp, Homo sapiens
acacgctaccacgcccagctaatttttgtatttttagtagaaacggaatttcgccacgttggccaggctggtctcgaactcctgacctgaggtgatccacctgccacggcctcccacagtgctgggattataggtgtgagtcaccatgcctggccaaattgtgcttttactttacattcaatttttactttacactgtaacccagaacctagatttttatctaaaccaagttttaaatgcctgtgtcaaatgtgtctgtctctcttaggagaggaacaggggtgcccagatgatgggccacctttctttgattactgataatgttaataaccagaatagtaacaaactttttttttttccctttttgagacagtctcactctgt

SEQ ID NO: 163391 - DNA, 281 bp, Homo sapiens
tgacactggagattattacaattcaggatgagatttgggtggagacacagccaaactatatcaaaatggaaggcttgtgaaatgtaaatattgattcatttaccaaaggcagcatctataagcccagacccatgaagggcttcatagcccatataaagggttttcattttattcaaaatataatggaaggctgtgggtaaatgaaaattaaactgttgggagcaagaatagaagcagaaagaccagtgaaggagtggttacattagttccaacaacagatg

SEQ ID NO: 163392 - DNA, 429 bp, Homo sapiens
gctgctccttcaccaggctgacctggtcctcactcagggcctttccgcttcctatcccctctgcctagacgcacctgcctccggtcctggcatggctgcttctttctcatcgttcacatctccagcctttgagccttaagagaaatagcttaagagaactagctcaaaaacaataaagagaaaatagccccactattcaattgtattcaatgaatagatatagaaaactaggactggatgtggttactaattacttcaaaacaattctaattactaaaactaaaggaaatgttgtagaaggcgattaatttgtaaagaaagaagcagtttcaaagaaaactctaagccattttcatcaagccatcttttaaaatgaaatatgaaagcaaatattctttttctaaattctattcagtatcattagagtga

SEQ ID NO: 163393 - DNA, 545 bp, Homo sapiens
ggcaacatagggagactctgtctctacaaaattttttttttaatttaaaaattaacaatgcatggtggcatgcacctgtagacctacctactagggaggctaaggcagaaggctcacctaagcccaggatttcaaggctgcagtgagccatgatcatgccactgcactccagcctgagtgacagagtgagaccctatctctaaaaataaaaacaataaaaatttaaaataaaaaaaaaatgactggaagcatatacataagttaataattactactaggtaacaatactttgagttataagtttttgttaatctatttcccaattttactacaatggatttccagtgtaataacatcatgtttttaaaaaacaatgatgttctacttcaaaaataaaaatgccctcactgttaaaaaagatttcagactttttacaaaaggaaaaattatagaacaacctacaaatttagaagtatttttaaaaattattattttgctgctttgggaatacgccattttttaaacctccttcctcacattttatt

SEQ ID NO: 163394 - DNA, 476 bp, Homo sapiens
aagagaagaaagattctacttttcagagacattaaaatcactcatcactgagtctggctcgcttacagttgagtcagattttttcctttcagtatatgtagttataaatatgtgtttcagagaagtataggatttatagaacatagaagtggcttattttagcaagagacattaaggctaaaatctgaaaagttgaattggaggttgctaggagaaaaggaggtgagggttatcattgcaagcagaagtgttgggccaagtagtcagaagaattttaaattaccaaatgaaaagaaaggtagagtaggctggcagagagggtgtgtagcagaatggtcaaggtcagattattttggtcaaggtcagattattttgataattttgtactttatactaagaacattatgatatggatgaattttaagctggacaggaggtagtatgatcatatttatatttaaaaggttactctggct

SEQ ID NO: 163395 - DNA, 321 bp, Homo sapiens
tatcgtcatggctgactcttgaggatccacctccataatgtgagcccaggctgggctgaaacccctgagtggaagccatctgcttgccttggcctcccaaagtgctgggattataggtgcgagccaccatgcctagcctcagaatctcatttttaaattactgaataatttcaattgtatgtctataccacatttgatttatccatttatctgttgaaggacacttggacattttcacctttttgactattgtgaataatgccgctgtagaaattggtatacaaagtatctgttgagtccctgcttacagttcttttgggt

SEQ ID NO: 163396 - DNA, 142 bp, Homo sapiens
agctgggtggagaaggcgcctggacaacggggcgaacttacacaggcaacggcaggcaccctgggaagcaaagggcgagtgctttcataaattactttgtctcgtagaatcagatcctgagcgacagctatgtatatgctca

SEQ ID NO: 163397 - DNA, 426 bp, Homo sapiens
gggtgtctagaggatccctcataggtcgcaggtcataggttcgcaggtcataggtcgcagacttatgaatgagagaatagtggagcaacacaattgcttcagattcttttcatgtctttaggtatctctcttttcccaaattaactttattttccagggtctaataatctggccatgcaaggcaggttcataggtccaaggttcattacagcatggacctctgttgacctctgtgatatgttattcaaattttctcttgtaaaatgtatggcaagagagttttttttttcccccaaaggaatttatatataccggatttcagccttccagcttactcaggggctcaggggtttttctctactatccattggaatctggtcttctataaagaggaatgcctttctgcctttcccggcgaacctaaca

SEQ ID NO: 163398 - DNA, 606 bp, Homo sapiens
catgatctctgttgttatttcaaacctggcgtcataggtctctttatattttcccccctgaattgcaagatcgattgctgattttcggagtattgaacaaatagattagaagaacattttgggctatccaaaaaatctgctttcctttctttacaccttttaccccaaacccttgacctagactctcagacttccaaagagaatctatctacagagttctggtgaagacttggcaggaagagggggcgtctgagtccctggaggtaggcgttgagaccactgtccattcataggtcctttcttcctcttccagaggtaccaagggacaccttggggtgtctcttgagtccatcgcgctccctgcatgtcttcacccagagcgtctgcctgtgggctgtctgtagcccctcgccggaaatggggcggcagaacaaaccccgggattctctctgtcagctggtgaattccacaaggagggaaatgctgcaagagaaggagaaactagttcattgttttgccagatgaagtgggagcctgaaagcatctttgggtcttatacacacacacacctcacacataccacgcacacacaccacacacacacca

SEQ ID NO: 163399 - DNA, 395 bp, Homo sapiens
cttgcccaaggtcactcagcaagtgcttgaactcaggatttgaaccacatctgccagacccccaagccacctgaaactttctatctcctcacttttcctcccaccagggtaagtgggataaaaaagacagatttggtgaccaaactctagaatgacaacactaaacaatacagaagaaatgttaagtattatctcacttccccatcagtggtaattatggatctcattattccagaagcagcacaggctaaatcatagaggtttagataaatctgagtataacggattcactaagccctattaaaaacatttgcagtgacttgttcagccctcttcaggttggctgtgtggaggacaaccatcacctcccagtgccaaggcacacaccaggacag

SEQ ID NO: 163400 - DNA, 535 bp, Homo sapiens
cacccatgtgctgtgccagctgaggatgcacagcctcagtgctgtgaacaggaaacatcagaaacacacaaaacgggaacgttgctatgaaaaagcgaggaggacaacattcctcaaaaatatcaatgtcataaagacaaagaaaggaaatgagtcagaataaaggatattaaagaaacaatctggccctgggtagatgcactgagggaagcagaactcggccagcaggtaacatgttgcttcgatggcagttcatcaagcatgcctcagtcatgagaaaatattctcattcagtcaggtgctgggaaacttactctccaggaaataaaagccctcgcttgtggcttttacaaatttctgtggtttaaagcctgtatcaatttgaagcctatcaaaggcttaataagcaatctgcaaatccttgaactctgcatgatcacctgcaggagcaggaagctgcacagcactgccagcagaacgggaggaagtgtttcttaggaagtgcacacaagcactgggccgtgaagggtcagga

SEQ ID NO: 163401 - DNA, 635 bp, Homo sapiens
tgtccttggttggagcatctctattacataaatcatgaaatgactgcttttggacaaaatttcccctttatatttctctagactagggaacctgatatagagtgtgaagaaccttttttcttctcccattctctttttttgggggctgatttttggttcatatttgtaggttcaaggacaactctgtaaagaattttgaaaattcaaacttcaaccaatttgaggatatcctaacccagtagtgttgaaagtgtgttcacagactactgacaactgtttcttatcagttcatgacaagattcataccgaaattgagaattgcatttagaatgcaataattttaaatcccttaaagctaatgacaaaaaaagaggtgtttatattttgtgtattcatccatgaggaactgggaatttaaaagaactagctggtttttaatcccagatattttgagaagcattgttctaacttgtggtcttttcaattgcccatgccttgcttttgatccatagttgtataatgattgattctgaccttctgattagcaaagcccagggtagaaaaatcaagcacaaagtccagtaaaaataattcatcacctggtaccagtataatatggcttgatttttgccttg

SEQ ID NO: 163402 - DNA, 267 bp, Homo sapiens
taccaatgagcccatttctctttgaagataaactcacagagatctactcagacaggaccttcgcacctttgccagagtttgagcaggaagaggatgatggtgaggtaactgaggactctgatgaagactttatacagccccgcagaaaacgcctaaagtcagatgagagaccagtacatataaagtaaaatgacatggatttattctactaagcaatgagactggggatcaaatccactttcttatctcaggaatcagcattatttc

SEQ ID NO: 163403 - DNA, 570 bp, Homo sapiens
caagtcctcattgctagctatattgaaatatacaatactttgttgttaactttagtcaacctactctgctgtcgaacatgataacttatttcgtctatctaactgtatgcttatacctattaagcaacctctcttcattcagccacctgccccccagccccccacaaacacacccatacccacatgcatcctagcctctggtagctatcattataatctccacctccatgaggtcaacttttttagcccccacatatgaatgagtacatgccatatttatctttctaggtctggcttattttacttaacgtaatggcctccagttccatccatgttgctgtagatgacatggttttgttcttttatatggccaaataatatttcattgtgtaaatagagcatattttctttatctgtttgtccattgatggacacttaggttcatttcatatctttgctactgtgaattgtgcagcaataaacatgggggtgtagatatccctttgatatactgatttccttgcctgtgaataaatacccagcagttggattgctggatcatatggtaat

SEQ ID NO: 163404 - DNA, 232 bp, Homo sapiens
aaggctcttctcaaggacaaaaaatatgatatcgtaagctgcatcatgttgactgtgcatttgttgcaatcctctgccaaatttaaataatggggaattatttagagacttgaaaatgacctggatccccattaaataagtttctgattggctggttttgtgattgtaagaaactttacaaagtgaagatgagaaatttagtgcttgtagggtttgagtaatattgtgtatg

SEQ ID NO: 163405 - DNA, 508 bp, Homo sapiens
atcatgtcattgctgtttcctatgatgtaaacagccggcatttgccggtttcatgacttgaataaccttgccgactcgtttccatttgtctttacacctaaaggtgataggccttcaaggatcgaaactgaatacctaggatacttaacagagccctactctttactgaaacctgaactccaagttatgtttttcctgcctatgagatttctagctgttctgctactgcctaggtaatggcaactgcctgaaagagaaaggtagggctgaatgttgggagtttacctctctgatttcatagttcttataccttcaaacagataaatttatactttagtcaaggttttctagttgttttcagcagaacagctggtgtaatataagcaaaagtgtcataatcagaatcagaagctccacataaattatttaatagttcaaatttctcaaaatattccactggattttgattgacatttcatagaatttatagattagggagaactgatat

SEQ ID NO: 163406 - DNA, 557 bp, Homo sapiens
taattacaaagaacaaaggcctaaaagagaaattcctaaccacaggcccactttcacatgggtttgaaaccagaatttataccatatttttagcccccaaatcccaactcaggatgtcaagaagcatcctgagttggcctataggctaaatcatcaatgtattgattgatgctctggaaccctatgtgtcttttcccagagattatcattaatcttaaagtttacacaacttttttaaacagaagccatggatatcatgtggtaagtaatcatggtaagctagttttcataaatgatgtaacgcatttgaagctgcgaggtaaagtgaagtttatttatacctctgaatcttgagtgaaatatcatagacagaatgagagagatgactctgtaaagaaaccagaacctgaaaatgtgatcattttccaagcaggtgaaagttgactggtaggaccagtttaggagtggaaggaaagaatgattatttaacctagcccagatgccttatggtaaatatttaaatattccaagtggtattcactactttgattagaaat

SEQ ID NO: 163407 - DNA, 563 bp, Homo sapiens
cagtcatcatctctcttcgggaaaataactacaaagtgagtgagcacattagtgaaatagaaagattagcgcttgcaggaccaacaccaaagctgtagaaacaacattgaaaccattcttccactagctgccttgcctgttgctctacctgtcttctgcacctttcttcaccagctttatccttcattccctccttcctctttcaggttttcacctagttattttaagaaaaggttctaaactatttctctagactcatctgtgtgttttcttgtcctgtgatgaattcctgtgatttatgttactttggcattaattttaatcctcctctagcacacgcagactccttgttgagaaagcttaaattctttctgtatttgagatgtaaatttgccaccctcttttctctaaaatttggtaagggattttgctatgtgggacagatacatttcaacttactttatttacagaaacgctggttgaatctaactgtcttctaaacaagggggttttacccgactcatggctcaagttttaaaataaaagctaaaagatcattaaat

SEQ ID NO: 163408 - DNA, 508 bp, Homo sapiens
aagagtgggacatgaatgttaggcaggtacttttggaatcatcatagagacgggcattgaattggcaggaatggaggagacggcacagagagaatccatgtggagcaaaaggcgggaagcagagtctggtggaagtatcagtggtgtgggcagaagcctggggcaagaggctatagtgtgagtgggttgagtggaaatagaaccaacaggtatagcccactttttcttaggaaatgtgggaaaaggagggttgagccaagggtctttgtttttctctgacatacaagagtcaatttaatggggtagacctgccacacgagtcctgctcaggtataagtctggtagttgcatgttcagcactgcccggtcctgagataataggagtatcttagcagtatctctggatctctcccacctgcgaatagggtgctgctgtcatgccatgtctgccctgggagctagagcatcatgctccaccttcctggttaactcgccctgggtatggcct

SEQ ID NO: 163409 - DNA, 838 bp, Homo sapiens
caaaccctgttctgtgctgtgtacgatgagtaagcttcccaagttaaaattattgctccacaccacagatttcagattccaagtggaacagaagtccaaagttgctgtttataaacttctaagggtcgattgtacctttcaatggtgtccaccctgtgttgacatacagcaaaaccgaagggctcttgaaacttctaaccactttctgaattacagcgaagaatattctttgcatggtatcaaagttctacaatgtctcagtaattttacatattgaaaaaagtcattgatttccatattcagtcctctgcgctgtcttctcatttcaagtagtctcatgttccatgtattattacgttatttgaggaattaaaaaaaaaaaaaaagaactggggaatctccaagagctggcgggaatattggctttgagaaaggaaccttagaattcaaacgtaatgttttacctaaaaaggagtccagtttccaacacttgggctgggaacgacaggctatggttgcccaggatctgaagtacagaggaaattgcttgtccttctggtgggagagtttgtctctagaggatcaggaggatcaggagggtcaggagaagggcagggtgtggccgggaggaaggggcatggttagagatttcttttcttgatcattttcatcccagttcagcactgagttcagatttcccttccttccttccttccttccatctgtccttccttcctcctttcctccctctctccctccctcctccccctgtccctctccttcctccttcctccctctccctctctgtctctcccccctaccttccttccttccttcc

SEQ ID NO: 163410 - DNA, 776 bp, Homo sapiens
ccaaccgccgtcttccagacttgccccaaacctatctaaccggaccacaagcctagaaccagaaggcctgggtctctctctgagctgctgctttgttcttacacctgggtggggaagggggcagtgggtacccaaggcctgaaaacagactacaggctgcccctccctgcacatctggctggtcccctccttcccatcttgatagccccctgcacccagggtggaccagcccagctcctcaaccacaggttggaggactagaaaagggagagaagggtccagggtggggagagtgggaaatggcaagcggaggaaaggagagggccagggacatcacctggctgtgagttctaggactgctgggggaggtgacagtgatacaggctttaggaacaggcctcacctccatgatccctatgatgcatacacattttctcagaggtctacttggaggatggagggaggggactttagaggctgaaacacaatgatggggggatgcagtacccaaatgtcccaaggaagggagggaaagtagaagatagggagtcagagaagcggggagcaggtgcctcctcccagcagccagccccagggagggaatgggggtggacccagacccgggccaaggctcagggcccatctgagcatgtcgcctgctaaggaggagtggaggcgggggaggggagggcggggaggtgaataaataataggaaataaaacttcatgaagcagaaaataaaaggcagattatacagatgtggcaatttgaagga

SEQ ID NO: 163411 - DNA, 705 bp, Homo sapiens
ccaaccgccgtcttccagacttgccccaaacctatctaaccggaccacaagcctagaaccagaaggcctgggtctctctctgagctgctgctttgttcttacacctgggtggggaagggggcagtgggtacccaaggcctgaaaacagactacaggctgcccctccctgcacatctggctggtcccctccttcccatcttgatagccccctgcacccaggagtgggaaatggcaagcggaggaaaggagagggccagggacatcacctggctgtgagttctaggactgctgggggaggtgacagtgatacaggctttaggaacaggcctcacctccatgatccctatgatgcatacacattttctcagaggtctacttggaggatggagggaggggactttagaggctgaaacacaatgatggggggatgcagtacccaaatgtcccaaggaagggagggaaagtagaagatagggagtcagagaagcggggagcaggtgcctcctcccagcagccagccccagggagggaatgggggtggacccagacccgggccaaggctcagggcccatctgagcatgtcgcctgctaaggaggagtggaggcgggggaggggagggcggggaggtgaataaataataggaaataaaacttcatgaagcagaaaataaaaggcagattatacagatgtggcaatttgaagga

SEQ ID NO: 163412 - DNA, 480 bp, Homo sapiens
cagcgcacagcagcacagcagcgcacagcagcacacaccagcacaaagcagcgcacgccagcgcacagcagcgcacaccagtacacagcagcacacagcaccacacagcagcgtacagcagcgcacgccagagcacagtagcgcacgccagcgcacagcagcacacagcagcgcacagcagcacacgccagggcacagcagcgcatgccagcacacgccagcgcacagcagcacacagcagcacacgccagcgcacagcagcacacgccagcgcacagcgcacagcagcgcacagcacacagcagcacacagcagcacacaccagcgcacagcagcgcacagcagcgcacgccagcacacagcagcacacagcacacagcagcgcacagcagcacacaccagcgcacagcagcacacgccagcgcacagcagcacacagcagcacacgccagcacacgccagcgcacagcagcacacgcc

SEQ ID NO: 163413 - DNA, 435 bp, Homo sapiens
catttgtttgcttcgatcagagctgcttcttcagggaaacacacggcttctgcagaaggccctctttagcctatgggcttattgacacatgcccactcactgaggcctggatggatacagcacttgggccccttgagaacaggacatggagggttttagaaatggcagtggacatgcccggaagtttgcccatgatgtggcacccatagagtctgagatgggagcctgtgctgtcgggggaccacaggagggcagtctagcaccaggagagggatggcaaggatagcagtatttgtccacgcctgtccagtgtcttcagggccccatgctcaggggtcatttgctgtgtctgcgtctctctcactctgtcagtgcagacaaagagctgcaaacacagccttagcactttgcttccagaagcaagttaaaagtcac

SEQ ID NO: 163414 - DNA, 398 bp, Homo sapiens
tgaaaaaatcagtatgaaaatggcaacctagaagaaaagtgagcgaagattacattcacaggaaaatacagaaccaataagcaaataaaaaatggaagtgtaaatcaaaacaatcttatacctatcaggagattggtaaaattaattcatccagccagacacggtggctcacgcctataatcccagcactttgggaggccaaggcaggcagatcacctgaggtcaggagttcgagaccagcctggccaacatggccaaaccccgtctctactaaaaatacaaaaattagctgggcatggtggcaggtacccgtaatcccagctactcaggaggctgaggcaggagaattgcttgaactcggggggtggaggttgcagtgacccaagatagcactaatt

SEQ ID NO: 163415 - DNA, 213 bp, Homo sapiens
gggtcaccaatcagtactcgagttctataggtccagaagcacttcttcagccactgatgaagactatctgcaaggtcttcatcataaaacatatcgccaagaacaacaaggtcccacttatcttgttccaaattcaaaatgttttggattaaaataggaaaaggattcagtctgttcaattcacaatttagtgtaatagccattcctgcaact

SEQ ID NO: 163416 - DNA, 340 bp, Homo sapiens
tgaactgaggatactcctgccaattttcatctacctagatcccatatctccttctgaccacctccacgacgccctccttggccacccagcccagagttttccctgcccccctccatatgacattaatcgaagttccttatttgctgctgctgtgacagctcccgcttgttatcacaggtaacatcttcatgtatcttgactccccaaatattacagtttgctcgctaaactgtaatattcgcagttatctttatatccacaccattcaccaacagtgcctagcaaagggctaaaaacatagtaggcactggaatacttgctacagatgtctgtaaagaca

SEQ ID NO: 163417 - DNA, 464 bp, Homo sapiens
aagttagccgggcatggtggcaggcacctgtagtcccagctacttgggaggctgaggcaggagaatggcgtgaacccgggaggcgaagcttgcagcaagccaagatcgcaccactgcactccagcctgggcaacaagagcaaaactccgtgtcaaaaaaaaaaaaaaaaaaagaatgtgaactttttcctcatcaggaagatcagtccttatagagaatcagagatggagggaccccaaaattctctttcaggccccctcctaagtccatttctaggaatcagataatttcatctttaacaagatggcagtcatcagtctcctactcatctctatatattactcccctctcacgtgggtcagagccaccacctcagagtgaatgggctttagttccaggatatgctccgctctgtgctgtgcacacattctctgccacttccctcccacatccttctctgttcg

SEQ ID NO: 163418 - DNA, 303 bp, Homo sapiens
agctgggcagtcctcttgaccttgcagactggcaggagtgaaccatcatttattactttgggcttctcagtaaaaaaaaaaaaaatatatatatatatacacacacacacacacacacatatatatatatatacacatatatatatatatataccataagcaaagtattagggaaccaaaggaactagacaattttataagggggcccacttaaaatccaggctgttgagccaggtgcagtggcttaaacctataatccaagcacctttggaggccaaggcaagaggatcatgtgagcccagg

SEQ ID NO: 163419 - DNA, 178 bp, Homo sapiens
taaatacctgatgtattataagttgctgttcttgctgttactgtcatcatcatcaacatcaacatcttcttctgaatccttctttcaaaatgttcagggaccccaatttttgaaattccctctagatactgtgcacagggaccttaggtaataccagtcacctgaattcatttaggat

SEQ ID NO: 163420 - DNA, 559 bp, Homo sapiens
tgagcttagccggtttcttaattgtgaaacccctatcgcatcactgtcactgtactgaggccatatggaccaggtatggcgctgacacttcacacatcctcacaacagccctagttttcaaataaaggaactgaagatggggaaactgtatataaaaggatatggtagcactcccgtcctcttcctcttcctactcagcaggagaagacgctttgcagctgatcaaactgtccccaccatcaccatcagtgtcagattaaatcatatgagaggccttggctggtctgtcagctgccccagagctcattctggctgtttgactgagggctctgagtgaaagctccccacgttgcaaatggctggcctctctctactgctggattctccttggaggaaaatcttccatgggaactgggtaggattctgtgttgctttggcagcaactgcagaatgattaacatggcactggggaaactgtatataaaaggatatggtagcactcccgtcctcttcctcttcctactcagcaggagaagacgctttgcagctgatcaaactg

SEQ ID NO: 163421 - DNA, 239 bp, Homo sapiens
gtcgcccaggctggagtgcagtggcgtaatcttggctcactgtaagctccgcctccccggttcacgtcattctcctgcctcagcctcccgagtagtgagattacaggcactgcgcctggcagacaatactttaaatgtagcttttgttgtttagagaaatacacatcttaaagattgcctgtataaaaaaatccacagccttaagacagttatgctacttgtagccaaagttcacagaa

SEQ ID NO: 163422 - DNA, 153 bp, Homo sapiens
tgttgaggctaacttcttcattgttaactcatgtatttctcatggcacctcttctttttggccatctctttttaaattctcttcctttctctctaccatccctcctccccagttaggcacttattgttttcttaataccctgtgcacattttt

SEQ ID NO: 163423 - DNA, 278 bp, Homo sapiens
aaataagtgggaaaggaaaatattgttcagtgatgttcccccaaaagtgtacaatgtttgggatattcaatacagatattcttaaatctatcgtgatgaattcacccaatgtgaagcccaaatttctttggaaacaccgaactataaattaaagagtacttatttattccttatgagtttctcccaatttatggaacaaaattctataccatactgtacaagataatctatgtttaattaactttaatgaaattaagctattacaaaactataagcag

SEQ ID NO: 163424 - DNA, 307 bp, Homo sapiens
ggcaggggctggggaaggggcagaggagagagcagaagccgtcccctccccaccaccaagcttctctgtcagtctcctagggctgccgtaacagaggaccatgaacttggtggcttaaaacaactaaagtgtgttttctcgcagttctggaggccagaagtctcaaatcaaggtgccaggagggccatgcgctctctgaaacatataggagaggttctttccttcctctctagcttccagtgtttgatgggaacccttggcttaaggctgcgttacttcagtctctcccgtcgcctggtcatcttct

SEQ ID NO: 163425 - DNA, 366 bp, Homo sapiens
ccggctttactgtagaatagatttctggaagtataagaacaggagacataaatatttttaggtcattgatacataatttgaaaatgactcctagaaagattttaacaatttgtgttctaccaacagtgtttgagggtgtctttttctcattgtctcaccagtaaatgacaattgtaatttgtttatttgcaaggcaaaaaaaaaaaaaatttgcaatttgatagttaaagagattaaactttttctcagatttttattttgtaatttgtatttctttttagtgaagctcttgcttttaccctggctactacctatgattgtgttatgttctggaggagagggaacttggctgagggggactttggg

SEQ ID NO: 163426 - DNA, 490 bp, Homo sapiens
aagtgaaaccttgtcactactaaaaatataaaaatcagctgggtgtggtggtgggcacctgtaatcccagctacttgggaggctgaggcaggagaactgcttgaacccaggaggcggaggttgcagtgagccgagattgcaccactgcacactccagcccgggtgacagagcaagactcttgtctcaaaaaataaaacataaaaataaataaaaattctaaaaaaaaggaaagaaaaaagaaaggaaagcaggcagggtccaagggatctctatcagctaaaagttatccatgcaggttcaatcagaatgtgtccattaagacaaaacggtattccaactgtcctgcctctatgctcaggatctcaggaggaggaacatctgaggattactttgagtcaggtgccccagattattcgggactatagctaggtcttctcaactataaccagcgaaaaagaactaattcctcctggggaaactgggatacta

SEQ ID NO: 163427 - DNA, 191 bp, Homo sapiens
gaactgttatttcaacatgaaccttgccaaaggcttaagaaaaccacattttagttttccctttctctattaaaaaatgcatctctactaacccaagatctctctttcattataagtaactttaatttcattgaaaggatttggggatgggggtaaattttagtttcattctaaataaatgccttcaattt

SEQ ID NO: 163428 - DNA, 321 bp, Homo sapiens
gactagaggacccgcgacactctgagttgcatcttaggattttatggttatttttgtctcaggtaccataggtcaccctaatttatgttctctatatatcttttggagaagataatttcagcaatgtggtagctcatgaacactgaaaattaaaaacaaatcaatttagcctatgataaataaattaaaatgtttcataaaatgcaattttacatttcagttatttatgactctagctgaaaggcaaaaaccactatgagagaaccactgactacaagaacaagtttggtttcctttaagcaactgtaccaagaaaaaacc

SEQ ID NO: 163429 - DNA, 482 bp, Homo sapiens
gcagacacagctagggttgactggatcctttctttaccttgagtggttttaataaatagcaacatttctctcaatggctgcagtacaaataattaaattacttatatctggacaggatttagcattgccttcacatggttaaattccaactactacccaaaatctctcattgataagtgggtgatttgggctgctattgtctgtggtttatttaaatgatttaaataaacatctattctcctatagtgttaaaaaacaatttatgtactattaatgaaaaaaatccacttcagttagtaactatgaatgaccttcaagatagggatataagaaagtaatcaaatcagggatgttttataaaaggaagactttggagtttaataagttctgtggaggggaaaaatactgagtaaataactgggtatttgcatgcattattttgacaacgggagggctctattttttttacctatttctttaga

SEQ ID NO: 163430 - DNA, 265 bp, Homo sapiens
gcctatgctaaatttcaaatcaaagaggctcaaatcccaaaagaaaaacttatctagaaaagaaggaatgccccagggtctgttgttcccctttttgtgttcatgagttctcattatgtggctgctacttgtatgtgagaacatgtgatatttggttttctgttcctgtagttgtttgctagggaaaatggcctccagttccatccatttttctgcaaaagacatgatctcattcttttttacagctgcatagtattccatggtg

SEQ ID NO: 163431 - DNA, 375 bp, Homo sapiens
tcctgtgtccccgggtaaggggctgtgattgttaatggatgtgaggtttctttgtgaggtaataaaaatgttccaaaattaggtagtggtgatgattgaacaactttgtgagtatactaaaaaacactgaattgtgtactttataaggatgaattttatagtattaaattatatctcaatgaaactattactttttaaaattcataggcacaaataaataagatctcttgttatggctctttacaaaaccattgtacaccttctcaatatagctcagcctggaaacacagtgcataagcaacattaacaaaaatggattgagtttttaagaaagtaaaacagcacttattttaagatgggatttaaataaactac

SEQ ID NO: 163432 - DNA, 479 bp, Homo sapiens
tgccctaaactgtgttcaataaatataatctcttgccatactctgcccgttttctggatggataagctgcaggtgggaagctattgggaaagaggaagaatactaattggtaaattgactttgggtcttggacaacagcttgtagtacaaaaactctaacttattagctaaactaggcaattggcaatagttgcctctgaaaaagatgaaaactggaagcacaaagcatattcattcaggcaataatgtaccctgtactgtggtaaatgaatcttcacctttgtaagcacagtgctacataattgttcagaatatttcctgtgactaaagcataaaattttcatacgtcccataagaattctcaaatcttaattactcactcttctattttcttcatcttcaatattttccttaggatgaggatgtcaaattccctgtgggaatgtggcaacatatatttatcactaaaacctatcttg

SEQ ID NO: 163433 - DNA, 430 bp, Homo sapiens
gggtataaggcgagtcctgggtgaggctgaacatgagttgagctctgcaactccttcccactccccattccgcatcatcaaacagagaaaacagtcatctctgccctgccaaacttgcaggcttggtgtgagcctcaaatgcattgaaaacgaggcagtgttttgttagtgatccaagtgaaaggattttattcttgtggacatcattttcattcagaccaaatttgcttttcccttggatagatgattatctctagatgtgtgctttcaaagaagtaagttttcctgccataagttgtacctttccacattgaagttgatgctccatttccaacagagacctgtccaacatgcccttcattgtggtacttgccccggtggcttctagaaagcttctctagagagagctgagccttcttcctcctcccct

SEQ ID NO: 163434 - DNA, 211 bp, Homo sapiens
tactttacagcacatgacatatttcaagtgctgtggaattagggagtgtagaggttatatttctttgagaaggtggagaagactgtaggtagaagttgccacttggctcacaatattaagttcaaaaaagtaggatgcaaaactgtccggttttctctcaattttattataatatatctctacgagaaagaaaacttttaatctttatgaa

SEQ ID NO: 163435 - DNA, 144 bp, Homo sapiens
atctacttcagtgtaaatttatggacagagtctaaaagaatatgtgtcatgattagcaatgaggagatagtcaattattttttataatatgtacttattatttgtgaaattaaaaattcactgtcactaataccgacaacagca

SEQ ID NO: 163436 - DNA, 284 bp, Homo sapiens
aggaagtaagcatgaacaaactaccttatatgggaattcccagacctcagctccacccagaccaagataaatgatggtttcagactgctattccagcaaaacagggaccatcctatatttataatattcagtcatttcttccatgctttcttactttaaaaaatgttcttgaaattttcccttggtcttctttcttcttgtgattctgcctactttgttgcctttgtcccacttaactattttcttcagtttttcccattgtacttggtttattttgttgttgt

SEQ ID NO: 163437 - DNA, 368 bp, Homo sapiens
catctactttttagtccctctgaagtgtcattctccatccacaacgggcctttgttcattttgtttttttttctctgcatgccacatctgaaatcccttctctcagtaacctaaatcaactttgtccttctcatcctccagttcttagcttgttatcacttcccctgggcagccttcctccaagaccagaccagatcctgctattttatggatcctcaaagcagcctgtacctctccttcctagcccttgtcacctttgtgatttaacatgtctttatgtgttattttgcttctctgcttccttaaataagctcctcaggacagggaccgtatcttttttgctcatcattgatatccttagcacccag

SEQ ID NO: 163438 - DNA, 134 bp, Homo sapiens
tcattgattttaggccaatttatgaatcacaccacaaatctcattactctgcagacatctttgcttttgatttttaaaaaatatattacttaaactggtgattcctttgtttgccagaccgtaaatgaactgag

SEQ ID NO: 163439 - DNA, 256 bp, Homo sapiens
gagaggccaggagtaacccggagtggggaagaggcccactcatgccatctcacagctctgcttccagagcgaacccaaacctgatcatcttgctctcccacttaaaatcctcagtgccaccccccgcctcacacccaaggtagccatgcgaaccactttgggttctactggtgtttcttcctgttcctgtctcttcctctctctctcactcctggccagcaccctctccatccgtaagcctcagcttgtgtgtgtc

SEQ ID NO: 163440 - DNA, 331 bp, Homo sapiens
aagtctgggattttgcctcagtttccttagggaattccttttctggtaaactgctaagcattccagctccctcctgggactgggccatctgccttagtccttgctcttgtcagttcctgtctccagcatgccacccaaggacagactcctcagatgtggactgcctggtggactgcttaccccattgtaatcatgcgcttagactaggtttttactttacccttgactatcatcataattgcctctgggattttccacccttccatctttccatccatccatccatccgcctcgtcgacgcggccgcgaatttagtagtagtaggcggccg

SEQ ID NO: 163441 - DNA, 114 bp, Homo sapiens
gtctctcacccttgtcctctcagatgtagttcttgtagtctattccatggcaagaccaaataaatatgattctgttctgtcatttttattcctttcggatgtaaacaaacatta

SEQ ID NO: 163442 - DNA, 162 bp, Homo sapiens
tttgacggtgagggctgtagagaagtggggagatcccagggtttctgtgttgggctgtaaaacctgttctactccagaaaagattgctgttggcttaatactagcagaattctacctgggactcattgaccccaaaacagacccaccaggactattcaagtt

SEQ ID NO: 163443 - DNA, 453 bp, Homo sapiens
gagagaagaatcaaatggatgcaataaaaaatgataaaggggataccatcactgatcccacagaaataaaaactaccatcagagaatactataaatacctcaatgcaaattatatatttgattagaaatatgtatctaaaacacacaaagaacttttacaactcaacagtgaaaagaaaaaaaacataaaaatagacaaaacatttaaataggcttttttgtaaagaagatataagtgtcgaataagtgcatgaagaaaagcctaagatcaccagccatcaagaaaatacaaaatcaaaaccacaaggagacatcacttaacacccaatagtgtgcctataataaaaaaggacaaacaataaccagtgttggtgaggatgtagagaaattagatctttcatacatttccagtgggaaagtaaaatagtacacactttggaaaactgtgaggtg

SEQ ID NO: 163444 - DNA, 450 bp, Homo sapiens
ctgcactccagcctgggcaacagagtgagactccatctgaaaaaaacaaaaaacaaaaacaaaaaacaaatacaagagaggagagacagaattggttcctccaaactccagtacttgttgcaagttcaggctagggccttaattctttaggcacctaaggcagtttcttgacctgatattctagctcagtaattattgtctatattcactcttctcagtgccatatcggttgaatccatatttcaagtattatactttttatacctgagatatctacttggatcgtcttagttgtttttttgtccttgcttcatattaaccaatataatctcctgtttctttgaggatatttattaagcttatttttaaatcatggttcatgtcttacaccaattctggttcctccaggtaggtcatttgggtggtggtttttccgtcaaacaataaata

SEQ ID NO: 163445 - DNA, 321 bp, Homo sapiens
gttccgaagcggagatgctgctcagtgatgaaaaaaaaaaagagaaagaaaagaaaagaaaagacaggaaaggaaaggaaaggaaagaaagaaagaaggaaagaaagaaagaaagagagagagagagaaagaaagaaagaaagaaagaaagaaagaaagaaagaaagaaagaaagaaagaaaaagaaagaaagaaagaaagaaagaaaaggagtagttaagaagcttaaccaaaagcccgatgccctcaggacttctggctgactcccttcaccagccccaccctgccgcaggtggtctgatcagcgtccagatcagaaac

SEQ ID NO: 163446 - DNA, 314 bp, Homo sapiens
cgggcatgagccagcgcacctggcattaaaaagtaataacaatttttaaatatcaatatgtcttatacagaaaagtgagcagtgtggtagagtgtaactggaatgtgagttgagacataacaccagacagagaagccagagaaggacttttgtttgaggaaatgacatttgaaaaggaacctgaatagtgacagaggcagatacctaaagaatatgttccagacaaaggaaacaaaaagcgtgcaattgcatagtcaacttagcctacttgaggaaaagtgtgagtggattttggtgatggagaggtaagtgcc

SEQ ID NO: 163447 - DNA, 384 bp, Homo sapiens
cctccctgccacacacacactttcaaattaattttataatttaagatggggctcacagataggtgttattagcaatgcaaggccttctggtagcttcttattttaaaaattaataattcttgctaatcgagtgatagatttttttaaaaatcattaaaattttctgtactgtctctatttcaaatttatttttccctatgttcctacagctctgttccttagagagtctcagggggatttttttagggtcagggatgctttcagccacaaatttgaagtaaacaattgtgatacctcacctatgcacatttctttttcattttcaagtcatttttatgcacattatctcacttagtccttacagctctgacataggtagggcaa

SEQ ID NO: 163448 - DNA, 451 bp, Homo sapiens
acaaataaaagttctgtggaaagtcaaaggtatccaattaggaaagcctgaggtgggagacataggacaccccagatataggatgggaagaagatgggattaaaaaaaaaggctttataaaggatgtaacattccagataggccttaaaagatggcttcgatcttttaaataaaactttttgttttagaacagatctagatttacagaaaacttgtgtagacattacagataattcctatatactctacactgtttcccatttttaatgtctgactttagtatggcacatttgtcacaattattgaaccaatactgatacattattattaaacaaagtccacacttcattcagatttccttagttttcacgtaatttccttttttctgttctggatcccatccaggataccacataatatttagtcctcatgtctcctgaggctcttcttg

SEQ ID NO: 163449 - DNA, 522 bp, Homo sapiens
ttaatagtaaatgtgactgagatatccaggctaattaactaaaaaaaaaattgtaatttactggactagaaaagttaaaacaggggagttgatagtttagggggatgaaatgataaataatgatggaattttaaggtaacactaggatgtttaaccggaactgccttgccagcctttcttaaccagtattccacaagatgtataagccctaatgccctaagtcattcattgtaagcaataaattaacttatcttctgtgcatttagaacagtaggagttatgtaccatctttgagagaacagagaaagtagacgtattttgtgttctctgattcagatgaaaaacctgtttagaaagtctgtttatggctgggcatggtggcttacgtctgtaatcccagcacttttggaggctgaggcgggcatatcatctgaggtcaggagttcaagacaagtctggccaacatggtgaaaccccatctctactgaaaatacaaaaattagccaaacttggtggtgggtg

SEQ ID NO: 163450 - DNA, 440 bp, Homo sapiens
aagactttgtcatccacagacaattgtcttattttcagtcctcttcaaaaggtcgtttataattagctattggattttgataggtgtttttgaatgcaggtttctaattactctggagattgtgacattagaataaagaaaaatgtgacatgagtctgcttgggaacatttttttttttttaaagtggaatagaggagtaaacttttaggactctcatggagagctgaagtattcgtgaatatcaaacaggagttaattgcatggaccgaacaaatagaagactgaaatgatattgttgacttttttgctaaaaaattgctgatccttaaaaaattgctgatccttttttatgttttcctgagtcaaggaaactttacttttgagctattgacagcttttaacaattcagtaaagtatactccagtgaacaaaatttgga

SEQ ID NO: 163451 - DNA, 192 bp, Homo sapiens
catcattcccataactccctgtgggagggacttggtgggagataattgaatcatgggggtagttccccctatactgtccttgtggtagtgaatatgtctcacaagatctgatggttttttaaggggtttcccttttcacttggcttcattctctcttctctgccaccatgtaagatgtgcctttcaccttcc

SEQ ID NO: 163452 - DNA, 467 bp, Homo sapiens
atcgatcatgtactaagataaatcattttatttctgtaattgaaaccaaccaaagtagatccttctgatatttttgcataataagttttgtccaagtgtactgactgaacatgtaatttacgaatgttcagaaacggactcacaagaatgtaaaaaagactggttctctgatgtctactgtttttctcctggaatcatgtctcatgcaactatttgagagtaaaaataattttaccccacaaaaatagtagatttttgtttttaaaagtctagcagaatatctgttgataaaagccaggtggttgccgggattggctcagggacttaaggagatgagaccctgttacggctgctcagtaaaaatgatagagccttgtcaccagaaggtgccagtgctgccagaaatgacttattaggtcaccaaagacctcagaaaagcacagtatctcagtacggatcgaccaacg

SEQ ID NO: 163453 - DNA, 440 bp, Homo sapiens
acagatggatggggaaagcttcctaggccagaggagcccgggagcagaggcatagggcataggacagcatggcatgagacagcaatgggcgtggcacccctagacttgtgcattgtggtcctggaggcatggttggggtcatgcatttttaaatgaaattccagaggatatggtgtttgggtagagtgtgcggaacatcaagctcagcttaattaggtactatttttttttttcaatgtgaaagaccatgatacacgacagagttctgtagtccgtggtacactgtctgctgctaacaagaaatagttaaatcataaatacagtgctctgttctaagggaagtctccagattcagcttttcatggcaacccccaaaccatatgcctccaggaaacatgccttgcagtataaaattaatctaagcaacagtggctgttttt

SEQ ID NO: 163454 - DNA, 739 bp, Homo sapiens
  misc_feature (725)..(725): n is a, c, g, or t
aaatatgaatgttattctgaacctttagaagactcataaatagcaattttaaagttaacgaaagagattctcaccaacactattggtttggagagaagctaatggatttgaatttctagttttctggtggtgaaatgtatttggtacaaaagaaaaaaaaagtaattttcaaacaagctcccagggagtagagattagccataaaagaagccaatatttaatgaaagttgctcaagccttgagtcaagaaccaatttcctcctgatgttctcattgtgacagtttcctgacttgctcattattcagttcgaaaaagtcacactttttgtgacttacattcctagattgtgaaatggggctgattcaacgctcctgtttaatgttatcattagaacttaaaagaaaaaaaaaactgtgatgacaagtagattgtcatccttaagctatctctaaagaggtgtatttttctttctacatagaagtaaatggtttttgcaatgggttcaatgcatttggagcattttagaggtcaatgtgctacccatggaagactggttttctttgtatggtagtgtagttctccacaaaattataatggaagcagggctcatttatggtgcttcccctgtcccaagacctcaccctgttacacgtccctcttccccgtaagccaagtgagcagagactaggaggctagcacttgactgctcaaaggttgcccattnctgtgctagagcgg

SEQ ID NO: 163455 - DNA, 240 bp, Homo sapiens
actggcgagttccacctgacagaaataagaacaccagtccataaagacgcatgtccggtgatgcctgcagcggcaaaagagaaaaataaagtgcagagcaggccccataccagaggatgggctacgcggagaacaccatgccacatgagggaccgtgtgccgcctgaaagcaggcgccgacctggtggggccctggcacattctgctgaaggagcaaagaggacgcaggaagagtgtgct

SEQ ID NO: 163456 - DNA, 388 bp, Homo sapiens
tgttaaaaagttatgttcacagcttcactttaattctgttcctccacgaatttctctcttgccccagttgtttttgctttgtttttctgatatttcatttttgcaaatgtaagcatatgtgtatatttttgtttccctttcctacacaataggcagcgttctatgcacactgctctgccgttctatgcacactgctcccttttacttaatttattctggagagcgcttcattgaagtgcgtgcttgcaactcatctcctaatgatgaacatttgggttgtttatattctcttggctgttataaatattgcggcaatgaataaccttgtgggtatattgttttttatttgtgcagatacagctttaagatagatgtggggtgaaaggta

SEQ ID NO: 163457 - DNA, 656 bp, Homo sapiens
ttcagaggatccccaaagatctttgagcatcacccctctgctcaaaaccttctgataactttcagttctacccagagtcttcacaataacctatgaggcctgacatgatggtaccctgtgcctgtcactgctctgacctaatttcctactttcttttttgttttgtttttctaaagacagagtctcgccctgttgcccaggctggagtgcaatggtgtgatctcggctgactgcaacctccatctcctgggttcaagtgattctcctgcctcagcctcccaagtaactgggattacaggcatgtgccatcatgcctggctaattttgtattttcagtagagacaggatttcaccacattggccagggtggtctcaaactcctgacctcaagtgatccacccaccttggcctcccaaagtgttgggattacaagtgtgagccactgcgcccagcaaagagcatgttcttgttgtattcatatgattgatctctgactgacgatgtgtgttgtctatattaagaccaagtcaaaatgtggaaaaaacaactgtgataggttctatctttagagccaagaaatttgtttttaactaaacatttcctcccactagaccagtaatttgcagactctagcatgtatcagaatgccttgggag

SEQ ID NO: 163458 - DNA, 292 bp, Homo sapiens
gtgatagctgttctagaggattcccgacggcaggttatactcatcacaggtgtacgaatgtctgaattctgtgtagagtatggcttatagtttttgtttctgctttagggttttttttttcggtcagtggagggtggggcagggttccttgcgggatatgtaccacattctctttcttaattttctggactttatttttctttggtccttttttttggagacagagtctcactctgtcacccaggctggaatgcagtggcgtgatctcagctcagtacaaccgtgccggtgg

SEQ ID NO: 163459 - DNA, 177 bp, Homo sapiens
tacctaatctggattgccaggaatatgcttgaaatgccaaatcatgacttagtattttactgtggtaattggagtagtctttgacacatcaggaagtatgggaatatgggaaagatctttgagagtggaaactataccacagttttgtttagtgctaggtaggaaaggtgaaaaaaa

SEQ ID NO: 163460 - DNA, 462 bp, Homo sapiens
tctctgcctagcccagtagccacttggagaaaaggtttcttaaattgtgatgttatcaaaacttgttaggcaggttatggataatgttcaactttatggctagtgtggatatctatattaaaatttactttatgtcccacagtatgaatgcagttctcagtgttgccattgaatataattattaaccaaatctgaaaaccagtaattaccctctgaagtttttttatggatttcccccctttcctcaggatttgacattgtaaatgattttttagtgagtggcaattagtttgaaccctttatttaaagagttcaaagtgtaatctagtagtaaaaacagttggtttggaagtcagattctggtcttgcctctgctattctctgtgatctcatggacaagatcccatggctgcttcatttactgattgtaaattataatgagaatgatgtattccttgttta

SEQ ID NO: 163461 - DNA, 312 bp, Homo sapiens
tgcttgtactcagctctcctcataaatatgtagcttttcccccaaacctgctgaatatatatgactccactgtgtaatacagaactggtgaggcataaaacccagtctgtccttttcctcttcaaagagagagcaccttcagtctatgctggagacttcctcttcccagcttacaaaccagtatcaccaataaaagttctcctttctactgtttagccatcctgggagtctttgggatgtcacttccctgtaacatgaaatttaaggttcaatggtatttttgtgttgtcaacaaaaagagtaaaactctaa

SEQ ID NO: 163462 - DNA, 632 bp, Homo sapiens
ctcccgagtagctaggattacaggcacatgccactaaacccggctgatttttctcattttttgtagggagtggtctcatcatgttgcccaggctagtttcaaactcctgacctcaagtgttactcccacctcagcctcccaaagtgctgggattttaggcatgaaccaccacacctagccctctaagattttcttgatcaatcatatttgttataatatttaaatataagacttaatatttgtcccaatagtagtagagaagtaaaaatctctttagtttatgtaattacataattgatttcgtaaacaactgtattccttccatttacttcttgcatatatattgtttgtaattctcgtgaaataaattataaatacagtgtttaccatttgattatcaagataaatatattttgtaataacatttcagttttagaaaactcagagacagatttagttatttcttcttttttatgaccaaatcaaaatttgaaaggctgaagtatttcaaaactttctttacatcatagatttcattcctaatgtttcccatttgtaagtactggggtcataaaaatactagtaccttctggctaaggaagccagtgacgtggcatggggatgagggttga

SEQ ID NO: 163463 - DNA, 429 bp, Homo sapiens
caggtgagggcagatgcaggcagatgtaggcaggtggaggcaggaggagacaggaggaggcaggtgagggcaggcgcaggcagatgtgggcgggtggaggcaggaatagacaggaagaggcaggtgcaggcaggtacagacagatgtgggcagatggaggcaggtagaggcaggaggaggcaagatgaggtaagaggagccaggtgcgggcaggtgcaggcagatgtgagcaggtggaggcaggagacaggaagaggcaagaggatgccagctgcctgaggtggctgacagcttcacccagctgaggttcttgcccatcctatacacccatcccaggacctctctctaaacactctgctctgactttggcatttccttgaataaacaccccagaagctcctcgtctccttcatacaataatccagtctg

SEQ ID NO: 163464 - DNA, 251 bp, Homo sapiens
aagggatgggctcccaaggccttgggcagctctgctcctgtggctctacagggctcagccccatggctgctttcatcggctggcattgagtgcctgcagcttttccaggcacacggtgcaaactgtcagtggatctacctttctggggtctagaggatggtggccctcttctcacagccccacctggcaaagccccagcactaaggggaggtctcagggagctttttacccatggcagaaggcaaagcagg

SEQ ID NO: 163465 - DNA, 250 bp, Homo sapiens
ctctgtcattcttagcatgtggcttccattctcaaggtcaccttgtcacctataatgacagtttggagctttgaccatcaagttagcagtccaagcaggaagtaggaagaaggggaaggagagcaaaaaaggtgtactgtcagctgtctgtttctctcaaggagctttctcaaaggtcttgccatactactactgctcacagcgcatgacctcgctctacctcatgaagtcttttttttttttttgaagc

SEQ ID NO: 163466 - DNA, 376 bp, Homo sapiens
taatgtcttaggtaaagaagtctttcttttctggtgcttggggacttgtattttttaaaaatctgcttcaaagtaaatagatgaaatttcattttctcagtggagtttggatcactgggattgagggggatgaggaagggctagatagatagtatgaaacctattggattcatactatggctgcagaagtctgggctttacacattaggttgctaccaagctggatattttgaaatatatatatgtatatgcctgtaatgttttagcatttgcttgttgggttttttttttccccataatggtaggttcttaactgactttttcaaatgcaaggtaaaactttcttttccttttcttgtctccagagtactgatgt

SEQ ID NO: 163467 - DNA, 516 bp, Homo sapiens
aacgcctgcaggaggacactagagaagccccttacaacagataattaactcacacggctcataatttaaaagcaccttatatgacccataaaaacttttaaaaccttaaaacaatttaactttttgctaaatctgacattcaaagaagttaaaaatcactatagggttccaccataaatgactgtcactacttgttcaatttcctaacagaccttagaggtaccactcagtagaagtagtagtcttaaaaagttgttttaaagaaagggaacattctgagtggcacattcgtttatccaaccaaaacactattacaaaatgaaagacaccattattttcagcattgatctcatttcttttcctacataataactggcaataacagcagttatttcaaactttcaaagaaatttatcaagtccctggttgttgttttttaatttttcaatttctgggtcaagactgcatttggaaaaccttaaaattcaaaagcaacattgctctgaaactatctga

SEQ ID NO: 163468 - DNA, 335 bp, Homo sapiens
aaattcaaatgttatcatctccaagaatcctcccctgagccctcagggcaggatttgggcttactgtcatcttacccttgtgaatatgtgttccaagaagaactggcagcctgtctgttgagacatttactagctgactcagaaatctgattttatcagcattttaagaacaaattagccaggcatggtgatgcgtgcctgtagtcccagctactcaggaggatcccattagcctgggaggtatttctcaggaaataaagttttccccaatctctccactcctcaccccactttccctgcacagctctcaccccatgcttctgataataacagat

SEQ ID NO: 163469 - DNA, 941 bp, Homo sapiens
ggggggtgggtgccacttttgtaaagttcaatgccttatttagaaatataagtagtaatgtgtttttcctacagcctaagggatcatcactccttacatcctagagtttctgagactcttgaaaggggtgaagagcagtcgtcgaaattttaaatgatcttaaaggcagggtctcgctttgccaccatgctgtagtgcagtggtgccatcagctcactgcagtgtttaactccgaagctcaagcgatccttctgcctcagtctcctgggtagctaggactacaggcacgcaccaccgcagccagctgattttttctatattttttgtagagacgagggtctccctatgttgcccaggcttgtctcaagctcctgggctcaagcaatcctcctgcctcaacctcccaaagtgctgcgattatagggatgaaccactacacctggcctagtcactgaaatcttttgaccgaaagagtgacaattacaattatcataaagttataaaaggccttcgagattatctaacacaatcttcttacctgacagatgtggaaactgtgtccagtgcacaaccacatacagatgacctgagatctttagacaaaactccttttggataagttacttagcaaacaaaccaataatacctaagcactattttgtaatatgggaagaagagtttgatctaaacatagacaagttgagttcacaagccacagctatggggggaaaaggcctcaaacaacattctaataaatatccacaatgttagagggttactgataacccatttgagtttctgtcatcagaaatctcagccgggtacggtggctcacgcctgtaatcccagcactttgggaggccgaggcaggcagatcacttgagatcaggagttcgagaccagcctggccaacacggtgaaaccccgtctgtactaaacat

SEQ ID NO: 163470 - DNA, 120 bp, Homo sapiens
tttttcatttagccaaaaatagcctatccattagtactggacatttttgatatctagccatctattttaatgatatatattttaatgactctaataaaggttacagtcactaaatccaaa

SEQ ID NO: 163471 - DNA, 475 bp, Homo sapiens
tgaaaaatgttagataaaccaaatctcaagcatagaggcttttcttctggatgaccaagacattcaaatccttcatttctagaaatgtactctgtagtgtaattagcattgtctgaactacatcttttcaaggatgatatgaagttttcaggaaatgaaaacaccatgtgggacttccagaacttggagtaacttggagttgattcccattttcctttggaggtgactggcaaatgcaatctttaggaagctcctctgacccaagagacatgcacacatatttgagtgggattccagggcccgtgagccagcagttttcccaaggcttatctcctgtcctgcaccatcccagatctccctgatagacttctcggaagttgctgctcagaaaactagtgataacaaaacaagtttcttacgttgattttactaaaactgtaaggataagctcacaacttgtttgacttctgctttt

SEQ ID NO: 163472 - DNA, 538 bp, Homo sapiens
gaatgtactgcaacacaacaaagcccatagatgaaaaacccaccaataacataatacacaatggtgaaaagttgaaaacttttcctctaagatcaggaacaagacaagaatgcccactctcaacacttctagtcaacacaacactggatgttctagccagagcaattagacaagaaaaagaaataggaggcaatcaaataggaaaggaagaagggaaatagtctgtttgctaatgacatgatcttatatgcagaaaactccaaagactccatgaaaaaaattgttagagctgacaaacaaactcagtaaatttgcagtgtgcaaaatcaatacacaaaaatcagcagcatttctttacaccaacaatcaactatctgaaaaagaaattaagaaatctaacgcactcacaatagtcccaaaaagaaaagctaaaatacttaggagtagccgggcacgatggctcatgcctgtaataccagcactctgggaggcccaggtgggtaaattgctggagcccaggagttcaagaccagcctgg

SEQ ID NO: 163473 - DNA, 217 bp, Homo sapiens
aggattgctttagcccaggagtttgagatcaacctagggaacacagtgagactccaactctacaaaaaaaatgtttttaattaggaggggctggtgtcacacacctgcagtcccaactacatgggaggctgaggcaggaggatcacttaagctgaggagttcaaggtcacagggcgctatgatcgtgccactgaactccagtctgggtgacacagcg

SEQ ID NO: 163474 - DNA, 506 bp, Homo sapiens
gtatatcacttatggaatgtgttgccggatttttagccatttgtttattaatgggattgttatgagaagattttatacttgggtcactaagaaaggtgaattaaaaaaaaaatccctattataccatttgtttctatttagacttttttttttttttttttttggagatggagtcttgctcagttgcccaggctgtagtgcagtggtgtgatctcggctcactgcaacctccgcctcccaggttcaagtgattctcctgcctcagcctcccaggtagctgggattacaggtgccctccactacacccggctggtttttgtatttttagtagaaacaggtttcaccatgttggccaggctgttcccaaactcctaacctcaaatcatctggcatttagacattcttaagttcatttcactatatgtgcatatctgcagagaaaaggatatatacccacaatggttatctctgagtgctggtcgggaagtctattgactggtgggaag

SEQ ID NO: 163475 - DNA, 675 bp, Homo sapiens
gtatatcacttatggaatgtgttgccggatttttagccatttgtttattaatgggattgttatgagaagattttatacttgggtcactaagaaaggtgaattaaaaaaaaaatccctattataccatttgtttctatttagacttttttttttttttttttttggagatggagtcttgctcagttgcccaggctgtagtgcagtggtgtgatctcggctcactgcaacctccgcctcccaggttcaagtgattctcctgcctcagcctcccaggtagctgggattacaggtgccctccactacacccggctggtttttgtatttttagtagaaacaggtttcaccatgttggccaggctgttcccaaactcctaacctcaaatcatctggcatttagacattcttaagttcatttcactatatgtgcatatctgcagagaaaaggatatatacccacaatggttatctctgagtgctggtattgagtaatttttatgtatttcctcatgatttacttcacacattttccataatcaatatttgttatattcaagaaaaataaattattgtttaaaatgcctatttcaatgttctggagtaaagttatacataattttaaaaaaatctttactaggcaccaactttgttagggcctgctgatgggctttgggcata

SEQ ID NO: 163476 - DNA, 517 bp, Homo sapiens
ccgggaggcagagcttgcagtgagcggagatcccaccactgcactccagcctgggtgacagagcaagactctgtctcaaaaaataaataaaatgttacagttcacagcatgtgtttccagagaggatgttttcctgatagtgctttagtggcatctcttccttagaaaagttagtttagtccaagaataaagtatagcctgagagtacttattgttgaaaatactttatattttctataatagtacagtactcctatactgtctcttattatatctaacccagtcagtctttcctccaacactggaaaagtgcatttgagggacatgttcagtaaatacactggcatcagtgtacggcttagggatatggtcacagttttagagggatgcagaaacagaggccctatgtaacagattaacacagcccctctcatagtctgtatcctttttatattcggggatgggaaaggttacctaacctatctatagtattaactgaatttctgaaaatgaaatg

SEQ ID NO: 163477 - DNA, 170 bp, Homo sapiens
aaactgggtatctgcaaaaagtgtgatgctcaggtcataccagacacaaacattaaacttgaaatcgatcatagatctaattaaaaagctaaacatataaatattttctaaatagatttctgctcttcaaagactagaaatttaaagggaaaccacactgggagcaatta

SEQ ID NO: 163478 - DNA, 563 bp, Homo sapiens
agcgcccggtccatctgtgggatgacatcttggtgcacatggcaacttcggagaagatgtgggaggacgtggggcccgtgggactctgcaggattttaggaggggtttcccttcggggccccctcctcctacctcgttaaaatcaatataagcaatcatcagtgaataatctctcttttggtttcaaatcctgcccaggagggctgatagtctggccacagacaatgccaggattgcagaggcctgggcttcagtgccccatcagggaaagtcccaccccacaccacatgctgactgcaggaggtgtgtgtgtgacctggtacaggggtgtggtttatcctcggaagggtttgaggagtgttgtgtgtgtgcaggacagggcaggcgttgggacagctgtggtagtgagggccactttattctgtgctacatgaagagaggctgtctgacaaagcttgccatgtgtttgatgaatgctacgtggcccatctcttttccataggaggacttcctggacatgaagctagattccggcagggccactggtgtcagcagcactcctg

SEQ ID NO: 163479 - DNA, 671 bp, Homo sapiens
tagaggactccgggacatttcacgagtacactctatgctgccaattgcatgatctcatggttccttgagttttggggttacaggcaaaaaggcaaagaagtgagcaaggaggataacagatcaaaagtgagttgtgcagctgataattcagcaaagaacaaagagacaatggcatgggaccgtgtcctgtttagagcctacagctactgtctcttgctggccttgctgtcccagagatgaccgaggaggagtcaggccagggcagagtacatggccagggtaaagaatactaggtttggttgtttgtttaaacctgagctctccaatcgcgctgctttggtcagatacctccagtggtgtcacaaagggaaatgtgatcttttgtcttgcctttcctcctctgcctgccagggaaaaatatatttacatatgttagtttttattttcctagcaacgaaagagtagaactattttacaaaccaaacacaatgtaaacactttggttcaaggggaaccagataatcataggtcatgacttctttagtaaaaacagaactgtatattatgtacaactcattagtcatgagttccataagtatgtgcaagtgctatgcatcttttattccctaaagaactcagtcttacccagagcatcattggtgactcgtgga

SEQ ID NO: 163480 - DNA, 571 bp, Homo sapiens
tcagttctattcagaagcaattcaaatgcattttacagacttagatttatgactattcccttgctcttatatacttcagggccaactttcatgttccatttttgacatcccagatagaatattgagatatgtttggcattggagatgagaggttatgaggaaagaatttctacaaaagcaagttgaaaataagctttcttctcattgtgtacaaaggggaggaagggctgagaaagtagctccagagagaggagagatggtattcctctacatcctggatctcccaggaaggcactgatttcaaactgcaccaacactcctgttgttgcccaacctgaatttagaaaagcttcagtaacagcgagaaattgccagaaaccagctgggtttttttttgttttttttggtcaggttttgaaaatagcacaaatataactgtagctggattcacaaattaatcctgcagaagggactctcaattaacaacacctcctatccctcacttcagtctgaagaactggggaggaatgcttaaaccgcattgtcttaatgcacggagaccaacgagtcc

SEQ ID NO: 163481 - DNA, 307 bp, Homo sapiens
taggtttgacatcagccaaatggtgtagcgcgatgtctctgacagatattcttactgatttaaagggaggcacaactcaggaaagatggatcttctgagacaggatttcagagtggctgtttttcccttttccaccccattttcctctctttatgattccagttgatgtgttgttcctattcacagtcaaatcattagagccttcagaacttgggaagaactgtgtttgattgacgacagtgaggcttcatgttgactgccacatgggctaggtggccagcatactggaaatacgatttttaaaaaa

SEQ ID NO: 163482 - DNA, 745 bp, Homo sapiens
cataggaatccacagtactaagacacaattcacaaattgctactctttaaaaagtgcaagaaagatcagtgctgattataggtcttaattatcaccttctgaataatctgtgtgcctggctcatagcaagcatttaataagtgtctatcaaataaagtcaagccttgcattttacttcttgcatactttgtataaattcctatttaatcccacgggtattaacagagtacctgagagactagtagtcttctattaacatatttatctctagcctctttcttttttgaaaaaaacaaaacaaaaaccttactacccctaaggttagctgtttctcctagcttgtggcctcatctggatcccctcctccccttttgaggctcactgacacttttctattgagtccgtcagatttccctgccctcaaaacgtaagacagaactaaggtaatgatgcagacaaaagatttattactgtctcctcttctcctttacatcatctttagaaaggttaatcctctccattcattttctcttaaacattttttttggccagctatggtggctcatgcctatagtcccagcactttggtaggccaaggtggggaggatcccttgaggacaggagttcaagacagttcaagactgacctgggctacacagtgagactatgtctctaccaaaaaaaaaaatttcttttaaattagcaaggcattatagcgcatgcctatagtcccagatactggtga

SEQ ID NO: 163483 - DNA, 200 bp, Homo sapiens
ggtggcaacggaaagagacttggtgtagagaaggctctgtgtgttaactgatgggagagactgtttgtttataaatgtgtacagttttgttttctcgtaaggggagaagtcagaactcagttcaaattctggttctgttgtttaccagctgaggggctttgagcatgtttcttggcctcggagctatagctttttcatgt

SEQ ID NO: 163484 - DNA, 409 bp, Homo sapiens
cgttctgattatgaatgtcaaaaaggcagagcatgaaattaacttccccttagtcattgggcacagggagacactacactaattcactgcccttggtatgaaaacttcccatgacaacgtcgcatcaaattagggcccatgctaccctggtgccatctctatctctccccagtgcactcttttacaatcaggcccagcctgaaaacaagggccctgcttgttccagaaaagttagggcgacaggcaggaggtgatggttaactgggacagtagggagaagggctgctctggtcccccgtgggggctgcccactgaaaagtggaggtgggatctcattgtgctaaggagtaactcactcggcagagcatctgatgcagtaatgtaccactagccccacctgagagatggg

SEQ ID NO: 163485 - DNA, 364 bp, Homo sapiens
ccaggagttcgagaccagcctgggcaacaaagcaagaccctgtctctacaaaaaataaaaaataaaaattacctgggtgcagtggcacacacctatagtcccagctactggagaggctgaggcaggaggatcacttgagtccaggagtttgaggcttctgtgagccatgatcgtaccactgcaccccaacctaggcaatacagagagagagagaccttatctcaaaagaaaaaaaaaaaaaaacattgagtctgggggttaatagcacagcaatccaccatctcatcttgctgcccaagacacagatatggacatggcttctgttccttagtcgctattaaatgtttcttcccaaggaacttta

SEQ ID NO: 163486 - DNA, 477 bp, Homo sapiens
tgccctaatgggcatttcggtatatgtatttttattgtttggagctctttgcaatatttccagagcaatagatttttttagatatcacttaaaacgtgctcattttatagataaagaggtttaggtctgtatattgacttggttaaagtcatgttgatttccagtatatatgaagtgtgccatacttttgctgcttttgtgaacctaaatattgtgctaattttagatttatcagagctataaaacttctactagtttctggtttcttgttctagcttcctcttcctggtccctggctttctttcagcctttgaaacctctggagctacttctgccaggattaagcttttttgttgcaagttgcagaaatctggcgacaaggccagaagagaagagagagattaagttagtctaccttttggaattgtttcaagaatgaaaaatgagaatagaagtctcctgaatcccagtctggat

SEQ ID NO: 163487 - DNA, 250 bp, Homo sapiens
aaatctggcttctcctcacacttttcctgggtcactttccaccctcccctgacatcaggatgatacaggcttggcgaggtgaaacactgagagtatttatataataagccgggccttggaaagagaccctcccaagaacagagaaggagaaaacattccacctacccacccacccatccagctacctacctgtctatccaaacatcttatcattgatcctaagtctgttcgcttctccctacctcctctg

SEQ ID NO: 163488 - DNA, 1545 bp, Homo sapiens
ctcatattagagcccacttagtgtataaagcttgctgctgccttgagatcaactaaatatgaaatattaatttaatctcccagttgttcctgtcttctggcacttaatggattctgtttcaaccacgtggttgtccctgtcagtggcctaggcacacagagtgaggcctgagtaactctagagccctcaccttcttgtgacccgtggtggtgatgcatctttgtgagcagaggatctatgtatattagcacctaacatctggagcaaaactagtcctatggacataagccagatgctgttccgaggtccaaaaggtgagacagctggcagttctatcaaggacagcccgtgttccctgggctttcaccctcttttaacgcttttgtgtccagtaaagctcaaagtcaaatgaaagacaatgacacgtcttaatcagatagtgcacctataatcagagtagcagatgaaaaagtttacagtctgtactaattgcacatttattgttggggattttccatgttttctaaacacaagtcattgcatatatctggagtgatagatggggaataaaggagatctggctacacagttttgtggcatttctgatagataagctgaggaatggtggccataactcaagctcatgaggacatctccctgtccttgtcttgtgacttctggccactagacagggccactctgagtcttttactctgcgtgttggtatatgagatggaaatgcctgttcttaggaattttacacagattttcttactgtaatggtcaaagagtaataaaagttctgttttaaaagctagatggccaaagagtaataaaagttctgttttaaaagctagattctctcttttaatagggttaccatccatataatttattcttcaaaccacgatgcttttgagagtgaaaagggggctgttaataattctgatgggacaatagtcatacatagatcaggagtgtcccaagcaaactggatatgtggtagccctgcattttagcaccggcttctctgtactctacccctaagctttctagctcctaagtggagcgaaaaatgtatcaaggcatatatccaatttagtgctacttaccttttcaaagagctgaccaaaattcacgcaacaaaatgacactgcctttggtgagatctaaatgaaagctataactaagctattctttcaggctgggtaaggggaaagtatagccaatatccccatagttatatatcaaaacttttttttttaactttttaagttcagaggtacaagtgcagtaaagctttaatactaaaggaaatagttcacaagtcaaccagggatacttatgtcatacttgggaaaccagggcccaggaggtctgagaattgcatgttaccttcagaggaaaaatctaacagcagatctctcgtgtgttgaaaattctcagattgttttgtgtaaatttattgttgttttgctacttaattgttaaatttgtaattagtaaattattcgactagtaaatttgttttcatgtgatagtaga

SEQ ID NO: 163489 - DNA, 543 bp, Homo sapiens
catcatataccaccactggaatataaatttgaaagagagtcctgcagattatatacatgaatctacttaggcctaataaccaagcagtcctcagtggcagatcaatgaaaagtgaaactaaaggcaagtgaagggtaggagagattggccagtgtttgtgcagcctctgtgggaagtgtctagttcaattcctctcatgtctgcttctattttcctgttccccccaattctaaaaagccagtgtctccttctaatgtctgtatgttctgtgggaattttaaagtccaggtgatactctatacagactgatatggtttggctctgtgtctgcatccaaatctcatctggaattgtaatccccatgtattgaggagaggaggtgattggatcatggggtggttcccccaggctgttctcatgatagtgagttctcacaagatctgatagttttgtaagtatctggaagttcctcctgtgtgcttctctctcctgctgccatgtaagacatgcctgcttttccttccaccatgattgtacattttc

SEQ ID NO: 163490 - DNA, 276 bp, Homo sapiens
gagtgagtgtagatagagaaaagatgaagttcttagactgagttgctggataaatatttttgatactgggagaaatttatctagaataccagaactaaaagagaatcttttgataatttgaggactaacaccttcctggctaagaaactctaacaagtactaactagtcaagatgtagagacaaatgtaaaatggttggtgaatgaatgtctattttttatctctcttttgtttgatacggagtctggctctgttgcctaggctggagtacaatgg

SEQ ID NO: 163491 - DNA, 451 bp, Homo sapiens
gctggattgagattgtgatacaataaccagatggtaaacatagcaatactgaaatggagagctacttggagaaggtcagataatcccaaggattctggtggtaaccagtccactaaattatcagtgatctgttgtaacagaactcattcaaaagcatgaaggcctctcacaggagcaacaaagtcagccaccaagactgttgttacagagaagtccgacgcttttctagtttattttgtgcttggcgctaggaatttctgtaaaaaattacttttaataagggaggggaaaaaaggcttagaggagtagaagcaaagcagtgtgggatgttacgggatcaagaataatgtttctcaagaaaatcaactagtcagaggaagctgcctaatgatatcaggtctggaaaacctaacaggataaaaatgcagacttttggagtgtctaggtcctg

SEQ ID NO: 163492 - DNA, 188 bp, Homo sapiens
gttgtggaggaaataatgaaagtcactgactggaaaagtaacctgtgacgttagccaggtcaacctccaaattccttcccccatttctaacaagtacatcaaactagagacagtgtgtgaatcaaagaattccaggcacagttggctgttaactagaatagtaagtggctgcctaggttctgtcattc

SEQ ID NO: 163493 - DNA, 156 bp, Homo sapiens
gtgggaaagtatgtttgtagtccccagttgtcttccttttctggtaaattcctcttctgaagtgattgctttctgggatatgttccttttcttcaccttttgctctctgaaattcagggcaggatttgtaggactcccactggcacttgtgagagg

SEQ ID NO: 163494 - DNA, 377 bp, Homo sapiens
  misc_feature (371)..(371): n is a, c, g, or t
  misc_feature (374)..(374): n is a, c, g, or t
gcacttgagcacttacagagagaaaagcaaaaagctcaagtctttacctctcagcataagtcatggtctgagatccagagagctcccatgatagcacaaacacaattccttatttcttgtatccacaggggtgatattattggtaatcaatatcaattggtaatcaataattattaaacgtgttggttgctgaattaccatgacagttgaattcactgtgtcaccagggttctcatgataatgttagggcactaataagtgaagaatgggaactttttctcttttcttttttttttttttttcccccaacggggggcccgggggggccccgggctcaatttcgaaataagggcaatggttttttcttgtgnttnatt

SEQ ID NO: 163495 - DNA, 237 bp, Homo sapiens
ggaaagaggtacaatgcaatcagtagaaaggtcaccagaaaagaggaaggaggaacaacgagctgtggggaaatgctgatgggcgcatcttgctcccatcagcttcctccttcccaggcttttgtttgctgcttgtcttgtctgctctcccttgcctcaggtggctatgggtagtatgtttttaaatcttttcaatagactccacattaggaagccacttcagacctgatgggaggt

SEQ ID NO: 163496 - DNA, 468 bp, Homo sapiens
caggtcagcaggctgatggccaacacagcactgtggttaagagcatggttcaagaggcagaccacatgtatttgaaccttcactccatcacttactggctgtgagacctcaggttgattactgtacctccctgtgcctccgctgtcttcactgttaggttagtcatcaatttatttcctctctattccaaattcactcttcattgcctgctctgcaaaaatgcatctggctccaggatagagccccaaactcctaagcttgttgttcaaaggcccggaccccatgctacgtctccagccttatctcctcctgtcttcaagctaccctgctctgcctgtccctgacaacaaccacatcctccatagcctcaagcatgccactctggccaccgccttctaccttctctaactccttagccctacaataaccacgagcaggccctccgtgctgccggcaatccagcctcat

SEQ ID NO: 163497 - DNA, 187 bp, Homo sapiens
aactcagcctgcaggagtactcagcaatcttgttaaaaatgcaggtggcactgatgccgcaatacagaccacgggcaaagttgagaggagctaagggagaacccacggatttttaaacaacaaaatcgtatatactgccagacacaggggctcacacctgtaatcccaacgctttgggaggctgagg

SEQ ID NO: 163498 - DNA, 233 bp, Homo sapiens
gctactctgacatatttatgataggtttatccttagatttggatgtatttaagaaagatatatgatgttgatttatatatgcatgtatttttaaccctacataaattgcactatggagctgggcacagtggcttatgcctgtaatcccagccttttgggatgctaaggtgggaagattgcctgaggccagggtttcaagaccagcctgggcaacagagcaagactcttgtctc

SEQ ID NO: 163499 - DNA, 383 bp, Homo sapiens
ttcccatctggctgtcgatgatggcatagtcgggaccacagcagggctgttggttggacacctagatacagtctcacctgtggcctctctgcatggatggattagtttgggattcctcactgcatggtggccgggtccaaagagtgactatcccaagacagcaagacagaaaggtatttgtgtgacctaagcttggaggtcacagagcatcacacaaaaagcgccaccgtacacacaaagtatccattatacacaaagctccacccaggctcaagggaaggggacagaccccagtgctggatgggcggagtgtcaaggccattttgcaagaagagcaagtggaacagtagccagggttgcagccacatttgggaaatataatc

SEQ ID NO: 163500 - DNA, 774 bp, Homo sapiens
ggccgttcaggtggagctggagccggttaatgcccaagccaggaaggccttttctcggcagcgggaaaagatggagcggaggcgcaagccccagctagaccgcagaggcgccgtcatccagagcgtccctggcttctgggccaatgttattgcaaaccacccccagatgtcagccctgatcactgacgaagatgaagacatgctgagctacatggtcagcctggaggtggaagaagagaagcatcctgttcatctctgcaagatcatgttgttctttcggagtaacccctacttccagaataaagtgattaccaaggaatatctggtgaacatcacagaatacagggcttctcattccactccaattgagtggtatccggattatgaagtggaggcctatcgccgcagacaccacaacagcagccttaacttcttcaactggttctctgaccacaacttcgcaggatctaacaagattgctgagatcctatgtaaggacctgtggcgcaatcccctgcaatactacaagaggatgaagccacctgaagagggaacagagacgtcaggggactcccagttgttgagttgaatatgatggagcatcagattttacctaatacagcagaactcctaaaaagttacagccatatgcaggacggcagtactcagcatggtcttatgcacaggaactaaaggaaaaagagatcgagtcacaaaaattcaggaagagggggtaaatgtggattgtatggaatgaaaaataaacattctcaa

SEQ ID NO: 163501 - DNA, 372 bp, Homo sapiens
atggctccaggaaataccaaaccgtctgagatgttagtattagttagttttgttgtgagtgttaggaaaagggcatacaggactaggaagcagataggaaaatgattatgagggcgtgatcatgaaaggtgataagctcttctatgataggggaagtagcgtcttgtagacctacttgcgctgcatgtgccatggagcctcatgtcacatgaggctcctcccaggtgtcctgatctgtgatttatagtcacagagtttccagcacctggcctagcatgaattgtattcatgaatctttcagctgatgagtgaatgcaattaatgatgggtcaggaaagaattgcagagatgaagtcacagttcagggtggcc

SEQ ID NO: 163502 - DNA, 596 bp, Homo sapiens
tcaggaagctcctcagttcagtgaaaattcaaagggttggcactgagctaggaagcgagaatgcagggttatgaaaaaggatccctgctttgggagctcatggacttgtagcagagaccggtagtaaattggcagtctcagtaacttctgtaaatgattgcatctctttgcaggcttctcttcccatactctcccccactcctccttggacagtgttccgggggttctttcctaagcaactgctttttcagtatacatacttcagatgattgtgtctactccaggatttccaacgatgctaggtttctttcctgtgccctagacgtataggtctaagttccacctggatatcccacagggctatcaagctcagttcatcctaaacagaacttacattcatccccaactcaggatgctgtcaagaagcatcctgagttcacgtaatcctcctgagtacctgggactacaggtgcccaccaccacgcccaactaatttttgtatttttagtagagacatggtttcccacattggccaggctggtctcaaactcatgaccttaagtatccacctgccttggcctcccaaagggctggga

SEQ ID NO: 163503 - DNA, 155 bp, Homo sapiens
tcttcataatctgtatatctgaaaaaggactaatacccagaatctacaacgaattcaaatcagtaagaaaaaagtaaacattcccatcaaacaaatcacaagccctccccagaccagatcatccagcccctcttagaacttgacccaatatcgtg

SEQ ID NO: 163504 - DNA, 263 bp, Homo sapiens
gcaaggatcaggaaggaagagggagggaaggcaggaaggagggaagcaaggaaggaaggaggaagggaacgaacacctgaaagaactgggatacctagtggactacaaaaaagcctgataccccaacaccaaatatgttttatgtgcaatccttctgcagtctcctgtcacataaatgcttgactgtagggacagaagatagtggacatgagtggctactgattcatccagaactatttctttattactactgcaggcatgcc

SEQ ID NO: 163505 - DNA, 372 bp, Homo sapiens
ggctcaagtaatccttccccctcagcctcctgggtagctgagactacaggcatctgtcagcacacctaattttttgtggagatgggcttttgccatgttacccaggctggtcttggactcctgggcttaagggatccgcccacctcagcctcccaaagtgctggggttgcaggtgtgaaccactgcacccggctctggatactactttaaagcccaacagaatccaccacaagtcactgaagcactgtgtttagagccaggcaacttccttgactgcatgaaccaggacggcaattttcacctctctttcccaacttcaattctctacccacaccctacctttcccgtcttcccgttatcaacagaatgggc

SEQ ID NO: 163506 - DNA, 512 bp, Homo sapiens
caccagagaacccccctttgagtgtaatttttctttacctacccaaatcctataaaacggtcccacccctatctcccttcgctgactctcttttcagactcagcccacctgcaccaaagctttattgctcacacaaagcctgtttggtggtctcttcacacggacacgcatgaaactggccctactgcatctagggtgaaagacggagctgaataactttctgtgaggctaaatttctcccttgcagtggtcctagactcaagtgactgtttgtgtgacagttaggacatttccaggacagcctttagggggattatgtggctgtttcccctagagcatatgcagctttgcgtccagtgctgatctaacatagtctcacctctaacaaagcaagggcctctaactcttttaaatttccaccttccatatcagagatctaatgtgaaagttcctcacagctttttcttgagttttattcttttctctctcctcacttcctctttaacagatct

SEQ ID NO: 163507 - DNA, 265 bp, Homo sapiens
cattttttcccctaactctgagctctaaaccacacactgggaggcattcctaattgacaggctttgttggtcgccttgacatttggtctgtttcaaagcagatactgcttaaagctgtgtgtctggaaatgtaccagcaggcaaaccctcagaccttctttcggctgcatgtgtttatatacatccttggtcactgtaatgagtaaaatgtgaacgtggcctatgacaatggatcaatcaggctttgaggtgtaacgtgaaccgt

SEQ ID NO: 163508 - DNA, 851 bp, Homo sapiens
ggtctcagaaaggaaagtccacaagctgatgctgcagaacatctccccctcagatgctggggaatacacagctgtggtcgggcaattggaatgcaaagcaaaactgtttgtggagacattacatattacaaaaaccatgaaaaatatcgaggtgcctgagaccaaaactgcctcttttgagtgtgaggtgtcccacttcaatgtcccttccatgtggctgaagaatggtgtggaaattgagatgagtgaaaagttcaagatagttgtgcagggaaaactccatcagctgatcatcatgaacaccagcacagaggactcggcagaatacacatttgtctgtggcaatgaccaagtcagtgccaccctgacagtcaccccaatcatgattacttccatgctgaaagacatcaacgctgaagaaaaagacactattacttttgaggtgacagtgaactatgaaggcatctcttacaaatggttaaagaatggtgtggaaatcaaatcaactgacaagtgccagatgagaaccaaaaagctcacacactcactgaacatcaggaatgttcactttggggatgctgctgactacacctttgtggctggaaaagcaacatcaacagccacactttatgtggaagctcgtcatatagaatttaggaaacacattaaggacattaaggtactggagaagaagcgagccatgtttgaatgtgaagtttctgaacctgacatcactgtacagtggatgaaagatgaccaggaactgcagatcacagacagaataaagattcagaaggagaaatatgtccaccgccttctgatcccatccacccggatgtctgatgctggga

SEQ ID NO: 163509 - DNA, 292 bp, Homo sapiens
gactctcatgttggagagagaaatcgagatgcaaagaaactttttaaagttctactaattcctaatgaaataatagggatgcaatgcagcaagaatacaaataattgaagtagcctggcatcaccgctgacatgtaggcaggttggcaggtaacagctccgctcatggtctcaagtccaaatttgtataagaaaggaggtttaagagttcaacggctaagggacaaaaaggtagtttatgggaacgctgaaggccaccctcaattctctcccgtttctccagctgggcttgg

SEQ ID NO: 163510 - DNA, 285 bp, Homo sapiens
aacaccaacattgaaaacaagatatcaaattgataacctaagcttttacctcttaagataaattctaaaaaattaaagcaaaccatataaaacagtgaaaggagaaaaaaatgaaacagaaaatagaagaaatacagagaaaacaaatgaaatttaaaaaattaattcttcaaaaagatcaacaaaattggcaaactttcaggtagactgaccaagaaaatcaaagagaaaacagaacatactcatcactcccaaacaattccttattttgcctatatttttaaa

SEQ ID NO: 163511 - DNA, 348 bp, Homo sapiens
ctctcaggctcagccacgcctggcccatcctgggccccctcctggccccaggaacccaaagcgggatgcaccattcactgggcccaggcaatcagatccactgattctacttggcggtcaacgcccctgactgctgctgggtatggaggccaggagcttacctcattggtgaggacacagatccctggggcctctgcctccagggaagggaaggctgcctggagcagaagaggcagtacctctggaggaacaccaggccttgggggaatgtcgtgggtacaaaggcagttgattggccacagaaggcccaatcggggcccaggttcttcgagagggagagtctatgct

SEQ ID NO: 163512 - DNA, 158 bp, Homo sapiens
ctgtttgcctggatatcaccagcggaggctgcagaacagcaaatattgcagaacggcaaattttgctgtctgatccttcttctgaaagcttcatctcagaggggcacctggctgtatgaggtgtcagtgggcccctactgggaggtgtctcccattta

SEQ ID NO: 163513 - DNA, 222 bp, Homo sapiens
acctgctgaacgattctttgcctccttctccatctagcacactggtgtttacaccaggttttttcttgcctgtaatgaagggaggataaatggctaaaataaaccccttctctctttcaaaatctcaatttgcttttgactcaggcgctcctaacagagcaacaatcaagcatcggtccccaggaagacaaggctgtcacgactggaagaaagaagacctgc

SEQ ID NO: 163514 - DNA, 309 bp, Homo sapiens
caaggggacgtgctggtggaggttttctctctgcacagtggggggacaaggacagaagaaaagaaaggcatctttcggcttaattttaaaagaggttcttttttcttcccagagaacagctggagccctggaacctggccaagtcagagcctgagacctgaagtcaggaaccagcacgcctacaaaatccagccacggatcttcctttaattcagtctgactcattaccttcagcctctggcaggttccagaggggttactaatgcagaatccagagccttcttctatttataagccaatggaagggct

SEQ ID NO: 163515 - DNA, 565 bp, Homo sapiens
ctggggttatatggcagtgagaccaacgcaggcaggggacccgcacctgaccctggcccacttggagttaccccagagttacatgagaggctgagtaagaggatcatttaagaccaaggttcaaggccgcagtaagacatgtttatggctgctgcactctggcctgggtaacagagtgagacttggtctaaaaacaaaagcaaacaaaacaggttcttacattaaaaccctgagtttacattaaaacccaggcagaggacccacacctgaccctggcccacttggaggtgccccagagcccctggcttctggcttttccctttatgagtcaaggacaaatgaggtttattctagaaaatgcagctggtctgaaagtggccagtttactagggaactatttcaactttaacacacaggggtccttggcaggttccgagccaaatcccaacaacataaaatgagtggaaagcagccttacaagcttcctcccgattccggaacacactccatcaaaggctcaccaaaatccttgccagtgctgcctcctggagtcggtcagtgctag

SEQ ID NO: 163516 - DNA, 405 bp, Homo sapiens
gagctaaacttctaggaactttgtcatggtctaactctttgtatactactaagtatttagtggatgttctttctctttgtcatatccacttcatatcaacttttatctctccgaataaaaggaatttgaattgctctttagtttgacaatttttcatatatacaattgtctcatattttctgttttattcaattagtagtcatggagaggaaaaaagacaggaataggcacctgtgattgtaaaatattttaccagtaaacaactagtatagaatatcaagggcaactggttataaaatgaaagcctgtagacctgtcaggtggaggtctttgatggctaagattctaatatgggttattaaaagcatgattttaagcacctagaaggtgagtagttggagccaa

SEQ ID NO: 163517 - DNA, 346 bp, Homo sapiens
attaattttgcagggcacaagggaaacagcattactaaatgcttccatttaaaaagaaatactgaaataaacaaaaagtattgaaacaaatattaaaaacaaatattgagttagaaaattaagacagtgattagcctatactttttcaattcagttatcaatacagtcaatgtaattaattctacagatggaatctaaacaagtatcttattgaatatttatctaaagtactaaggaaaatatttccaaggtatatatatgacttgtctgataatatttctattgagatcacttaacattcaactaacaaaacataaaataacatatgcatgataaactcatttaa

SEQ ID NO: 163518 - DNA, 185 bp, Homo sapiens
ggcaaaccccgggctctgtactcttcgtttttgttttgtaacttaatctagcaggacaacgcagttttaaaaaatggtgtctcatacatgggtccatgacagaagtcgtggctatggttaagctaaaaaagagatacttgcagctgttcaacaagggccaagaaatactcccaaggcttgtgcaa

SEQ ID NO: 163519 - DNA, 484 bp, Homo sapiens
ttccttgttactgatttctagtttcattccatcgtgattagaaaatacttagtattttgcatactttcaaacttttaaaacattaatatttgttttgcagcctaatacactgtatactctggacaatatcccacacgctcttgaaaagaatgtgtattttgctgttgttgggttggtgtctgcatatgaccattagatctaattggattatcatgttgttcaagtgctctctttcctattgatctggtctctgtattattaacattgaggtagtgaggtctccaatgatcatcctgaaactctatttctccctttaattctatccttttttacttcatatgttttgatgctctgttgttaggcacatatgttttaaattattatattttcttgttggattaaactttttatcagtatagaattcccttgtctctcataaccattcttggcttaaaacctattgtgcctaacatgtggccactcc

SEQ ID NO: 163520 - DNA, 665 bp, Homo sapiens
aaaattaaattttaaaaaatcgtattaactggaggtaaatggatagaattcgaaataaaatatgtgtcccttggggacataaacctgtgtaatcacttatgcattactatatatacttgatattacaatgtgagcattagagttgatgttttcacttcccagtacataaaactttttcgattatagaggtgtaaactcttgttttacagttttcatttaagagaataagctgtggaattttgaggaacaggttggctatttttatgattcaattatctttgttcgctttgcacttgctgtggcttccatgatttatgccaacagtcttggttttgtcttcagcagaaacaccaggggaagttctcatgacatctctcaccatcagtatggctaacatctgttaaaacagagttgatatgaaattggatagtttttctttttaatacttgatctgggtatggctctgatctcaaattgttaaaacaataaaactacattttatatgatttatgttttttctgattataagaataatacatgcttgttgtataatgtgtggaaagtgctgatcattagtgggaaattgttgaattcatatctaagtaatatgatagctttcctttaatgagcacctactatgttaaggctctttccatgaaatgatt

SEQ ID NO: 163521 - DNA, 520 bp, Homo sapiens
gaccaacctgagcaaaatagtgagacctcatctctacaaaaattttgaaaagttaaaaagttaaaaagttcatggtggtatgaacttgtagtcctagttactagggaggctgaggcaagataattacttgagcccaggagtttgaggctgcagtgagctatgattgcaccactgcattctagcctggacaacagagcaagaccctgtatcaaacaaagaaagaaaaagtataagctattgagccatggaaagacatgttggaagcagaaatgcactgaggaattcttaagtaaaagaagttagcccaaaatggctgtgtactgtatgtttccaaatatataacattctagaaaaggcaaaactatggagacaataaaaagatcagtggttgccagtggggagggagggaggaatgaatgggtggagcataggggagtctcaggggagtgaaagtatttggtatcatactctaacggtggatacatgacattatgcatttgtcaaaactgatagaatggtg

SEQ ID NO: 163522 - DNA, 646 bp, Homo sapiens
cacctccagcaccattgcttccacttccatcaccattacctccaccatcatcaccttcatctctacctccatcttcaccatcaccatcacctccaccttcaccaccaccaccacctttatggaagatccctaaagaaactgagccaactctaggtcggcttccaggctgaggaagtagggcttgattatgttcaagctgagaagtggttggagaaaggggtaatatctgccctcctcactcagtggagcttcagtatctgcacttcccttttctgtagccttcaagttccaggatttttatttttattttttgagacatggtcttgtgtcgcccaggctggtcttgaactcctggactcaagtgaccctccccactcagcctcctgagtagctaggattctaggcatgagccatggaacctgctagttccagggtattttctgtttccctgcacctcctccctctcgccactacccttccatatacagaagaagaaaagtctgcatctctgtgaaagtaggtctgtacctctctgcacgcactggcagctgctctctgtgtctgtagtcttccacggaagccttgtgcaggaggagctgagctgagagacagggctatttatcaatagaaagtggggtaaagtctg

SEQ ID NO: 163523 - DNA, 470 bp, Homo sapiens
tgtcccaaaaccacattctgtggtgagtgtggaaacccctaaactcacccccttcacttctgacgccctggggggaaagcctgtgataaatggaaaggctaaagtccaaggtgggtactgagaaaagacttcccagttgggagttttggtgccaaggttttaggaaaagaaaaacccataagaagctaggtctctattttctgaggctgcattcccagaaacagggcccagcccacctccgggggcctcaactgagcccctctgtactctattgctgtgtgatctccaaggatcacttcacctctctgaacttctctggtaaacagggctaagacccatctggcagggtttgtgtaaagaatcattgaaataatggaagtgaaagctgtaaaagcacttatgcctacgagagggttgagaccccatgccgcacgcaggctgggtgaggacagggaggagaaggaggcctg

SEQ ID NO: 163524 - DNA, 633 bp, Homo sapiens
tttaccaccatcgctattacttcctcattttcccaagtacattttgtgcccattcataaggattttgccaattgatggcctgatccgagaaacttaactaatcacccaggagtgagtgactgtactttctccacgtcctgatggcactttttgtacctcccactcttaattatatcttacttatttctagatcttctaaatagtctgtaaggtcattaagtgcagggacttagtcaactaaatcattttgccctctgtgctatatacactgcctggcacagaatgaacatgcatttactatttgattaacttaaccaaactaacatgaaagaaatcagataaactctgtcatacatattttgttaaatgaagagaccctagctcaccagcctaactttatgtattttgttttagagacaaggtcttgctctgttgcccaagctagagtgcagtgcccaatcaccactcactgcagcctttaactactgagctcaagcaatcctccagcctcagcctccaaaatagctgggactaaaagcatgcaccactatgcctggttattattgtgtgtgtgtgtgtaatttgagtttagtcatatatgacagagtgctgacagtccccaagtgactcgtg

SEQ ID NO: 163525 - DNA, 506 bp, Homo sapiens
ccactaatcacctaaattatatgtatagcctgtgaggcatctttatgatgctttatgatttaacagccttataaccttttgtgctcagtactgaactgggattggactttaattcctaagaagccttcttccttctttgatgtcacattcccttcctctctctagtttacatttttgtattatcctttaaatttttattttaaacatacatacagaaaaactcactcttttgggtgtacagttctgtgagttttgacaactgcatagggtcacataactcccaccacagtatgagacagttccatcacttcaaaatcttgcccagtgcttcccctttgatgttattccctacctctacccctaatctctggcaaacactgatctgtactctgtcactgtatttttgcctatgtccctatatttttgttatataaatggaactctacagtatgtagtttttcaagtgtggcttctttcacgtcccataataaatttagggttgattg

SEQ ID NO: 163526 - DNA, 280 bp, Homo sapiens
aaccaaattttacgtggggatccatcctctctctgcacactggccagaacaaccatccttaacatgcagcccctgggcctgcactcccacgtgacaatagcaggtagcaggtggggtgaggaggggcacacttcacacagggcacatgccaactggccgcagtccccgccactcccaactgccttactccagcctgctgcactcattcccactattgcccggccctgcaggtgggtaggtatagagtccaaggtctaagagaaagttgcctagcgacagg

SEQ ID NO: 163527 - DNA, 459 bp, Homo sapiens
atgtgcggctaggactcaatgagatagggttgatagtggaggaataaatcagaagaaattaagtgtcacagaaactgtaaaaagaatgtttcaataaatagattgtgatgaagatcatcaaatgatggacaatcatggagaagcagtgttaaatattaaaaaggtacatttaagctttggaggcagagagaattgggtttaaatgttatctgtactaactagctgtgtcagctatgaaattcatgttacctcactaaaccttatttttctcacctgtaaagaaggggcaatatgtgtctttttaaagtttggttgtaattaagagcagccacactctctctctctcacacacacacaaacacacacacacacaaatgcttagcaaacaggtgctcaataaatggccactgttgttactgctgtaagacaatagagaaaggtgtgggactagactactag

SEQ ID NO: 163528 - DNA, 345 bp, Homo sapiens
  misc_feature (10)..(10): n is a, c, g, or t
tcatagctgnctcctgaaccaaaaacaagggagcccaatccataatgtgtgcccattgccatgaccgactccctcaacacacacacacacacacatgcaacacctgactcccataaatagctcccccataaatagcttggaccactcccagacccaacctctccagtagggattctcctgacacaccccagagatggtccacgccaccgctgccccggggaggttttctccggagctagggaaagtctaccatcacggttaggagaagtcggaagctcagagaacctctttctccacagctactggtgatctgtgctgtattttagtgcagtcacctcccgcagc

SEQ ID NO: 163529 - DNA, 582 bp, Homo sapiens
ggaactttggatagttgtctaattctggttctaactgccttttcctctcactttatttacaatttatttttacaatagagattgggtctccctatgttgcccaggctgaccttgaactcctgggctccagtgatcctcctgccttggtctcccaaagtgctgggattacaggtgtgagccaccatgcccagccgtccagtgcctttttaaccaaacagtgcactgtgtacatttctagacaagtcctggagctccctgcaggccggaaaaaggggcctccgggaatgtctgacgtgaaggggaagtttcagtcttgggttcagtgctttgaatgaggccgtgtggcagaagtttgcttggagctgtttgctgaggctatctgtctgcattggtggtggtatcacttagtgtatattggggtgtccaatcttttggcttccctgggccacataggaagaagaagaattgtcttgagtcacacataaaatacactgacactaacaatagctgatgagctaaataaaaatcacaaaaaagtctcataatgttataagaaagtcccgttgaagccgtcggggatcc

SEQ ID NO: 163530 - DNA, 238 bp, Homo sapiens
aatattgacatcagtgacaatgctctttatgccagtgactctgaagaagaaggagggaaatcctgtaccctttgcaaaagcctgcaggtgattttgaaacaaccacctcactgatctgggaattggtagccatatagggtagccatagaagtttggggaggaaggaagtgttgtaatcttatttttattttatttatcgctcaaggcattatgtggagaattgatcaaagtggacaag

SEQ ID NO: 163531 - DNA, 412 bp, Homo sapiens
aaagacagtttcacagctgaaattggcaatcaacctatgaagacaatcacttaatagcaaaatgctcaaaaacctggaagatatcaattatttgtatgttatcttttaaaagccatggatgaatgtcagatgagccaccttccaagaaacagcatagctgaagaaatactgtgttaatagttgctccaggaccaaacccattctcagcacagaatcagagttttgcaatctgctctgactcacacaaacgttcaaagagaaaactttactacccagcaggtgtcaggctgaaaggtaaagtggccacctacactggtacctcaggaagaatttgctagtcatgccttaagtcatattaaaatagaagaacgaccttcttttttggagacagggtctcactctgtcacccggg

SEQ ID NO: 163532 - DNA, 254 bp, Homo sapiens
agtaacttggcattgaattgacacataatgaaggctcagtaaacattcatttttgttaacctgtggggtttgatttaaactcaaggggaacttgaaggactctttctcagggacatgagttgcgcattagaagacgaggttcagagccaggcactgtggctcgcgcctgtaatcccaatactttgggaggctgaggtgggcggatcatgaggtcaagagatcgagaccatcttggccaacatggtgaaaccctg

SEQ ID NO: 163533 - DNA, 152 bp, Homo sapiens
tggccaagtaaaaaacatttttctgcattcttgctgatgctgagggccagtctcctttttctgagtatagtcaacccctcctcccaagccatcactgcccaacaaaacagttattaaaaatatcccagcattcatggtaaccataccttccc

SEQ ID NO: 163534 - DNA, 520 bp, Homo sapiens
tctgcaactagtgcgtagtcatacatctcagcctcatttttttccatccttaaaatcaggcaaattggatgtcataatctctaaacttccactaacaacacagttttcaccaacaccaggaatataagcaaatctcaaactgtgaacaggtttctaaaaagaactaagacattgcttttgttgttttcaaaagaatttcagtttaaagaaaaaggaagccaaaaatacttgttttcattatgacaccaaatcctaaagggaaagaaatagatttaatgccaaaaagatgtcagaataaccagctcaaaagctagaggtcacccaatacagagtaggaactaacctaggcagcaagtgtgatggaagttttaaatagcaaatgaaaagattatataataatgagctgtcaaaggcagaattaaaactggcataagtcaacttcaagaaagaaatggactgtaatcccagcactttgggaggccgaggcgggtggatcatgaggtcaggagatcgagaccat

SEQ ID NO: 163535 - DNA, 159 bp, Homo sapiens
gttgtaatggaaacggaattctgtatccattcaaagagcaaaacagagatggaaaagcaaggacccacattttaccatgtgtggccactttctgaaagaatagtcaagggactatccaacaaaacataacaattctaagagatacaatgtattaaagaa

SEQ ID NO: 163536 - DNA, 415 bp, Homo sapiens
tatcatcaaaagtagcatcacttagtctagagcagtggttctgggctaagtctaggtcctgcttgtccatcacaattacctgtggagtttttccaaaaacttgcttagcatcctaaggttgcagcttcatacctaccccagggcttctggtttaggactggatgggatctgtatgtgtgtgatacagacatctgtgtgcaaaatgcacaggaaatactacctggcccatgatcccctatccccaaagaatagacgggaaggaaagggccatttgctcgtaggttcttttttgcaagaaaatgttcacctctaacagctcgactctggtttagtgacattccctgacccttcccactttcttttctgcacactgctgttaccactgttatctctaggcagaggtgtgccaaaccac

SEQ ID NO: 163537 - DNA, 314 bp, Homo sapiens
taacttcctgtttcactcaaaaatacagaaccaaacacagattttccacaagctctccaactataacctgtgtgcactgtgcacatatattctgccttgctttctcttactatggagaaatcatccatattgccattaaatacccctcattaggccaggcatggtggctcatgcctgtaatcctagcacattaaaaggctgaggcaggcggatcacgaggtcaggagattgacactaccctggctaagatggtgaaacctcgtctctactaaaaatacaaaaaaattagccaggcgtggtggcacacgactgta

SEQ ID NO: 163538 - DNA, 693 bp, Homo sapiens
agcataccatccaattgcagtaacccaaaatgtctccagatattaccaagtgtccctgggggtgaggaggacaaagtcacccacctattgagaagcactggcctcaacagtgtgcttagccaaggcttctgggagagggagttatcttaacaccaatgaacaggctgcagcaggtttcagatattttacttcattattttatttttgtggagacaacatcatgctttgttgcccaggctgatcttgaactcctcggctcgagcaattctctgacctcagcctcctaaaatgctgggattagaggcatgagccaccacgtctggactcacagatcatttcttcagtccagtggttactccatcctgcccctaaaggagaaggtagagaagcatcaccctgtccttaaggacagagtttttattttttgtttgttcattctgagacagagtcttgctctattgcccaggctggagtgcagtggcacgatcttggctcactacaacctccacctccgggttcaatcgattcccatacctcagcctcccaagtagctgggattacaggcatgtgccaccatgcccagctaatttttgtatttttagtagagacaaggtttcaatatgttggccaggctcatctcaaatgcctgacctcaagtgactcacccgcctcggcctcccaaagtgctgggat

SEQ ID NO: 163539 - DNA, 427 bp, Homo sapiens
tacccctcacgttttcttttcacttgatgaggcttcatgaggaataattttcctccttaaaaaattctgaagcaaggatattattcctgtaaatatctatgttatccatttcattctataataaggtataataatataaataaatctttcaaattagttctgttaaaatattttttcctctgataatttagaaaatgaatctaatttcacaactacctctagggacaacattgagcttttttcatatttgtaatttctttagctctaatcactataatttttaaggtggttcttcacaggccatttctttggtagcccaatgatacaaatatcttagagtagcctccttaacacttctgaaaccatctttagctagcaccaacaatttaaaatgtccctaaggtctatatcaatgttcaagaatagc

SEQ ID NO: 163540 - DNA, 185 bp, Homo sapiens
cagttccgttcttgatcatattaccagggtgaggccaagccctcagtcttcacattttcattagacctagaaaaacaacgggaaacagagagcctgtgcctattgcatctgcaagagttttggttcaacctctgtgggtccatcttttcttgatacagtgggctcatacagagaagcactgatat

SEQ ID NO: 163541 - DNA, 977 bp, Homo sapiens
tgacagctaaatgcaatgtgggatcatagatcagatcctggaacagaaaaagagcactggagaaaattggtgatattaaaataaagtctgtattttagttaatagtattgcatcaatgttaatttcctagttttaatgaatgttaggtaagatgttaacattggaggaactgaggtgaagggtatatgggaaccctttgtactatctttgcaagtcttctgtaagtctaaaattatttcaaaaagaaaaaattaaaaaaagtaaaatggtatgtaaatgatacatgaattgtctgcttcctgtggctgacctgtgccttctggaaagttctattaggttttaatactttatgtagtaaaagttaaacatggtccctatgtagaaaattatctcttcagaaagataaataccagtagaccacaagctccttgacagtggaatccacctttttttttttttttttttttttatatagacagtaggtctcactctgttgctcaggctggttttgaactcctggcttcaagcagttctcccacgtcagcctcccaaagtgtcgggattacaggcatgagccaccgtgcccggcctatagaacatcaatcttttggactcttctcactttatatctccccatgcccaaggtttgcctgttccataacactcactctcttcccccttggctaatcagaaagccattctccctcctcagggtctgatctcggcgtcttccataacatgattcaccgttcatggcggtacacgagcgcttcgctcacctccatcgcagacaatcctaatgggggctcccaattttcccaggctctccagcaacacccttgtcgcgcgtgtcgcgatttttcacaccgtccaacctccctggtaccaccaggttggattcgcccgccaaccggccttcactcctcaatcgcgacaaccggcccgtcacgcggacacacacccaccaacgcctcctg

SEQ ID NO: 163542 - DNA, 580 bp, Homo sapiens
atagtaagtacttggctggttccttctatcagtggtggaggaatgggcatgtctatagctttgggacttcttttatgtggagtaaaaaggaacaacctttacctcacaccaaaggggcctctatgtccaccctcttgggtatcatatcatgttttgtggaaaggacacttggtgtcagaagactttggtgtgagtcctgattcaacacatttttactgcatcctcttggaaagttcaccttatatctctgaatctcactttcctcatctgtaaaatcatgataatactagtaatagttatcccatagggtctttgtcatgacaaaatggggtcacatatagaaagcaccttatacagtgcctggcacaaagtaggattcaactaatattggttactgcctgcctgtgagcatgcatgtgtgaacacaaaagtgaacagttatcagcctgtactccaccacaaagagatgcgtggactgtggattcaggaattccttatgaaaatcacaactctttgcttaaattaaaatatttacttggctgggtgcagtggcccatgcctgtttcccaccactgtggga

SEQ ID NO: 163543 - DNA, 384 bp, Homo sapiens
tttggctaaaactgggtcactggtatacctctttcttcaggcctggtgcagcgcacatgcatcccgtgactggcttggaccattcatgatttattccctaggacgaggagacagtttgccttctctgaggttaggtaatctccaccagagctacataaacataaacctagggatataaagcaggtaataatgaagtatgattgtagggtagaaaaaagtctgaatacggttattccttagcttttgtgattgctccatgtatctatcaatctagctttcactgcacttatctagctatatatgatctctcatatataaatatatatatacactccaccttgtgacagtttaaggtaataggatttttcttttttgttttttttt

SEQ ID NO: 163544 - DNA, 472 bp, Homo sapiens
ctggaattgtaggtttggccaggagtttgccaggattgctcgaaggtcatcttccaatcccaggaggctgggggtaaggggaggttcatcatagttctcaaaatagatctgttgagccccccccccccccagattacatgtcagctacaaccagtaaatgtggaatttgaggcctggggttagcacaagagagccctccagttgccaggagtaaggtagggctgccagaataccagtgacccagtgatcaccctgtccctgggccccttcttaacaagcccagatgcagtgacagcaaaagctccagaatcccaaggcaggaggtgccaaaaacaccccccaacaaccattaccaaaaaaaattttcagtaaaatgttctcacccctagaggggaaaacctgtccatgcctgaagcagcttgaccccagcaaacaccctgcctccatggagtgaactgcaaatctccaaaaa

SEQ ID NO: 163545 - DNA, 495 bp, Homo sapiens
cattgacttcaggatgtgtgtcattctaagttcctgcaacttttcaaacacccctcgggctagcgtgtggctgcacggtgtccatttgtgcaggccaccactcctcttgcatctgggtctagccacctctccttcttgacttaccatagttcattttgtaccatgctttcagaatgagctttctcaaatccaagtctcaccacggttcttcccagctgaaaacccttgtgcggttccctttgcctcacaggataatacatggtgtggcttacggaaccctgcaggtctggccctaggcccctggacacagacctctcaccactcttggaactttagccaggacaaagttttctgtttttagtttcttaccatgttctctgggccgaggagtcccagtgcccacgttcatcccacttgcaggcacccctggacggctgcccccagctccccaactgcctgcattctcccctgccctcctcactctgttggaatagc

SEQ ID NO: 163546 - DNA, 240 bp, Homo sapiens
ttcctgtggaactgagcttcgactggtgggggacataagaggcagccactggtccaaccagccaaggcctaaagctcgcagaagagaaattctcattagcagaattttcagtcgttggagctgagctgcaggatgtttgagtgtggacacctagcacaaaatgtaccaatggggggctggtccgagtctttagtcccctaccatgctccctacctctgtactgtgtgctcctgtcactct

SEQ ID NO: 163547 - DNA, 158 bp, Homo sapiens
accgggcggggcggggggctcctaaaatgtgctgcacagtcagccgtgcctctgttgctcctcagctcatggctcaggaaggccaactaacgcaaggaaaacaaactccaaagcaaggggatgagagcacacagatggtcacgagtcggatattccgg

SEQ ID NO: 163548 - DNA, 639 bp, Homo sapiens
gattgcacaacccaaagaaaatgtatttgagaaaaaagctgactttccgtgatcaataaggttgtggtgttttaacttgtcctgtccccattttcttctcagctccacagtagccttgaaaatcagcaaccttgagaccacagtagctgtgacaaccagtagcctagaaaccactgaaggaatttagagtccccccaagataggtttggagttatccaagacgccccatccccagagatttgtcactccttgacctgtctggcagctccctggaatagtcccaatcacagggcttgtcttcatttaacccaactcaggtcactcaatgaggaaactatcctcaggttgtttgttataaacaattggtggcaataatttaaatagcacagttgcctgacatggctatactagttgggacaaatgagactggccagaaaacttaaaaaaaggggagtgtgatgtctacagaggctttgaaaagtgccaaaatattcttgggagctagaaagtcaggtaaaggtgagagacttatgcttcaaccacttaaggaaatccctgtctaatcatatgctcaagactaaagtaaccaagcagagattttggtgactgcaacatgacaaagaacacagactaaacaga

SEQ ID NO: 163549 - DNA, 590 bp, Homo sapiens
cacacccatctttgtagagttgtaactatagttatttaaattgcatggtggtatgtctagtacctttcctcgactaattctattaagtctgtgttcttagtcatgttgcagtcaccaaaatctctgcttggttactttagttcttgagcatatgattagacagggatttccttaagtggttgaagcataagtctctctccttgacctgtctggcagctccctggaatagtcccaatcacagggcttgtcttcatttaacccaactcaggtcactcaatgaggaaactatcctcaggttgtttgttataaacaattggtggcaataatttaaatagcacagttgcctgacatggctatactagttgggacaaatgagactggccagaaaacttaaaaaaaggggagtgtgatgtctacagaggctttgaaaagtgccaaaatattcttgggagctagaaagtcaggtaaaggtgagagacttatgcttcaaccacttaaggaaatccctgtctaatcatatgctcaagactaaagtaaccaagcagagattttggtgactgcaacatgacaaagaacacagactaaacaga

SEQ ID NO: 163550 - DNA, 112 bp, Homo sapiens
ttcaaagagactaaacacttattttgagaaacatcagggaatatggatgataccttgtggtgagaaatgaacataccagataatagataaaatattattaaattcttctagt

SEQ ID NO: 163551 - DNA, 586 bp, Homo sapiens
atattataatggaaaattccagaaataacacaattgataaattttaagttgatcaccgttctgagtagcatcataaaatctcatactgtcacacttggtacctccttcatcagaagaagggtgcatacagtacaacatgatattttgggagaccacattcatataactattattacagtgtattgtgataattgttctattattagctattgttaatctcttattgtgactaatctataaattaaaatttatcataggcatgtgtatataggaaaaaacagtatagggttcagtattatccgcagtttcagtcacccatgggaggtcttggaacacagcccctgcagataaagggggaccactgtacattttgctacaatctccagtgtttttgagaacacccttagccttggacttttctaggtgtgttgcaaatgaagtcagttcctttgggaagagattaggagttgtctgctttgtttcctgtcctggctggctcccctaccccagccccgcccttctgcctctcactcagggcaatctctgagccaaggttttggagctgggggtggggacaatggctcat

SEQ ID NO: 163552 - DNA, 307 bp, Homo sapiens
gataattaaaagaaaaaaatatttaacacaataggtgcagaaaaagcatccaagaaaatgcaatattgacaaaaatattctcaatacactagacactgatgaaacatacctcaaaataatgtcatctgtgacaaatccttagccatcatgatactaaaacaaaaatggatgcattctccataagaataaaaataagaatatccattctaaacagtcctactgaacatagttatggagtcgtagccagagaaataaaaggaatctgaatagaaaacgaagtcaaattatctttactgatgatataatt

SEQ ID NO: 163553 - DNA, 517 bp, Homo sapiens
cggacagatatgcagagaacccaagtagcttaagaaaacaagtgttcataatatcaccatctgcttcagtcgactttttgagaataacatcgtacagtctgaatcccacagatgttgggttccatatttcctcttcatagtcttgtcttctcagtgttgcctgcaggtccacgggccttactgacctgtggatgtggatggagcatataatccacaacaatccacattttctgtttatgcacctccctgctcctgcaggacctctagcctccataaagtctccctaatctttttatgtccgcgtccccaggaatgtcttctatgtacatgtgaattactgtatcagctagttaccctgaagagtcttctccatctctgtctactgcttgctccccttcttcataaaacctctgtgaggggctcatcattgagattctaactccagttagaatcctcatgtcacatgtctagagagatcgttcagagccctctacgttgccagcccttgaggagaggg

SEQ ID NO: 163554 - DNA, 488 bp, Homo sapiens
tgggagagccccccagaccctcaaaaagaagggagtagcagatgtcagtaggggtaggcagagggactggaataatgcctcgccataacacacagtactttatagtttaccaagcacgtgtacacatgcgttgtctcagtgaatcccactgtggttgagaggtgagctctggaagccaacaacctgggtcacacctcgcgctcctatttcctggccgtgtgacttatgactcatgacctccttcccagtgtctcgtttgcttttcctgtaaactgggactacctcataggtagaataacgcctggcccagagcaaaggccactaagagctagctatgaacaaggattttgtttcatctctgcgtggttgctgaagtaggcactgcaggcaggaggtgagtggatgtgcctaaaggcactaagtgcgcatcctgctacaaaactgtgaagccagggctccttcctgccacttaaaggaggagtggagca

SEQ ID NO: 163555 - DNA, 398 bp, Homo sapiens
aaagaataagaaaaagtttggtgtagaaagtgataaaagagtaaccaatgatatttctccggagtcgtcaccaggagttggaaggcgaagaacaaagactccacatacgttcccacacagtagatacatgagtcagatgtctgtcccagagcaggcagaattagagaaactgaaacagcggataaacttcagtgatttagatcagattaatactaacaagagcaaagatgcatctacaaaccccccaaacagagaaacgattggatcagcacagtgtaaagagttgtttgcttctgctttaagtaatgacctcttgcaaaactgtcaggtgtctgaagaagatgggaggggagaacctgcaatggagagcagccaggtgataacgtttgtttcttttg

SEQ ID NO: 163556 - DNA, 390 bp, Homo sapiens
aggatccacatacattgtctgatgacaatctcatgataaaacttgaattgatgacaaatttcttctactggatgagcaaagaaaatggtttcttttctttttgagacagtctcgctctgtcgcccaagctggagtgaaactctgtctcaaaaaaaaccaaaaaaacaaaaaacaaaaaaccaaagatataaaatgagactttctgaacccagcattacaggagctaattcaaattacacataataatcaaaagttaacttaaattttacataacaaatatagttaccctgagccctttagtaaatatttaaatcctcaacttctatcaaacttgaaaataaccagtggaggccaggcgcagtggctcacgcctgtcatcagacaatgtat

SEQ ID NO: 163557 - DNA, 373 bp, Homo sapiens
cacccaaaacaggtcatagtgtatggtaaatgctcaaaaaatgttagctcgtacttattgccactttacaaatgtctagacatttctctttacttttaggtgataagggtttacaaactttaaatgccatattccatcaatttgaagatgcacatttattagcactgatggtatgttaaatacattgattctaaagatagaaaaatttattgttcaaaaaaccatttatgtcaaagccagatataatattgatgaattatctattgtttgaattatttcatctagttctcatatttcccaagaggttacctcatatttcccaagaggttatcctgagggacaagaatacactgacagtgatggtcagggtacc

SEQ ID NO: 163558 - DNA, 624 bp, Homo sapiens
atctctggagagtctgctggctgcgcatcaaacacggctgtgcttctgggcatgatatatggatggcaagccagccccgggcaggagatagaacagagaggatgctgggattacaggcgtgagccactgtgcctgtcagagggtaaactttgatggttgttctcagttggtcgttgtcaactttcaatggctgggcactagcttcatcttcaaggctctcgtctcctttgaaaaacttcttgaaccactactgcactgtgcattctttagccattcctgggggcaaatgcgttgttgatgttgagagttgtctccgctgctttaccacacattttgaactcgaataagaaaatcgcttgaatttgctttttgtctaacatcatttccatagtctaaaataaaataaacagcaagtaataagtcattagcaaaaaaagtgaaagaatgtgcattaaaatgatgtataacataaccacatttatttaagaatgtattccaatatcaaatggcaaattccaacagtgcaaaaacttacccctgaaaacaggcatagtcactttcaaacttgatttttctttcattttactctaccttttcatttaatgaaacacctttgcattttat

SEQ ID NO: 163559 - DNA, 403 bp, Homo sapiens
cacacgtgtagtcacaaccactcaagaggctgaggttggacgatcccctgagcctgggaagccgaggctgcagtgagccgtgatcacacactactgcactctagcttgggtgacttttgagtgagactctgtctcaaaagatgcaaatagcacaagtcataaagaaaaagaccagacaacataaaaagatcaacatcactagttatcagtgaaattaatataacttattctcatcaggtaggcaaaaatgttaaattctgagcccatcaagtgtaggcctctgtacagagaaataggtaccttacacactgctgatatgactgaaaaaaagtcaaacataaagaaagtaattaatttggcatactttagtaaacttaaaagatactcatattccatgcaattc

SEQ ID NO: 163560 - DNA, 578 bp, Homo sapiens
ctaggttctcctgtgtctctttcttcctttgcagccaggctggtgttaaacctggagtataagtcacctttttataaagttaacctaagacttttcagtgctgaagatggagctatagggttaagtaactggaaaggtaacatatttccaaagccatttcagaaaatcagtcttggcgttaagttagagtgaactattccattctctccctgctatacccattgataccccatcctaacccagacaccttaggcgcctatataaggcgcctaggttacattggctaggaaccttttgccaatgtgtgaagatttgtatataggttccatattctccacctgtaaagtcagaggactaagttttaagcaagcattaaaaatatataggctcaggagcatgatttggattattctcagccccagaacgaacatggaaattagaaagccaggaatgcaaggaatacagatcattcatagaaagaaggaagagaagggggaccctaatatagggcttagttttttaagatgaagtctgtcatgtcacctagcgcctatagggatcctctagaacagccctga

SEQ ID NO: 163561 - DNA, 208 bp, Homo sapiens
ccttgctgcttctctatctgcctctgactgcctgtctctgtctccctctcctcttctgctctccctcctccacaccaggcttgcaccaaccccagagatgaccgcaaggccttcctgccccactgagtagtgtccacagcatgtcctgagtagcctgcagccaggagatcagcccagaccctggaccatccccctgcctcagccacca

SEQ ID NO: 163562 - DNA, 404 bp, Homo sapiens
ggcttccagtctgtgaagggatagggtgggagacatggctatctcttccattagacaaggattctgacaaatgcaatgctagagagtctccacttcattctgtgaaatacagtaggaatgtggtccattctggattttatgagatgttggtgagataagagtatgacctgtcggtatggcaagagattaggcaaaagattacttaggttctaattaaggcatatttccagacatctcaatggttacaacagggatggaggctgacagaatcaactcagggaggaaagagagagagagaaaaagaaagtaaactaagcaagtaagtgaaatacaaacctgggtacaccgagaaatccataaatttgactagcttacttcaaagttccttgactacttctgtgtca

SEQ ID NO: 163563 - DNA, 499 bp, Homo sapiens
aaaattattttccaaaggcagcaatagtgtaatatggatacttcagcactgtctagttgaggagacctatgactgtcttgaggagtgtcaccttggagcagttcataaagttcagaaaaataatggggcaattattcatgtcacttctggctgatccaagagcattgatggaaggcactcaccagacatcaactagaaagctaagatgtctctttatcacagagcaagtgatgggcagtctatagactttgcttcaacttgcacacatttcttagtatggaccataggtgggtttggcagtatcttattgctgaattccttcttcctacctactggctccctccaccccaccaggtttattggctttgtgctagatctcattaccaatccaactcctttttctctcccagccagaaagactgtcatgtggtctcttggagagaggctcatttagttcatcctcatattcttgctaggctgttttaataacaaaaacaca

SEQ ID NO: 163564 - DNA, 249 bp, Homo sapiens
agagaggaagcatgaagggcttgaggggaaggagcaggactgccagcatgagggcccttttgaggttgagagccatgtccttagaccaggacctcagcttagttgcgtgggtttcaccagctgcattcaggtactaagataggcaaggagtgggtatagtgttgtttttagagggggctgggattttaaggtagcagacactattagcttctttattctggtgctgtaatagcttgtttccacatgttg

SEQ ID NO: 163565 - DNA, 341 bp, Homo sapiens
acactacccctcatgccttcttctcataagaacccttgtgatttgtctggacccacagaagtaatccaggataatctcaagaacattaacttaatcacctgtgaagccctttttgctatgtagtcatacctcattttattgtgctttgctttattgctctttgcacatattgcctttttacagattgaagttttgtcacaaccctgcatggagcaagcctatcagcaccatttttccaacagcatgtgctcacctcatggcttggtgtcacattttgataattctcacaatatttcaagttttttattattattatattttttgtggtgatttgtgatcag

SEQ ID NO: 163566 - DNA, 604 bp, Homo sapiens
acaaagtgacagctaacatcacacttaatagggaaaagctgaatgcatttcctctaagaactagaaccagacaagtatgccaacttttcaccattcttactcaacatagtactggaagtcccagccagagcacttaggctagagaaaaaaataaagggcatccagattgcaaaagaggcagtcaaatgtccctgtttgcagacaacatgttcttatatctagaaaaacctaaagactccatcaaaacaatcttagaacttataaacaaattcactaaagttgcaggataaaaaatcaacatataaaaatcagtagcatttccatacaccaataacaaaccagctaaaaaagtaaccaagaatgcaatcccatttacaataagctacaacaacaaactctaagaataaattgaaccaagaaggtgaaagagctctacaatgaaaattacaaaatactgataaaagaaattgaagaggacacaaaaaaaattggaaagacatcccatgttcatggataggaagaatgctgttaaaatgaccactgtcatcccagctacatgggaggctgatgtggaatcatttgagcccaagagtttgaggtttca

SEQ ID NO: 163567 - DNA, 311 bp, Homo sapiens
accaggatttgaatcccggtctgtcgggatctttccactatgccattctgtcttccatggaacttgttctgatcagtatatttcagaaagaaattccaagaaaagttttggactagtatattaatcatatttgactctgggactaatcaggtacgagaacaatcttcatttgtaaatggaataaacatctagtcttctttttaaatagtcttggtcatgatctcaattttttttaagtacatagcaattgatgtttgtttctttagttctagtcatggtagggatttagtagaacatgtatatgatgcagt

SEQ ID NO: 163568 - DNA, 216 bp, Homo sapiens
gtgctaccttttctttggtaggctttcatttggtctcttttcgaatcagaagacccagaaaacttggatccacttctggctctcatccctctgggcagtgtgatttggagtaccgctttgcagtctggcagctttcctattgcactccgaggacaagctgaacgcctcgctcggatctacgaggcctgtgtgggaatcccgcttccactggcttca

SEQ ID NO: 163569 - DNA, 366 bp, Homo sapiens
ctagcacactgccacatctggtttcccggaggaacttcacagggtctttgttctttatctacagtctctggaagtctcagcagcctcctgtgttcgcaactgtcattccagagcagccgtctcgtgttatgcatttgcttactcataagcaaatatttcacaagaacctgcgagggccaggctgggccaggcaggtattgcaggtgcaaggatctatataagacagtgccctttagaagatccctgtctcattgagaagcgttgagtaaatgggtctctctggtcattctctccagaacatgaagccaaagggctgagagggagagactccaagaatgaattagtgtccagcaaggtatcgcttgt

SEQ ID NO: 163570 - DNA, 154 bp, Homo sapiens
caaacctaggtgcttcgattccagtctgaaatgaagcaggaccccctctcggcaggagccataatgtgggactgaacatattctgtgcctggcatggtgggtgcttcacgctgctttggggaacttgaaggcagtgggaaggaagggaaagggt

SEQ ID NO: 163571 - DNA, 216 bp, Homo sapiens
taagttatcttttctggagtctgttcagaagctaaatttgcttttttgttttatatttaataactatcaatggctgttattttgaagtcaattaataaaaggaaagtttgctagtaggagatgtcacagaattcatgaaagccctttgacaatttgctacgcctcttgtatgtactgggattggatatagtgatatgcactatatccaacagggga

SEQ ID NO: 163572 - DNA, 576 bp, Homo sapiens
ctcctggtattctaatttttctttatctaattttggggataatggaggtacaaaggagttgttggtttggtggtgtttttcttccctttagctgtctttaggcagaaatttgttttgtaagggccaagaaaagagggctcttatcaattgactccaggccacccctggtgagcagaagagaccacctgggctgggctgctcaggacctacttgagataagggaagaaaagagaaggtgcatcatagctgaggagccatgaggtcaccccaggccctagttcctccgcaggaatccagagtcacaacaattctaaaggcagagcaagcccagcgagaaagaaataactgaatttccaggaactgcactctcatgattttctgggtacttttcgcctgggagacatcagctaagacatcgaataataaaagaaaaatggcagtgttaacctaacataaaatggaataaaatgacaaacacttcatccgctctaaaaaattcagagctttccttcatcaacaacccatcacaaaaccgtggactctcaatagaaagagttggaatagagtctaacatgg

SEQ ID NO: 163573 - DNA, 158 bp, Homo sapiens
aatctgaggccacaccaaaaggaattagataattcttccttgaaagcctataagaagaaaaaatggtttatgaacaaataactacagaataacaagaaaagtatcaaacagaacctagatggtaccttgttgctttaatcatacattatcttaataaa

SEQ ID NO: 163574 - DNA, 251 bp, Homo sapiens
taattgtgttaaattactattaagagggtcaagtaatagatgttaagtaattttttggattaaatagatcttatcaactagataatagagagattaagagctgctttgcactcaggtttcatgtttttattgcaaagatcaattgtgcttacaagaaaacactgaaggaaattggggattatatatactaattaataacatccagagaatgataaaaatatcagtgtttgtattcttgctgtgacaaaata

SEQ ID NO: 163575 - DNA, 117 bp, Homo sapiens
ccatacacccatccacacatccacacataatacatgcacactctcccactcatttattcagacacccatgcataaacacataatccatgcacactctcccatacatttatccacata

SEQ ID NO: 163576 - DNA, 235 bp, Homo sapiens
aactgataacacagaaatacaaaagatcatcagcgactattataactgtatgctaataaactagaaaacctagaagaagtgaataaattcctagatacatacaacccaccaagattgaatcaggaaaaaatagagaacccgaatagatcaataatgagaaatgagattgaatcagtaataaaaggtctcctaacaaagaaaagtccatgaccagatggttcactgccaaattcta

SEQ ID NO: 163577 - DNA, 430 bp, Homo sapiens
ggagggatgggggtgcggggcacctgggaggttgagctaagctgtggagtagggaatgacctcccagcccctccagctcccgcagtcaggccagtgagtggcaaaacaagcagctgcagcaggttgcctgaggctcccaggcagcgtgaggcacacccagcccagggccggccctccatgcggcctggggcagaagtcccacctctccaagtctgcagaaccaggcaggggttgacccaccgggctgtcccactctgcgctatgtccctcagagcactgagactcaagctggggcacccccaaaccctgcacatctccacttggtcattcctaggcttcaaaagggcccattttcccatcccttcgtcagctcagctgctctcaaggctttctattgtccacactcctctcaaactgtggcgttcttgca

SEQ ID NO: 163578 - DNA, 200 bp, Homo sapiens
aaggtacaaaacagagataaccatcaagtagataaaataattgagtctccaaataagaaagttacatctgtgtaaggttttttccccttcctaaagcaattaataatttgtatctgattttttattgtagtttttataataaaagaagccaaagaaagcaaacagactggacgtggaggctcatgcctgtaatcccagca

SEQ ID NO: 163579 - DNA, 424 bp, Homo sapiens
cgccctgtgtagctgtgcagtctcactttgatcaaggctttgctgtgtatttccaggaagcctcttccgccactgagcctcggtctctacctggaaagttaaaaggttgcgtaggcctgacatcctgcagctcttggggggcctaaaactctggccctcccaccccaccttctggtcagttcaagctctaccccagccaagtccgattccgaagccctgagggccagaccgaatccctccgaaagtgccaaataccccgccccagggcggtgctcagagcctggggcgtggccggagtcccaaggggcggggttccagtgggggggcggggccaagacctagatgcaggcgtgcgcggcccgcccagaagcgtctcgcccagccaatgagcgtccgagggcggggaagccccgcctctgggtat

SEQ ID NO: 163580 - DNA, 396 bp, Homo sapiens
ccagctcgtaccccgcaactgctcggaaggtgtcttgagattatcatccgctgagggtggaagcggcccccgcagacgctcagcaggtgtcttgatattatcatctgctgagggtggagctgagggtggaaggggagtgagctgacgctcggaaggtgtcttgagattatcatccgctgagggtggaagcggcccccgcagacgctcggcaggtgtcttgatattatcatctgctgagggtggagctgagggtggaaggggagtgagctgacgctcggaaggtgtcttgagattatcatccgctgagggtggaagcggcccccgcagacgctccccgcagacgctcggcaggtgtcttgatattatcatctgctgagggtggagctgagggtggaa

SEQ ID NO: 163581 - DNA, 461 bp, Homo sapiens
tctgagctcaatcatttctcaagtgcctttaggttcaaagaccttgtttctctgaggttttcttcaaaaatacaaatcaccctgccacacttacttaaacttgaaatagtttccaacacccctctctaaaacaattttcagagggcagaaaattgagccaatgggagtcagatgggagaaaagcaaaagacatttagtagctttgacactgccttggagaggccgtggcagaagacaaactccggatatcctgggcagtggcaggcatctgcaaagagaggccagatagagaaaaggtatgaaaggcagtggaagaggctgctttgtaatattgctgtggccaggcccccagtgatatttctgagaaatgttctgttctttgaggccaataaggattgtatggtctgcagctgactggagctcttctttccctgggacctgattgcctttctgggcaagga

SEQ ID NO: 163582 - DNA, 352 bp, Homo sapiens
gggtacctgcctgttgtctgcatgctctgggaggtgccctctgcagctgtgatttcccagcactgaggccagcttcacacctccaaggtgcactgaagcatgttttcatcgtggttcttttatccaccctgtttgcagtcacccctcttcaccattcaggtcatccctgaggtctgggccagcattcaggaaatactggcagcaaaaagtcattgttattttaaaagcacatgtcatccaattataaagttataaaaaatatttgagctctccagccttggaatcattgtcatttgtataagagctccctgggtttcatttcagatcttctctattgtttagaagaggtagg

SEQ ID NO: 163583 - DNA, 358 bp, Homo sapiens
gttaaataagttaatactgaaaggtgcctagaaaagtgcccagaatgtagtaagcatgatatatgagctgttgttgctgttattattgctattaaagaccgagtgcatggaacacagatgcaaacctcctccctaacttctcccatatcttcctcatgtaaactgctccagccaagcgatttatctgttgttgttgttccatacacagcttttttgtttgttttgtttttttagagacaggattttgctctgtcactcaggctggagtgcagtggcatgatcacagctcactgcaaccttgaactcctggcctcaagcaatgctcctgcctcagcctcctaagtacctgggactatgg

SEQ ID NO: 163584 - DNA, 424 bp, Homo sapiens
ccactgtgacctatcaaggacatcaccatgacatgacataattagaaagctgtgtgtggcagctgcaggaaaaagatgtaacacagaaaggctgaacaagaccaagcagccagccgctcagggacacccaccctggtgtgctctataacaaaggccaagggaatgatcagtcagggctgtgggctcactaggcacaggctgactcaggacagaatgggtggcagatactctttttaactctagaaaagtcacccaaaatccctgcagatcctgaaatgcttcctccaggccaatgtcattatcccactggtaataaaacacctcccttctgttgacggctttacagttataaagggcttttatctacgtaatctcatttgaagagtcattccgtaacaaaaatttttgagtatatactatatgc

SEQ ID NO: 163585 - DNA, 1254 bp, Homo sapiens
ggcccggcggccgccgccgggaaccacctacgcgcaggtcaccgtctccaccgggcccggggcgccctgggaggaggatgagatccgcagggaccgagtggaaccccagagcgtgtccctgtcgtggcgggagcccatccctgccggagcccctggggccaatgacacggagtacgagatccgatactacgagaagggtcagagtgagcagacttactccatggtgaagacaggggcgcccacagtcaccgtcaccaacctgaagccggctacccgctacgtctttcagatccgggccgcttccccggggccatcctgggaggcccagagttttaaccccagcattgaagtacagaccctgggggaggctgcctcagggtccagggaccagagccccgccattgtcgtcaccgtagtgaccatctcggccctcctcgtcctgggctccgtgatgagtgtgctggccatttggaggaggccctgcagctatggcaaaggaggaggggatgcccatgatgaagaggagctgtatttccacttcaaagtcccaacacgtcgcacattcctggacccccagagctgtggggacctgctgcaggctgtgcatctgttcgccaaggaactggatgcgaaaagcgtcacgctggagaggagccttggaggagggcggtttggggagctgtgctgtggctgcttgcagctccccggtcgccaggagctgctcgtagccgtgcatatgctgagggacagcgcctccgactcacagaggctcggcttcctggccgaggccctcacgctgggccagtttgaccatagccacatcgtgcggctggagggcgttgttacccgaggaagcaccttgatgattgtcaccgagtacatgagccatggggccctggacggcttcctcagggtgagtggccctggggctgccaatgaccactttattctgtaaagcgggcaggggtccctcacttttctctttggtagggcttggaattggcatcatccccactggccgggctgacctgtggtcacagggtgaactaaagcctggcgagagctaggtgaccgccctggtgtcacacaacaccaggggatccaagcgcacagccctggcctcagtcttctccctccacagcggcacgaggggcagctggtggctgggcaactgatggggttgctgcctgggctggcatcagccatgaagtatctgtcagagatgggctacgttcaccggggcctggcagctcg

SEQ ID NO: 163586 - DNA, 182 bp, Homo sapiens
ggtcctgaaatcccctgcatataccgagtgacaactgtaaaaggataataatgctaagtccttttcatatgtatttccttagttgattggttattttatttattgacccagtgatttagtaattgatcaattccttccttcactcaccatccagtgaagcatccagccagcgagaccatgga

SEQ ID NO: 163587 - DNA, 715 bp, Homo sapiens
agggactgaaggccgtttccggctctggtagtgtagggacttcggcacgtgtgtcattccccgggatttctgtagtaaccctgcttctggtgaacttgtctggccggcattcatttaaggcctaaggatgaaggcgagaagaaataaaaaacagatcccaagctttcgcaagttaataaaaactagtaaagtcaaacttgaaaacaagctaaaaaataagcagtttaaacaacaaagcactctcaagaagtaccgaaaagaacagaggaaactaaggcaagctgtgaaagatgctgtgtctaagaaacccattccattggagaacccaaaggaaaagcgaccaggtaaaaggattgagagggaagaagaggaagaagaagaagcccttcctttagatatgatggatgaagatgacttacagttaatgaaggatttaggacaaagagtatcttttctaacaagagatctttcttctaggtaatacttcatttgggttataatcattcatatccatttagtgttaaaaacttggttctgaatttcacttaggtggttcaaggtgttcacctttgagcacaatgtttacaaagaataaagtattatttagcttatttcctaaataaaggaggttcatgtataagataagctgatttcatttaatgtacatctttcttttgagtctgaatagtcaagtagagtgaatgggggaagaatg

SEQ ID NO: 163588 - DNA, 953 bp, Homo sapiens
agggactgaaggccgtttccggctctggtagtgtagggacttcggcacgtgtgtcattccccgggatttctgtagtaaccctgcttctggtgaacttgtctggccggcattcatttaaggcctaaggatgaaggcgagaagaaataaaaaacagatcccaagctttcgcaagttaataaaaactagtaaagtcaaacttgaaaacaagctaaaaaataagcagtttaaacaacaaagcactctcaagaagtaccgaaaagaacagaggaaactaaggcaagctgtgaaagatgctgtgtctaagaaacccattccattggagaacccaaaggaaaagcgaccagatcttcctagagtgggtaaggatagtagtcctataggactgctataaagcatatatgctttatcacagtcagtatgagaaaacatttcaatacagtattcattcaagcttctgcttttagtttgtctggaaggcagatctgaagatgcactacttgggaaaacaaactgaaagtactccgttacataaatattgggcagtgtgccagtgctgccactttgccattcaccagcagttaggtaaaaggattgagagggaagaagaggaagaagaagaagcccttcctttagatatgatggatgaagatgacttacagttaatgaaggatttaggacaaagagtatcttttctaacaagagatctttcttctaggtaatacttcatttgggttataatcattcatatccatttagtgttaaaaacttggttctgaatttcacttaggtggttcaaggtgttcacctttgagcacaatgtttacaaagaataaagtattatttagcttatttcctaaataaaggaggttcatgtataagataagctgatttcatttaatgtacatctttcttttgagtctgaatagtcaagtagagtgaatgggggaagaatg

SEQ ID NO: 163589 - DNA, 498 bp, Homo sapiens
tctttggactgatgcttgaatcagtgggtgcttggcattgctgatagggatcagtgtaaatgagctattgtaaaatttagagttcagtggaactatcccccaggtaatagtatttttagattaaggtcccttcccctttttctgtgcatggttaggtcaatatttctctgtctctcatatcactcctttcctcctcatagccactgacaccatgctcatccaactcaaactaagctattagaatcctctttttatggacttactttcttttagaatggggactttcttcccccattccaatccatcttccactgggcaaccgagtgaattttccctaaatattgttttaactgttcattcattgaaaacctttttgtgcttttctaattaccccagaataaaatttacactcctctgtccacaaactaactcctacacaattcttttaacatttaatcctgaattgtatcctcataaagcaatgcatagagaaaaaaa

SEQ ID NO: 163590 - DNA, 516 bp, Homo sapiens
gagatgagatgttgctatgttacccaggctggtcttgaactcctggctgtaagcaatcctcctgcctcagcctctcaaagtgctgggattacaggttgagccactgggcctggcctttctttttttccttttctagaatatgctgacatcattccttccttgggaccttcacactggcgattctctccatttcaacgatcttcctggaactggctccttaccatcatttgaggtgcagctcaaatgtcacttcttcaaagaggcctcccctgcccagtctcagagggcagtgagagcttgtgtcagaactccaccctgccattagtggggccattttactttggaaaagttagtcttcttgtgcatcagtttcttaatctgcaaatagggttattaacagtagtaacttcttaggcagatttctttttttttctttttgagatggagtctcactgtatcgcccaggctggagtgctgtggtgtgatctcagctcattgcaacctctgccaccaggg

SEQ ID NO: 163591 - DNA, 306 bp, Homo sapiens
agagcaatttcgcctccattcgagtgggatctttctcaacatacagcattttacactgtctcagaggaaaaagcaaagcccaggtattctaataaagattgcatccagtcccagaagaactatctcctcaccccagtttcctcttttaccacctacagaaatgtagaggaaatggacagtactcttagagagaggaaaacaggcctcatatgagatggacaggaaatcaatgagaacctctgcagacatttcagagcaaatagatggtcttaactgagttgccccctttaggtgtgagctagatga

SEQ ID NO: 163592 - DNA, 560 bp, Homo sapiens
tatttcagaacttgatttcaactgtattattggtcaactattacatttccttttttatttcaaatgtcgatcaacagggtgtagccatttataatatttataattatttatatctacaattacaggcatttaatttgtcatttgaacaatgatatgacattgtgctaaatacttcaaggagagacacagaaggggaaatattattggttattacttcttaaatataaaagtttgtctttaaatagctgtgaaaggtgttataggagcatagattccgaattacaagccaaacataaaatcttctaaatgttattttggaactatactttcctcaagatagcgttatttttaaatctgtgaaactgacttgattgaatattgtttgttcattatagtaattcatacatttaatgttaagaaaaatattggacttcagaataatatgaatgaattaatccttataaaaataattgtatgttttgtatttatgtacaagcctgtgaatctcttttcccaaacataaagcaaacttccaaatacacacatttattttgtaccag

SEQ ID NO: 163593 - DNA, 408 bp, Homo sapiens
gtctgagcatgcaggtgcaggcatgcatgggggcatgcagccaggtgactggagaggctgggacagacacacctcaaaaggagttggagggctgggcatagtggctcacgcctgtaatcccagcattttgggagactgagacagaggatcacttgagcccagaagttcgaaaccagcttgggcaacatggtgaaaccctgtctccacaaataatttttttttttaaagttagccaggtgtggtggcccatgcctgtagtcccagctacttggcaggctgagatgggaggatcacctgagcccaggaggtcgaggctgcagtgagatgagattgagccactgcactccagcctgggcaacagagtgagactctgtctcaaaataaaataaaaataaaaataaaaataaa

SEQ ID NO: 163594 - DNA, 226 bp, Homo sapiens
actatagaggatcccagttcgacggacactctccactgtactccgtctcaaaaacaaaacaaaacagtgagttgacagagtacagtggagaggatcgagaagcaaataaagcattttgcccaagggaatggagaagggcggcactggcactcttcttgctgcaaactattcttaggcatatgattataatcaaaccacatgcaaaataaggaaatgtctctcccac

SEQ ID NO: 163595 - DNA, 509 bp, Homo sapiens
tgggcatggtagcacatgcttgtagtcccagctactcgggaggctgaggcaggagaattgctcgaacctcgtaaacagaggttgcagtgagccgaaatcatgccactgcactccagcctgcgtgacacagcaagactccatctcaaaaaaaaagtaaaaataaaaaaataaaattcaaattgaaaaagttcattttcacgattaaattcatatttacagtgctgccaaacttaaataccttaggattgtttctctcttcatgtaaaagatacataaagtgactacacatttcagtatctggtatggtttctctttataaaatacaaaatttaaagttcatgctttatctaataatctaagatccaagtattaatctatacttcattaatggttctttaccacatttgattctgctattcaaactggattcttttaacccaaccttggtcacatttactgataatcagaagtccacattgctataaatactactcacctaagccttgatt

SEQ ID NO: 163596 - DNA, 359 bp, Homo sapiens
tgggcatggtagcacatgcttgtagtcccagctactcgggaggctgaggcaggagaattgctcgaacctcgtaaacagaggttgcagtgagccgaaatcatgccactgcactccagcctgcgtgacacagcaagactccatctcaaaaaaaaagtaaaaataaaaaaataaaattcaaatatgaatttgataatgaaaatgaattgcagttcctcactaaaggaatttaaattttttgcatactagtgatgaggacttgattttccaccctgaagttgtaaaggtctttcagtctctctaaaagtgtgagttaaatctgttttctcacggccagcttttaaaggtcagtgaaggacggc

SEQ ID NO: 163597 - DNA, 285 bp, Homo sapiens
cagccttcagcgttgttccgttctgccccttcagccatgtaaggacacagtgttcttcccctctgaaggttgaggcaatgaaacaccatctcggaagcggaaagtagccctcaccagaaaactgaacctgctggtgccttgatcttggactacctagctccagagctgtgaacacatttctgttcttttatattacccagtctcaagtattttgttatagcagcacatatgaacttaaacagaattcaacaatgtataaaaagaattacatgctatgacaaagtg

SEQ ID NO: 163598 - DNA, 154 bp, Homo sapiens
cctgcatacagtggggaaaagggggatccccagggccaggtatggggaaagtccctggctcatcagactggaaggcaatcttgattctaatccctaatgctgtgtggtgtatggaaagtcactcaacctctctgagcctgtttccacattcctc

SEQ ID NO: 163599 - DNA, 359 bp, Homo sapiens
ctatcccaaagactacccatcataatctacagattgtcatctctcaccccagggaccccacagattccccatccctgattccaggatctacagaacctcatctcttacccccacagacctattaataaaaggatacattcataggagactgtgttgaccattttacacacccattgcctgtgtgtgtgtgtgtgtgtgtgtgtgtgtgtgtgtgtgctgattaatggacttaggtaaactttagcattttggtaggcaatgcaatttttcaatgccttttctttctttttcttgtacatctttaaaggccttactccagtaagtatgcattgcagtttattaatgcctatcccttactg

SEQ ID NO: 163600 - DNA, 431 bp, Homo sapiens
gtcgactcgtaggaggttcccgactcattccacggattgtcccgagttttcttgttcttgacagccgctgttgtcaggaaacagacttgctctgagcctattgttaaactagtgccgtttccctccttccagctctctctgggtgcatgcggtcttgtcgttggtctgccttctatattcttcgtgcttggaaaaccccttgcggtagcggtaaaaatcacagaagcatcggagctcctgtctatagtcatagtgtctaaagagacactatgattgtgtctctctacagattttctttcaggcttgtggatgctgagcctccagtaactcagtagttataattccagttctcctgcctcaacacttgttcctgcagaggttagggctatcagtctttccaatttgggagcaaatcgttttccctgtgacca

SEQ ID NO: 163601 - DNA, 349 bp, Homo sapiens
tggatatacttcgggaagggaggctgctttgaaatagtagggacagctcattacctccagcttccaggtatctttgcacagaagacagcaaagtggataaaggaaaccaaaggaagaaaggttgttatcaccagcaactgaacttagcctcctaaggatatcttcatgaattccagggacacccagtgaacttgggtcaccttaaggtgtcccaagcaactttttactgttgatggaacttctgagctctaagaagtcctggagatcttctaattaattccctcatcctagagatgaagaaacgggagaagtttgccctcctggagtgggaccctacccccattctgtt

SEQ ID NO: 163602 - DNA, 623 bp, Homo sapiens
atatttgaaatgctggagaaatcctggttgccccagaattgtacactggttgatatgaagattgaatttggtgttgatgtaaccacaaagaaattgttcttgctgatgtaattgacaatgattcctggagactctggccatcaggagatcgaagccaacagaaagacaaacagtgttatcgggatctcaaagaagtaactcctgaagggctccaaatggtaaagaaaaactttgagtgggttgcagagaaagtagagttgcttttgaaatcagaaagtcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttacgctctgatgtgctatgcttagctatctgtcagagattagtaaattataaaactcatgtgtactacttaagtttatatcttatgctagtttataagaacaattaaaaggacttagaagatta

SEQ ID NO: 163603 - DNA, 596 bp, Homo sapiens
aaagcctttctaagtgtaggtttaatcatttcagtgctatctctcatgcctcccatttcacataggcggctctcttacccacattgattgatttccctcaaactgagggtgactcaatacgacaacacgtagcgatgatgactgtgattcagtttgctgggaggctgcctcatgctttctgctaatgtcagtggcaggttcacgggaatatgtatatattctagcttaggagctgttttgagatttgggaatggtacacgtgcccacatctggggcagctggtggtgttggtgtttctaagtagtgtcctcaatattcttccattctccttttaggggaagaattttatggtctacaagaccaaaattactgtatgtgtatatatatatatatatatatacacacacacatacatatatatgtatgtatacatacatatatatatatacatctggtttccctatgttttctcagtcccatggaaagcttttttttttgagtgtttgtgtaatatttctaagcatattcttgccatattttctaactgtaaaatctacatgaaatggagtgtttggggaattaggtgcctggttcat

SEQ ID NO: 163604 - DNA, 497 bp, Homo sapiens
ccatggatgatggggtctgctccatctcttcaccctaatccaaacaaagatgttcttcctaattcttgtttccttggagaactgaggtcttcagcgtgggttccagttgcatgctgtattcccaggctgacaccttctgcccactgcagcctgttccctgaccctctgtaactttgtttaattctcttgacctgatgtcaacataaaagaagactggggaatgaagcgagaagtgacaggcccagcttgacctcttgaaggtcttccattgtgtgaggcttgcaggggagtcttggctttggaagcccaaggacctatctatcttgaatcttaattctgttatctcattgggcacctatacttcagccccaaaggctgttcaatggctgtcatgatatagcacaggagacaaagctggctttatcagacttgctcagtaagtgggtggctgtctttttatcgtgttcctcctggctacacacacacctcccctggtt

SEQ ID NO: 163605 - DNA, 396 bp, Homo sapiens
ttctgcagaaactcctggtacaaataagaacttgcaaagcttcatgttcaatggagttcttgtctggatgagataaggagtgcaatactgcacgctcttctgtacttgtgataaatcaaaactctaatgatgctattaaaatgggttttcttttggccctggtaagctggaaagcattgggaggtggggaggatagatttcacttggaaatacctgaagctaaaaagtggtggctttttcttctttcttctaaatgtactccttgctctaattaagcgatgtgatcactgtcccaacactgacataccccaggatgaaacacactttctattcaagtagcctttttttcccttgccttcttccatgagacttgctgaaattgtcatgttatttctt

SEQ ID NO: 163606 - DNA, 288 bp, Homo sapiens
cagtttgttcaactccttacttcaaatatatcatttgatctaactccatttcttggcctttccttttaaacacatcctttctagaatgagagaacttccctctgggctcattgcagattgctccattaatgagccctattttcagtggttagtcatgctctctctcttcagatctctgatacatggattagcttctcggtaaatatttctgtttgaaagcagttggcctccagtctttgtaaagtcttaaaaagcctggcatctaccatctccacagggtactatgca

SEQ ID NO: 163607 - DNA, 307 bp, Homo sapiens
ggaggggagccaggtgaatgcctgctagcaacaggaatttaagggggagaggtgtgcacatttatctgccatttagctgtagatgtgggaagaaaatatatccattacccaagtggagatcttagtgttaacagcaaccaaccactatttattagtaaatgccaagtctacatagatcctactttataagagatgagtaaaaagtgggggtggatgatatgatgtacaaactatgaaaaaagttactcacaaggtaaaggaaacataatctcttatgaaatacccggggaggggggggtaccgagct

SEQ ID NO: 163608 - DNA, 435 bp, Homo sapiens
tcaaatcaatcaatgaatcaatcagaagtatagacagacacatccactatggctttacttccttgtttggaacaccaaggggcaggcttccgtccttttctatgagagagtgcaaagcatcaagcctagaaaatgataacaacagtgcaggatataaagctgaaggaatatgtcatactttgttttctctcatcttctaaattgtcccctgggagtgggccagccctgaccatgctctccagggagagcccaccaggtcctacgtgttcacacactcaggaaaacaagtggctaagaatccctgtggtctagcctcagcaggattgtccaagcaccccaaagttaacataaaatctaaataattgatgtttggggtgaaataaaagaaactaaaatcccagatgatctaaatatgtgaggcacaaggggaaggag

SEQ ID NO: 163609 - DNA, 311 bp, Homo sapiens
ttttgagatgagggagaaaccttgttgtaggaagacagtgtttgcagcgaatgtccatgtattttccggccataatctctccctgtttagctttaacaggctgcttgagagagaatgccagctcctatcttgtgcaaaccaacagcagaattgattaattagaaataagctgaaccctagattcaataagaactgggcttaggttcagaaccttggagcaagagatacaccctggaagagccaagaaaaatctagggagactttttatactcgaagttgaaaatgttgtcaaaggcgacaggttctctgtc

SEQ ID NO: 163610 - DNA, 503 bp, Homo sapiens
ttactcgctattactagaccttttcatggttagaaatttaacttactgctgtctatttcaacttagaatgtaacagacttgattgcctcttccgatagggcaagctagacatctaaattttataaattgattgtattggaagcagtagatcatgtagagactttaaaaaagctgtatttagttttgtttgggtccattagtgatacactttaaatgtgaatattagaaaaccagagagtcaaaaaagaaagagtcaaagattacaactctatgcaaatattataggatgaaggattttttgtttgttttgtgcagaggggccaagtatgacttaaatttgctatgatcatgagtgtgttaacaagtaatgttggtagaatatcctttgtctttaaagaggctagaaaaattataggagtttaaacttaaagctgttatgatttggggttgtagaatatgatttgggattatagggcaaggaaactttgtttatagcacttgtt

SEQ ID NO: 163611 - DNA, 393 bp, Homo sapiens
actatgctcttaaaatcattcactgaggttcattccaatgacagcatcaacaaaaatactgaatgaagtacattcctaccaagccaccctctccctctaaataaccacttcaagccactatcaggcagcagtagaaataaggtgttggaactacaccagcgcttctgagagcactctcttgtgaaaagcaaagcatggccttgaacccaattccacttcttctccttttgcttaaaaggaatgacacagaaggtggtgactgaaagtattagtgaggtttacatacaggaaagccaagagaaacactctgatggggtacaccattccatcccttcttcaggaacacaaatgagcatgaaagaaatcaaagttataaataatctttactggtta

SEQ ID NO: 163612 - DNA, 452 bp, Homo sapiens
ctacaatgatcatgtgggctataaattacttgctcagcaaatgctgccaaattcctacatatgtatttttggtcagcttcatgcaggatgctgccatttgagattttacaaagctaaaatcagtaagattatgcccaaagcaactcaaaaaataaaacctagtctttgtaccaaatggagatatggtatatgtactaatctcaaggaaatatttgtacatctttaaagcaagtgaaggtcaccagattctaaggaagtatttctagtcttttacttatcaaggcacacacagaaagtgttaatattagcttttcaaatatttaacctatgagctgataatgatgccctcatttagttgaacttgtcagaagaccatgtattacatacggtgctccaaggactgcgaggaagatgtaggctaacaatgaaacctttaccttgttgtacacgcc

SEQ ID NO: 163613 - DNA, 241 bp, Homo sapiens
tctgtacccaggggcggtgcgcttaacgacgtcctgtccactaaatggccactgtgtcctgcacgtccttttctgtgccggtttgtgtccacagtggcaggtgcccgtgtttataaatgtgctttgcttctatcagcaatgcgggagtagcgtggtggctgcttgcgttctcaggagatgaccttacagagcatcaccaagttcaaagttccatggcttggtaaaccaggcttgcatttag

SEQ ID NO: 163614 - DNA, 646 bp, Homo sapiens
tacaaaaattagccaagtgtggtggcacacacctatagacccagctacttgggaggctcagctggagtgcagtggcacaatcacgactcactgcagattcaacctcccgggctcaagcaatcctcttgcctcagcctctggagtagctaggataatgccaccatgccaccatgcctggctaatattttatttttattttatatagagacagggtctcattatgttgctgaggctgatctcaatctcctgggctcaagcgaacctcctgcttcagcctcccaaagtgctgggattacaggtgtgagccactgtgcccagccaactatgtagctttcatgtacttatatgcttcatagtctatcaggcttctgacagttgcatttttctcctttggaacatcagcaagacgttggatttatactaggactagccatgttgggggaggtacctcttaacatattgaggacatggagttttgtttggaagggacttcagtttcctctctacccaccaaatgctatgcttatgcctatggcttgtccttctggttgggcttattgaaagaaaaaaaaaagaaacttaggaggcagaagctttgaggccagggactgttgagtgtggcatagtcggttggtctgtctgaagt

SEQ ID NO: 163615 - DNA, 315 bp, Homo sapiens
ccagaggtttgtgtgggagaagaagcgaggactacacccagtgccatgtgcagttgtagggctgctcatgtgcagtctggtgattcctctttttgcctgcaagtgtggcttgtctgtgtgattgtctgtgtctgatctgctgcttctgcttcttggttccaagcttacctgtatctcacatgccactgtcatgagatcacaggccccactcctgctcatgcagataagggacgttggttggtgggcagtgtgatcccttctcactgcttcttcccaaacatctgtgtggtatttcctgcctgggcaaccctctga

SEQ ID NO: 163616 - DNA, 1120 bp, Homo sapiens
aggatacaggggagttattagggttttgttctgcttgttgttttagacataccctgagttaaacattttttgactattgctgtgaaaaatgggttcttttcttttcagtaagtaaagtgatacctttagcctgacaacctttcagctgccaggacttagaacaaattccactacatcatacagcatgattattatagaaaaggaaatgtatttaatacaaaaccaagggtcaataagagacaagaagacacatatctacgactctcatgatctcacagatacatgtgctggggagatgtgctgaatacacagctgtggtttacgtttaaatggagagatacttctgtctcctcctctccatcccccattgttctccattcctaaaggacaagctcaagagtaatcttgttagtaaagagacatttaaactgcctatgacttaggccattgaatacttgttagatatttataggagttgtttgagaatgctagctgtgtaatccaggaggtcctcttagcagagattagaagctactaattgcctgggaaagttgaccatgggttgagatggtcagtggtgggtgtcttagctctgtccttccatgcagcccaggatgagcactcagggtcattttggaaaatcttgctgcttgcattattatcagtcatcctttaagtaagtatcaggttctgtgtgggaaatcattttgtctcagaatttaaaaaattttcttttataatttaggctcttacattgttattgagaaatcgaaagctacgtagattcttgatttttttttcctctgtgacctatttttttttttctagaagcttttaggatcctctctttgtccctgcttttctaaaatttcataataacatgccttgtggtagacctatttttatacatgtgctgggtactcattgaactctttcagtctggttattcatatcctttaatttgggcaaagtttcatgaattgtttaatgatatcctcctctgttttctccttctagttagatgacctcttagactgttcctctcattttcttatctttcttctcattttctatctttgtgttttgactacttgctaagagaactcctcaattttatcat

SEQ ID NO: 163617 - DNA, 679 bp, Homo sapiens
gggttttcaaacaccttgctccaaaaactgacttaactagccatttttttattagccatcatcactgtcactacagttgccatttaaggagaacctgctatgtgctgcaaactaggttaagaatattacacaaagcatcttatttaatccagccaacaactttaaaaggtgagtatcattattcttatttatcagatgagaaaatgatggccaagtcaaaatttgaactcagattttattgttgaatacaaactctgttctcttttccctatgtcaggctgcctctctaaaaataggcattgtctcctgcagctccgtctctcccaagtattcagattttatttattatatctgttaccactaataacaatatttttaaaaataagccaatatgtgatgatagtgtgaaaagtaaacatggtaattaggcaacatcaaaatgaagttaattattgccttgatgactagggtggtttgtgtacagtcttgagacagggaaaggcgtcacatcagaaagtggtactcccacatccctgccgtatcacaaggctgtgctcagcctatcaggggattgctggaaagggagcaaacctgaattcgctggtgccacacaaagactttttacccagggctgctatttccccaaggctttctctttattttgtgatatccctgtagc

SEQ ID NO: 163618 - DNA, 640 bp, Homo sapiens
agattaggatggccccagtgccaggatgacacacaaatttgtgaagtgtttaatttaaaaaataaaaacaaaaaagagatagtttttatggtagatagtggattttatgaaagagagtggattttttttttcgaaacagggtgtcgctatgtcacccagactggaatcttggctcactgcagctttgacctcctgggctcaagagatccacccgctttggcttctaaaattgctgggattacaggtgtgaaccactgcactcagccttagctgtggattcttaaagacagagacttaaaaaatgtgtgtgtgtgtgtatgtgcatgcagatgtgtgcagggaagggggaagaactgatccttttctacatccaggctgtgggatactccaatgaggacagaataaaaggaaaaagtaagggagggccagtttcttcctcaagttcacatctaatatcatttgcaatgaaaagagcgaaggagtggtggcattgaacctgagctgaagggaaagcgtacattgcagatgatgttggaagtgttgttcaggacccctttatgtgaaaacaagacccctggaaggcagctgaggcttcccaagcagcagtgcccactgtgggtctgcctggggtggtaaatgg

SEQ ID NO: 163619 - DNA, 557 bp, Homo sapiens
ttacaacagctccattacaacagctccagttacaacagctccagttacaacagctccattacaacagctccagttacaacagctccattacaacagctccagttacaacagctacctccttcaaaggataaattgtattgataagggattaatagtttttcttaaatggacatttggtctgggatagcaccattggaagaattctgaaacgcttatctcacaggttttcttaaagcatccaatcggtacccctcattttacagatgtgaatatggaagcccatggagactaagtgtcctgcccagggtcatgcaaaaggtgagggcagagctgagggcaaactgagactccatttccattccaggctttcttccaccctactgtacagccacacgtccttgtcctgtggggtgtatagctttctcccatctaaatgacactttctaaggctgggtgtggtggctcacctgaggccagcatggccaacatggtgaaaccttgtctctactaaaagtacaaagaattagctgggtgtgctggtgggtgcctgtaatccc

SEQ ID NO: 163620 - DNA, 561 bp, Homo sapiens
ttttctgttgcaactcttttaaatggtctgaagttcctattccaggctttcataactcactctctcgggatcctgatctccaccaaatctgctgaatgtgcatgactatattctctggccccactggctcttttgacattttggatggcctttcttttactctctcccattctccccaactagctggatgggttgaggccacaccttcttcccctaacaaaccaccttcacattcaattacacctactccatctgctccctctctctcaccttcccctcaacatcccaacctttgatgttgttttccagtgcctcctccttatcagggattctactccccttctcatactaggtcagaggccacctatgatctcattttggcctcagaaaaagttctgctgctccaggacgtggcaaatggggatctaggaaccatcagagtccatgttcccttcctaatgtctgatctttcccaaataaaaactaagctttggctctttcagtaggggccctcctcatttcatgaaggaatttacaggactattgcttccctctacctca

SEQ ID NO: 163621 - DNA, 191 bp, Homo sapiens
aaactgtaaagaaatgaggtgatttttaacaagtatgttggagtttgtgcactgaaagaatcatcgaacttcaaaaggccaacatgcaaaacattcccaaattcctctttggaaacttcttccagaacttggttgtttttgaccaaatgtgatgtactacttcacttaatcttattccccagccttggtac

SEQ ID NO: 163622 - DNA, 203 bp, Homo sapiens
tgatcaatttgcatgtgtcattcagttacaaataccttcacatgtccagttttctttcttatctgacctaggggttatttaaatgtttgttatttaactcccaatcattcagggatttttctacttttcttctcattaatttttgccttaattccatttggtcacaaaacacattctgcaagcccccatcctgtggcattgag

SEQ ID NO: 163623 - DNA, 387 bp, Homo sapiens
taggctccccacgtgatgtccactgacatcctccaggtatggacagaagtaccagcttccctcctcagccttccctgacaccatgacagtggaggggagggcatagccggggagttagagtgccccattatagcctggtgaggatggaagtctgggctccccactcagcctatgctggaataggtaggggtggagccacattttttctgtggtgtttggctgaagtagatcagttaatatctaaacattttctgtctttctggctgcccctttccttgtctgtcccttagctgcgagcataggctcttgtggtggtggtattattgttttttggggatttctttttggtctgtgcccagtggcatttccaggttgctgctgtcttcc

SEQ ID NO: 163624 - DNA, 119 bp, Homo sapiens
aaggctgcagtttgaaggggttcctttcaaaggccaagtctgcagtaatttgagcataaaaatacatgatatcatggattataatcattcaagtaaagtaggaatccatgagtccattc

SEQ ID NO: 163625 - DNA, 342 bp, Homo sapiens
tatttcttattccagcacagagaccaagataactatgagaggaatttaacttatagttcaacttgcagacaagggaaactgaccctccttcttgtccagagattgaagccacattcataagaggctggagtgcagtggcatgatctcagctgactacaacctccacctcccgggttcaagttatcctcccacctcaccctcccaagtagctgggactgcagggcccagcatgtctctgcaggaaggcagggcatcccacgatatcaccagctcctctaggagtataggagccaaggagctgctgagacctgctgatcacccactcactcccctccagccacc

SEQ ID NO: 163626 - DNA, 331 bp, Homo sapiens
agatggaatcttgccctgtcgcccaggctggagtgcagtggtgtgatcttggctcactgcaacctccgccttccgggttcaagcacatcctgtttttaatccatcatccatcgtgtctaaacctctcttaaacacatttctgtgttcagcatgtacaacccctggtgggggctgggaggtggcagatgggtgagtaaagagttctttacttgttgcctggtaaattgtataaactttttatctggtgtcccctagttcttctacttggggattttgtaaacaggtctgtgtatccttatttattaccacatatgaggttattttggtcgac

SEQ ID NO: 163627 - DNA, 161 bp, Homo sapiens
ccactaagctaacccagctagatctaatcctattttaaatgagttacatccactactgcttaaaactctctttgctccagaggggctgaggcagggtggccagtgccctgagtgtctgggctgggacatacccagggacaaggcccaacagtcaaatcccc

SEQ ID NO: 163628 - DNA, 581 bp, Homo sapiens
cgtaacattcgtcatagcctgattcctagagtatacccgcagttgtgtcagcaactgatcttgccagaccccctccctcagaaccaaatcccactccttataagagaaagactacagaaaaaagcttatgcaatccacacacgaaaaggcatggagaagacaaaaataaaagtggcagtggccttttgaatcataaagaaactactggctttcaatatagttggattttttttaagccaagccatgtattgcttttataagcaaaagaaaaaagttaaattcctcttgcggggagcagggggaaggtactttctgtctctgaaaagtctttttgtaataaagtcacccaagaccagcagtgtataaaaactctatctataatatgaccatagctatacgtttcttaaaatggattaagattgtaggaatgaacaaaaaatattaaaatggctgtccctgagatacagaagagtagaggattatttcccattttttccaaaatgatgtgttacttctataatattattttgtagtaattaactctgtaatctttgtcttcttaaataaatgtacccctgtgt

SEQ ID NO: 163629 - DNA, 301 bp, Homo sapiens
catgtggatgcagtgatccaattaaatggagagctgccaggcacattttgtcctctctggtcagtgagaatggttgggttggctcgctgcttcaatctgtggaatcagccaggagcccagtgaggaagctcagaaccccagtaacagcagagcatctttcagatagctccagagttttcctgcttttctgaggaagctcagcatcactgccacaatacggaaagtggtcttcattttagcctatttatttttaggcagagagtggatggttatttgtgtgggacttttggtggcgatatat

SEQ ID NO: 163630 - DNA, 841 bp, Homo sapiens
cagttcagcctaccacctaaaattcagaaatcctttccagagatctaagttctaagagcagaaattttaaaaagctaatagctttttacttctgctggtggaacaatgtagcagatgtgttttttcctgtaagtccacttaaaagtcggagtatcatacacaaagcaaacataagacttggaaaggtagagaaaaggcaaacaagttagaaaccttggaacacaaacgataaccgttgagtttcccgggttttcttttgccttatgtattccagactagataagagagaaggcagcaactcacaaatgctaatgagtgaagacaacaacaacaacaacaacaataaaagcctgctttttctagccaatgaaccaaaaaaagtagcagcctaacaggacaaaattttcagacaacaatgctctactccagccaaacaccctagaaaaatctgtggacccacctccatctgaaccagtgaaaacccatgctcaggttgtaactaagcaccccaagtgcctaccccatgactctccctgtacctcttatagcaatggggtgacccgcctcctctcgggctagggtggtatcagaggaggcctaatagagttaggacattcataaccattcattggtaaagccaccaccaactacccagagtgtaaatggagaccactagggggggcagtaattaggcatcctggcccttcccagctagggtggtatcagctgaggcctacggagagccttaactcccaccccgactgagcagtaatgaagcaccaacacaaggtcaaccgagtggacccaggacagctaacgcggctgttcaggatacgctgga

SEQ ID NO: 163631 - DNA, 81 bp, Homo sapiens
aggtaggttggtctttttcttcctttgttttataagagctgtgtcttagattgcctgtggttaactctagtgcctgaaata

SEQ ID NO: 163632 - DNA, 521 bp, Homo sapiens
ttcactgatgatatgaacgtatacctagaaaacccctaagactcatccaaaaagctcctagatcgataaatgaattcagtaaatgttttagtctgttttcatgctgctgatagtcatagctgagactgggcaacttacaaaaggaagatttaatggacttacagttccacatggttgggaaggcctcacaatcatggtggaggatgaaaggcacgtctcacatggtggcagacaagagaagagagtttgtgtagggaaactcccatttttaaaaccatcagatctcatgagacttattcactatcaccagaaagagctgcccccatgattcagttacctcccaccaggtccctcccacaacgtgggaattcaagatgagatttgggtgaggacacagccaaaccatatcagtaaagttttaggatacaaaattcaggtacacaaatcagtagcactgctatacacaaacagtgatgaagttgagaatgaaatcaagaactcaacttcttttataacagctg

SEQ ID NO: 163633 - DNA, 237 bp, Homo sapiens
ctgaactcctaatttggagaggatttgcttttccagcagaaattgtacattgatatactatatgcatgcttgttagaggtgattttattgttttatttctgtaaataattaacctgttttccatgctttctgtgatactaattaagaatatttagtgtggaataactcattcagatgaaacttcagcatttccttgctttgtaccgcttgccattgaagatgttgtaacataactat

SEQ ID NO: 163634 - DNA, 289 bp, Homo sapiens
ggtgctggaaaggaaccagagtgtgggaggactttgctcccaaggactgagttgaatgtcaccctgcatatgctttgcaaaagtttccctccgtaagatttccccctcttccatctcctaccctccaaatcgaccctagagtcccagatcctccaacagagagaaagtgagaactatcagggaagagaatgaaatgtgcccttcatatctacagtccagatccactgtccaagctgaatggaaacttaaagaacagcagcatcaacagcatctagaggtggggcatggt

SEQ ID NO: 163635 - DNA, 251 bp, Homo sapiens
acaagaccaaggtgtgggctggggctgcgggcagcctgcaggtgtggggagttctgtgccctgggagctgctctcactttgtagcagtgaattactaataaagtagccaggcatggtggcgcctgcctgcagtccccgctactggggaggccgaggtgggaggattgcttgagcccaggagttccagactgaaatgagctatgatcatgccacttattccagcctgggtgacagagtaagaccctttctct

SEQ ID NO: 163636 - DNA, 405 bp, Homo sapiens
tcacaagtcaattttgtccacacaccctgtttcaacaaacaggctttctcattgaccttcaatgacttcatacatggttgttcaggaatgttctttctctctgccttacaaaccctacccatcttgtaaggcccagttcaaactgccccaagtttgaggtctcccgctcacctgagctcctgcagcacttcctgtccacaccattccagcctggccctgttactttatgcatccgtttcacctgttcagcgagatgaccagtttctggcaggcctaatcactggcttaattctctctaagcacataacgtggtgtcttactgaatataatctatgggtcactttactgactgaggaagactcaacaacacagagcaaaggttgtgtaagaccccactgacacggg

SEQ ID NO: 163637 - DNA, 401 bp, Homo sapiens
gtgttagaagtgcaaatagtctatctgtcactaagctattcacaggaaggggcaggtgataagacttcatcggaaccgaacttaggttgagtaccctaattttccttgcacccatgcctgtccaatcagatgactctgggaaacgccaaacaggctgaatcaatgtctttgtgtggttttgttctaccagattgtattttactcacctataaaaggatctatctttaaaaataaactgtattaaatctgtaacatcaaaggcagaaggtggtgtgtgtgcgtgtgtgtttgtgtgtgtgtgtgtgtatcaatgacaaatacttaccaccccaaatgtcgactataacttctatgtggtagagtgctgtctggactgaggtaatttatgtagcttcctacaa

SEQ ID NO: 163638 - DNA, 393 bp, Homo sapiens
agtgtggcaaagttgggcctgtaggagtgagcacttgatgctttatcccagggcattagagcctatgagctctctctggcctctgttgaggattaacattggaaacagtaggaggaagtctccattgaagtgtcaagggcttccatgcagctggagaagctgagcagtgcagaggctgggaatggcagtgtctatgcatgaggcatttcaaaggtagatttttgttttcccagggaagtttttacttgggtggtcagggggactgttagtccatggagagtttcctggcttgaactgaatgtggatccaattcttctaaagaggcactgtgccttccaacatgttttatttcagtcagtgcaggcacaactgtagtgccacattttgctgacc

SEQ ID NO: 163639 - DNA, 648 bp, Homo sapiens
ttgagattacatccagaaaccagtgactatatttagcatttaagatcaaatggttagtgattgatgtttagctatgttattgtgctgataatttgtaaaataatctgcttctggggataggtagcaggctgaatttgtgattgactatggagattttagaatcaagagatctcttgaatcagagacatagagggaattggtgacttgctcaggttctcagataggatttgattctggatctcagtcagatcccttcccgtgttactatactgcttcttatgaattctatattaggccaagtgggcgaagacaaatattctcttttgttagaaatgggtatgaggataatccgtgtaccatagatatgattgtttgcttagagagccaatcagttgtataacctattataagtatatagtatgaaccactttttaagtagcttacatgtttattaaagtgatgattttcagatgtgaagcagtattataaaaatttgatatttcgaattcagaacatcctataacttccataatatattccaaaatatagtgtaaatctccccagagattaacacagtgaaactgtcagctagtatgtttcctgtgattctcaaattagggacaaggaacaaccttaaactatagtgag

SEQ ID NO: 163640 - DNA, 337 bp, Homo sapiens
gcaattgagaaaaaatgaacacacttcttgcagaaagcagaggctcagctcctggctaagtgttgagtctaaaccattcctctcctctgtcctcgaaaagagcagagtccccaactttctagaaaccctaacgcagtgtcccctcttgccccattccctcagacccttggtgcagtattgggaagagattcagaagggcaggactttgccctaagtcacaagtcaatgacagagctggggccagaactgaggttagggctcagttctccttggtgtgtgaaagagggcctcgcacaaccctaaaaccctcccccttccgagtacacgcagccccccg

SEQ ID NO: 163641 - DNA, 1022 bp, Homo sapiens
aagtagtgccacggactcctgtgtgataacattagccagaaccaaacagttagtaaggaatctgctacaacaaatttatacagagcaaaatataaagtattttaaaattggcatccttttgagatagtctgttcctctcctgcccttcgttagttgggtactcaagagttggcagtgttttcccatctagaagctcatgctgcatattgacctgcaaaggtattagtccaggtaccaatggcaacttttatgttatccatcaatcactttaatgagtacaagaaagcatcctatcaccctgccaaaagacagaggaattaagaatgactcatttatcacttaaatgtgtgagtgttttctatgtgtcaggtgccatcctggtgctgtggggcacagaacacagactccagtttccagggggttaccgttaaatggggctgaagcagcaacagtgtgtcggtctcctgtattcaatctcctcataataactgagccactagatcaggagcagctgcacgcctgtggtcccagcactttgggaggccgagacaggtggatcacctgaggtcaggagttcgagaccagcttggccaacatggtgaaacccagtctctcctaaaaatacaaaaattagctgagcgtggtggtatgtgcctgtaatcccagctgctcagaaggctgaggcaggagaatcgcttgaacttgggaggcggaggttgcagtgagctgagatcgcgccactacactccagcctgggcaacaagagcgaaactcggaatcaaaaataaaaataaaaaataagatggtaaaatttgtatgtgtattttactacaattttttaaaattagaaaacaaaaacgtaaatcctctagataccaaaacccaagccccatggaaaacatttaccacaaaaaggtgacaagctatccccacaaatgccaaaatataagtgggttggaacaagccacctatgccaccaagcctgcaggctgtcagcagctaggtggaaagacacagagggc

SEQ ID NO: 163642 - DNA, 374 bp, Homo sapiens
acaaggacacatactgacacaccagcactgatgcacaggcacacaaggatacaacatgtgccctggccctgcattaataggcaagtacagagacaccagccctgacatgcacaaatgcacactgatgcacactcacagataaacacagtctagcatacagacaggtgggcacgtatgcagacagacagtgctggaaaacagacccatgagcccacagggaccagacacccaaccacagacatacatggagaagaggtagaccaaggacacggccctctttgtccccacctcagctccaagttaccctcaggcagcccttggctgtttatcagcaggatgggctgctgccagtccttgaatgcccaggcccatga

SEQ ID NO: 163643 - DNA, 349 bp, Homo sapiens
tgataattctggcattgatagtagtgggtatggtggtaataattgtgtgtaacactcaaactttctgaaaacctacacttgatctgtaaatccaaaagtatatgtagcaaaagccataatctgctcttatttctgcaccacttgcaccagtgtggagtgataaggcaaattattcaggcacctgtgtaagccttcagtgtcctcacccccttgttataactctccactaatattacattggtaaagacgtccctgacctatatgtcactgagacctcaaagaaaagagcaaagctaaagcgtaagggggaaaaaagccagcttaaaaagacttaaaggtttctgggacc

SEQ ID NO: 163644 - DNA, 452 bp, Homo sapiens
ttacttccaagagacaacagggaattcagtgatgcatagaaattcatcaaattttgctttatgtgtatttaacctcagatatgtttatggttttatttaaatatgtgtttatgtatatatatacacatgcacagattgtatttaaaaataggagttaaattttaaattccccttagattctaaatttctcaaactcagcaagagtccacagtgcaacacacttactggggaactaatatcacttgacaaaaagagaactttcaaaattcaataaatacttgtttcatgcagcagacacattgtattagctagatcttacataacttcttactcctaaagtcagaataactttttgtgtttccctaaatatctgaagaagcaaataaaagggtaatgttaataaaaatgtaattataaatgcaataaagatgtaattatttgcctaacttgaa

SEQ ID NO: 163645 - DNA, 526 bp, Homo sapiens
accattgatttccaagagatacacgacaattcatctctgtattaatctaaaaattaaagttttctgttaaaaagatatcttacagatttcctttcactttaatacacattattttttaatgcatttacagaaaatgtggaaatgtacatcggtttccacagaacgactgctaaccccctctaagctctaaaagccttttaaaaaggacaattattaatggcacccaaattcaggagattgttgacttactggtatacaaatacatgtctgtgttcagaggaagcctgtattttttaggacaattccctttaccacacacacagatgggagcaaagtgggaggtaatatgcaatgaaacagccactgaacgaccaagcatacccgcttcacataaatacagccccactgtatttaactcccgggagagtctagcatcgcagctaacaatggatgaaaccacggaccagaattccaagttagaatgcaatatacagagggtgtaaatatactacagtgttctaccaca

SEQ ID NO: 163646 - DNA, 414 bp, Homo sapiens
tgctttttagttttaaaagtttctgttgtcatatcctcaaactcggagatccttttttcattttttttttaccttttattttggaattgggggtacttgagcaggtttgttacaaagatatattgtatgatgctgaggactagagtatgaatgtactccaggtagtgagcatagtatgcaataggtagtttttcagcccttgcctccctccctgtctcccctctctggtagttcccagtatctatttttcctgtctttatgtccatgtacacccaatgtttaagagcagagattctttcctcagtcatgttcaggtttctaatgaacccatcaaagacattttttacttctgttacattgtatttcatctccagcattttgtttctttccttctcggaatttttatctttttac

SEQ ID NO: 163647 - DNA, 396 bp, Homo sapiens
gggggcgtgggacagcgtgtctctgtggtttcaggtgcctggtctgtgcactttgccatagcagccctggccaactcgtgcaggtgcccagggccggagcaggctggagagctctggacggggagcaggcagtggctaggggcacatgggatggggactctggtcctaacagtcacgccagtaccctttgacctcagaaattgtggctctttccagcctgttatctcatgttatgacagagacctcaacccttcctctggatggggtcatgagatgtttgcacgtccagcgcaaggtcaagccctgggatatggaacagctctgctgatcgtagtggagcccaggaaatgaggtatctctggtgtgtttgtgcacacatatacatgtatgtgtgca

SEQ ID NO: 163648 - DNA, 157 bp, Homo sapiens
acaactgttaatataataaaaattactgaattgtatactttaaatgggtatggtatgtaaagtctctatcaataaagctgtttagaaaaagaaagaaatccagtaatgtaagagacactcataaaaagaaatatacttgaaattatcatctgtaatt

SEQ ID NO: 163649 - DNA, 550 bp, Homo sapiens
caacgctctatacataacaagttcagaaaccacagtgataaactaacctaagaaaatcgtttaacttttatctacctgaaacacaaaattacaaggcaacctataacactggaaaacaatatttgcatcaaatataacaaaagattatcaatatccttaagatgtaaatggcttttgcaaaagcaatcaatagaaaaatgactaggaattagaaaatcatacacacacacacacacacacacatacattcaaatgtctgggtagtcatctaaacactaacaatgactaataattcacagagctccaactgctacaatatttgtaacgtgataaagaaattataactttaatatgcaaagatgacttcatgatttaaaaaatgacaagtcgtatatagtagtgggcaaaagtcataaaactcgcaaaagaaggaagacagtgagagaattgtgttaaaatgggccaaggattgattttaatcggatatggtaagacatgcagacctggataattgtcaggaaagaactttatactcagatcctagaaacag

SEQ ID NO: 163650 - DNA, 238 bp, Homo sapiens
agcttgggatgtatagtttgctagggagagagaaaacagacttttttttccttttcaaatcaggaaaaatgtagtaagaatgtatatactaagtatttcttagcaactcaaactaacaaaagtcaactcagctgggcacagtggctcacacctataatcccagcactttgggaggccgaggtgggcagatcacctgaggtcaggagttcaagaccagcctggccaacatggcaaaacc

SEQ ID NO: 163651 - DNA, 520 bp, Homo sapiens
  misc_feature (451)..(451): n is a, c, g, or t
  misc_feature (454)..(454): n is a, c, g, or t
acatgaaaacaaaaattatctttgtatctctcacacatttattcaaagtttgtcttaccaggatcataatatttagcttgaagccttttaaaaaatgtcaagaagtatgaattttaaaaaatttgtccctggtaatactgcaagggtatagggctattagaagaaaactggatttccactctacttctgaaaggcagttctgattacaaaagttaggtgattatctggccaggaaacaggagctttgatcctctggaactgtactaaacaatttagagcgaatgaatcaggccccagggtgccaagaggaattcagtaatttctctgtgattgttttctttcaggcctaatctcataaatgttttagtctctgttatcatatttttacatgtgtttgcttcataaaagtaagtgcttttatgctaataaaaaggggttcttccgagaggtnggnagcgtgcagtgagccaagatcacgccactgcactccagcctgggtgacagagcaagactccatctc

SEQ ID NO: 163652 - DNA, 1001 bp, Homo sapiens
cggcattgttctggattctcactgtaatttaaagggaaattttcacagtgtccggagcccttgatgtcctgcaaatgaagaaagaggatgtccttaagttccttgcagcaggaacccagttaggtggcagcaatcttgacttccaggtggaacagtatgtctataaaaggaaaagtgatggcatctacatcataaatctgacgaggacctggaagaagcttctgctggcagctcgtgccattgttgccattgaaaacgctgctgctgtcagtgttatatcctccaggaatactggccagagggtcgtgctgaagtttgctgctgccaccggagccactccaatcgctggccccttcactcctggaaccttcactaaccagatccaggcagccttctgggagccacggcttcttgtggttactgaccccagggctgaccagcagcctctcagaacggaggcatcttatgttaacctacccaccattgcgctgtgaacacagattctcctctgcgctatgtggacattgccatcccatgcaacaacaagggagctcactcagtgggtttgatgtggtggatgctggctcgggaagttctgcgcatgcgtggcaccatttcccgtgaacacccatgggaggtcatgcctgatctgtacttctacagagatcctgaagagattgaaaagaagagcaggctgctgctgagaaggctgtgaccaaggaggaatttcagggtgaatggactgctccagctcctgagttcactgctactcagcctgaggttgcagactggtctgacggtgtgcaggtgccctctgtgcctattcagcagttccctactgaagactggagcactcagcctgccacggaagactggtctgcagctcccactgctcaggccactgaaggggtaggagcaaccactgaatggtcctaagctgttctcgcacaggctcttacgcaacatggaaataaggttgatggaaaataatcagtttctaa

SEQ ID NO: 163653 - DNA, 1000 bp, Homo sapiens
gttctgcatcacacactctcatctgactctatatgacggacatgtggggattggtattccaattagaatcgtaaacatcttttcaaaacacttccttagtgacactatatatatgtgtgtgtgtaatatacatagacacacacaatacaacacatatcacccctccctctcgaaaaagcaacaaccaccaatcctgccatagggggagctacacatttcttactagagtgggtgcatacgattgttaagcatatgattggcattgtgtgtcatgtaaggaacacatagaaacctttatgcggttcattgtttttccagccttttaacagtggtgattcaggtttcattccatttataagccaggtgagtctgcagtcttttttctgccgtttacaaaccaagtctgctttactggtgtctgttctattgttagtccccaacgaggcactctcctggtattcctgtgcttgccctgtgactgtcttgagcctgcagaatgcagcagagatggtgatgtgccagttccaggctttaagccctaagaagttggcagcttctgcttttgtgttcttgggagcctcaagtgatgtgcagtagatgttaggaggagacacagagaaagggagaatgccccgccttcccagctgtgtagcaccaccagcccaccagataaaggccccccaaagagtaaactaaaagtgagcccagcgttgactgtagaaccatgagcacatgaaatgggtggtgtcagtcactcagctgtgggtaaatgaaacagtaattttctgcttcagcctcccgagtggctgggattataggcatgcgccaccagccttggcttattttgtgtttttagtagcgacagggttttgccgtgttggccaagctggtctcaagctcctgatttcaagtgatccacccgcctccccctcccaaagtgctgggattataggcatgagccgctgcacccagccaataatcgcctttcttatctcactcc

SEQ ID NO: 163654 - DNA, 428 bp, Homo sapiens
actagctcataaatgtcataattttaaaaaatagtttcaatcaatagccaattaaaatttactcattatgattggctgataagtcttttaggcatcctttgatctgtaagatcccccagacccccactccatcctgcaatttatttgttgacaaaaatcagatttttatttgttgagtctcctaaaaccttcatttttctacatccctgtggtattccttaataatatgtctttatgtcctcatattttccataacttaatatatggatctagaggcttgatcagacacaggttcaaatctttttgacaagactatttcacaggtaatgttcctctatctggaggcatgtaataaatggttgcctctctttttgagtgctagctaccattatgatctatgtatagatccattagttcattaagcactg

SEQ ID NO: 163655 - DNA, 243 bp, Homo sapiens
ctgatcttttttttttaaaaagtaaataaaacagtttcttctgtgaccagatagttcatagaaaagtgtgttgatgatactttgtagtggcttaagctgaggtgtttgtatctaaatcttatagaagacattaaaactttaaaaatactgtacagatcagcttattctattcttcattataatcaataagaaaaattgagatccagtaaggaataaattatttgattctacagctagttatag

SEQ ID NO: 163656 - DNA, 291 bp, Homo sapiens
gtctcaaacacgcacacgcgcgcgcgcacacacacacacacacacaaacacaaagatgaaaaacctaactgaaatcttgttcccctcaaaatttcaagtggcttcattgtgccttatgttttacatgtaacccttacagaggttacatgatgtgtgataacacaataggccagatgcagcagatctgagaatctactcatcttctagcttaagacattaaagacccctgtgccaggtgcggtgactcatgcttgcaatcctagcactttggggaggctgaggcgggaggat

SEQ ID NO: 163657 - DNA, 458 bp, Homo sapiens
tggtgcgatctcagctcaccgcaatctccgcctcccagattcaagcgattctcctgcctcagcctcctcaggagctgggattacaggcgcccaccgccatgcccggctaatttttgtatttttagtagagacggggtttcactatattggccaggctggtctcgaactgctgacctcaagtaatccgcctgcctcagcctcccaaagtgctgggattacagacgtgatccaccaggatcacaccaggccgcgcctggcctgctttcattttaaaagtcaaatttgtcatccgcctcagtgcttgtaatcttttctgagtgagatactgaaatttgcagtttcgttttgcttgcacttgttcactggaccagtagtcactgttaaatgtaaaagtatctacttcctctgaaagttttttattcctttatttcctgcctgggcttgtcctccaccctaca

SEQ ID NO: 163658 - DNA, 484 bp, Homo sapiens
gtttttgcacatactactaacacttggtctgtcattttcgttttctccattctggtggttatgtggtattgtcacattatggggctggttagcaattccctgatgactagtgaagcacctttcttatattattggccatttggatatctttgaaggatctattcaagtattttttgcatattttcattgaatagcctatcctttaaatcaggggtccccaacccctgggctggggaccagtaccagtccttggcctgtaaggaaccaggctgcacatcaggacgtgagtggcaggccagggagcattactgtctgagctccgcctcctgtcagatcagcggcagcattagattctcataggagcacgaactcttttgtgaactgcgcatatgagggatctaagttgtgcacttcttatgagactctaaccaatgcctgatgatctgaggtggaacagtttcatcccatggaaaaattgtcttcc

SEQ ID NO: 163659 - DNA, 508 bp, Homo sapiens
gaaaccagatgccaggactgtgggggactcttgagcagcatcagccaaactgtaggagctgagaagaggaagctttgctcagggtaagcgccctgggataatgtctttaatgtcaagaggatgcacgctgtgaacgtggaaagccctccaggctgaaagagggaataacacaggcggggagtgttgccaagcatttgcgagcactctgttcggtggacagacagccggcttgctcatgattccgccttctctgttattggcaacaagccgtcactggaactttgtatccttaagctttgaggccttgactcaggtgggggtcccggaataagctcatgaagtttttgcctcgttacccccaggctccaaatcactggtacaaatttctcagtctgatttaatgcttagggaaatgtcgtatttttggatccttcattttaaaaaaacatatatatttaccagtgctatctccgccaattccgaataaaccttagacttcagatcatga

SEQ ID NO: 163660 - DNA, 281 bp, Homo sapiens
atgtgactcaggaggaaagtactttagaagaatataagaaacttagctttgatttttaaaatggcatgaagtaaacatggtaagggggaaaaagcctgccagttctgtaatttttcagattccttatagttttctttcctgttttcttccatggaagttggaatgtaggatgtttgctaatgagtggggagttagaaaaagggattctgaggaagtaggttggcattagatttgaagtgtcctatcttgaggaatctggactttattccttacgcatttgg

SEQ ID NO: 163661 - DNA, 181 bp, Homo sapiens
ccataagcaggattttctgaccttgatcatccaataccttgttggattttttgaggtcctttatctacatcacaacttgctatttatattcttttttcgagagagctttatggtctcattttcaatgctgactgttaacaaggggctttgtacataatatgttaaagggttagggagtttt

SEQ ID NO: 163662 - DNA, 133 bp, Homo sapiens
ttccctccatcatccttctgttccaatgtaatagggctgctgcagttttgctgtagaaaggcttaaacttttgaagatgtcagctgcctctgccttttgcagaaaattctgttaaaggtgaaacaagtaaaaa

SEQ ID NO: 163663 - DNA, 279 bp, Homo sapiens
gttaaatgtcactccactgctcaaagcccacttatagcttcccgcttcccacacaaaggccctatgtgatatgcccctccttcccttaggtgttcctctgaccccatatccccacacacttctcctgctcactctgctcagccatggtaggggagctgctactgcagtatttgctgctcctctaatacaccagcacgctcctgcctcagggaccactgcctagaatgctcttccccagatacctgtagggcttttttctaacctccttcatggctgtgc

SEQ ID NO: 163664 - DNA, 516 bp, Homo sapiens
tcagcagagaccgtgccagggcaggattctttgtgtctcagaatttcacttctgatagcttaaagcagaggttggaaaactctttctgtaagagtcagaaagcaaatattttagtttttgtgggccagtctctgtcataactacttaactctgccatgtagtgtaaaagcagtcatagccaatacatatacatgtgagcatgattattccaagaaaactttttacaaacacaggcagaaagctggatttggcccagcgcagggatagtctgccaatctctggctgagggtttgaaatggaaccatcttctatgactgcaggtagattttcccttgtcggttggcttttgtctctatggctgctagggggatccagggcagggcagacgagtgtcttacacttggcttactctctcctttttctttgagcaatcataagaagggcctctggaggttgcggtgagccgagatcgcaccattgcacttcagcctgggcaacaagagcgaacctcagtct

SEQ ID NO: 163665 - DNA, 380 bp, Homo sapiens
cccaaattattgggaggcagatcctaaaagtagagatagtttcttctttcttctagtccagggagcattgcagttttccacctcacactagaaacttctgagtccaatcaactctagttatgacctggggtctggtctttactctatcctgatgccgttcctttgagattttcagcaagcttaaatataactttccaaacctatttgggagaacaaaaaaataataatccgaactcttagagctcctttttaaacgtgttgttcttcaatacttcttatcgctaagtccagttataagcctttttcactgaagcctcatgacaaccttataagacagggcttattatcatacccactttacagatagggaaactgaggca

SEQ ID NO: 163666 - DNA, 369 bp, Homo sapiens
ttggttttgaatatgctacttttgatttgtctattagacactgaagtagagaagtcacataggcagcttactatatttgatctggaattcagtgaggaggtttagcttagagatataaagtgggaaattgttagcatatggattgcatataaactatgaagttggatgggctcaataagggagtaaatgtagataggtgaagaagattgaggactaagtcttgggacacactggcattaagaagccagataagtaaccagaagctagtgaaggagtgtgagcggcgtcagtgaggtgtcagaggaggcaaaccagaatgctgtggcctttaagccaagtgaagaaagcttcaagggaagagagatcagc

SEQ ID NO: 163667 - DNA, 475 bp, Homo sapiens
  misc_feature (360)..(360): n is a, c, g, or t
gtccaaaaagttcctcaaatgtagtttggtactttacaaatagagtctttataaagactcagacaaaaatttcagattacaatactcaatcaattattgataaattagtagaatattttccatttaaatcaacatatatgatgtgaatatatttccaggactaaatttcatgtacccaaagcttataaagagacttcattgtaaaattaggaaactggagaaaaaacatataatctgttgtattctgtagcaggagactatggtactgacagtgcgattaacaattaaaaagaaaaaaaaagagaggatcctgagagtatgtaaaaattaaaagttgttttgtgtgtgtgtgtgtgtgtngtctctttcatttagttctgctctgattttcatgatttctttgcttctgatttggggtttggtttgttcttttctagctccttaaggtaatccgggaggggggtaccgagcgcaa

SEQ ID NO: 163668 - DNA, 269 bp, Homo sapiens
ctataattggatacacatgtgagaaaatcctctctgaaagtaatagggatgatggatttgtgaaagtgaacctgcaggaaagatgaccagttaggtgcccatgcaattgtccaggtgggaaacatgatggcctgaatgagataggagcataaaagtgcaaacaggtggagagactgacataagtggagcagaattggctggacttgatcactgatgagagatcagggcaagtgaaggagtgcaatccaattaggctcttgcatgtctaa

SEQ ID NO: 163669 - DNA, 828 bp, Homo sapiens
agcgggggcaccgcggggcagcggcgccgcagcctgggctggcggaacctcgcgctccgactcgccccccgcctgtagctcggtcggcgttgcgggcaggcgccgctccgctggggattgctatgctatgccttgtatgactaagacctcttaccaagaatacgtgtcagaccataaaaccactgccaaggagtgcgggggtggcaatgaaacagcccaacaggaaaaggaagcttaatatggattccaaagagcgtttggatcaggacggacgcttggagcaagctgaagaggaaaagaagcccaaggatagcacaacccctttgagtcacgtcccttcagcggctgcacagggagcatggtcttgggagtggtacttgaaagaacagaaggctgtcgcagcacctgttgagctgttttccaaggatcagtcctttccagagcatgaaaatggttttcagattggaatgagattagaaggcattgatccccgacatccatcggtattctgtgtgctttctgtagcggaggtttgtggttaccgtctaagacttcattttgatggttatttaagttgctatgatttttggaccaatgctggttcccctgacattcatccagtaggatggtgtgaaaagaccaaacatgaactgcacatccctaagggttatagaaaagataaatttgtttggatggattacttgaaggcctgcaaattgcaaaatgctccaaagaaattattcagaaacagaagtcctaatgggccaatgtctaaagaatttcaggttggaatgaagctggaggccgtggacaggaagaacccttcct

SEQ ID NO: 163670 - DNA, 318 bp, Homo sapiens
tgctgcaaagaacatgggagtgaaaatatctctttgagattctaatttcaattcttttggataaataaccagaagtgggatgctggattatatactagtcctatatttgattttaatttttgaatgcttggagaaactttcatactgcttttcatagtggcagcagcattttacatttacactagcagtacataaagattctaatttctctacatccttgccaactctttcttttctttttctttctttctttctctttctttctttcttttcttttttctttctctttctctttctctctctctcctccctccctcc

SEQ ID NO: 163671 - DNA, 266 bp, Homo sapiens
ggtcacccacctggaacgaagctaacccccccgcccccggctgcccagcccagagacttgtggggagtatgactcacttcgcggggggccattgtggctaatgtttaactctgcccctccttcagcaaggcactttagccccagcagcccttagcgctgggccctgccctgatcatgcctgctgctgagtgggctcagacacacagctgagcttggcctccttgcgccgtggggaccgggcaccctgtggggaaaggtgggagcaa

SEQ ID NO: 163672 - DNA, 339 bp, Homo sapiens
atgtatgtttgtgaaaggttacttttttaaaatcatcagttttctagatttcagagtcctttgtttggtagtctcaccagcagccattgacattactgtggttaactacacacttagaaggttaagctggttccctaataactgcaagaaataaaacagcagtggcaataagaaatggtgaattaatgttctggaaaacataggtcttactaccccaaatgtcccaggataaagcttagcaaacataccttcttcatcacttgtgtgtgttggccttcaggatcacgacccgccattggtaagattctaattttctgtgtctttgaacttctattagca

SEQ ID NO: 163673 - DNA, 551 bp, Homo sapiens
gcgcccctcattgtagtcttccaggatattgtagggcttcagcagcctctcacctttatgagtgttctttttaactctctgtactgtatgtctgatccctgtccaaagaggcttatgagtgcccatttcacgttaccccaggaagagattggtccacctgactcaggagttcatccattcattgcccaaaaactaatttattcagtcccgactgtgtatgtaataagacccatgctaatcactataggagatcctaagaagcatattgccctcaacaaatgtctcctctggttgaggagataagatgtggcttgaaaattcatgatttcaatggatgcttcatgcaagatgaaaatctgaacccttcaaggcaatgtgtgatcaaagaccaagtgaccttatggcaccaagggctgttgtgttcccagaggacagagaaccatggctaagggccacagggtttgagaaagctgcttggaggaggtggaacctgagaggaaggtttcgtcaggagtgcggttgagctcagagagtggactgaagtccaagtc

SEQ ID NO: 163674 - DNA, 178 bp, Homo sapiens
caaacgaaatcaaacgcctaaaagaaatgaccttggttcccctctccctccacaaccccttcccagcatggcaaccagcagacaggctcgatctcaccacccgccacttcaggggctcattcctccacagttcacggaggccttttggggccctgcacgctgctgagtgcacatgcat

SEQ ID NO: 163675 - DNA, 243 bp, Homo sapiens
gatttattataaaaagctttaagtattcattgaaagagaaaatatgtatgaaccactatataccagctttaattaccattaaattttgccatacttgtttcttttctttcccttttattttgtttaaagcacatcccagataagatgtcattttactctaaatacgtgaggatatatcaaaaaagaatatttctacatggaattacaatgtcagtatcccattgaacataattaatacctttt

SEQ ID NO: 163676 - DNA, 297 bp, Homo sapiens
gtcttttcctcactgaatataaatgagtagactgaatgaatgtgcttgttattttgtttgcaacctacactattactttatctcctccctctcctcccaccccgcaaaaccatataaacaacagcaaaagaaaaaaatcctccacaaaacttcttaccatcttacagagaacagctaacagttggtgaccacacaagaattaaaatgtgttgaagtatggtcttatatttgcctggcactctacagagtactttcatgaagatgacctcatgatcttaaacaactctgagaaatgga

SEQ ID NO: 163677 - DNA, 258 bp, Homo sapiens
ggaatctgcatttctaggactataaacagtaactgggcatgtgggatgaatggctaccagagagtcagagagccatccacaccagcaagtggtactatggtatcacttcaggcttccctagcaagatgaatttgtacctaaatctagagttgccttaagaacacaatctaggttctattcatttttaaaatataaatccatcttttatcttcctcagatagttactgaatttccaaaccagcactggttcttttttta

SEQ ID NO: 163678 - DNA, 261 bp, Homo sapiens
gacactttgggggcgcctaggaaaggggaactaggatcaaaaaagagatcaggacctgggcactcagctctagagatggcatcagggcagccaaggcactggggacaccccacacccactgtgccagcctagggcagggagcccgaggaagccacaggctctgccctgctcagtgctggactcagtgcctggcccaggctgagaaggagataaactgcagccttgggggtgtggggaaggggcaccacactgggatctcag

SEQ ID NO: 163679 - DNA, 333 bp, Homo sapiens
tgagattatggggaaataggcacaaacacaccttgtcattatagatcccctataccttttatgtttcctgcgttttctttcacgattatgtctttctcccagatgttactactaccctgaatttagatattggggttatgtatgcatctgttaaaggtgttctaacctttttatgaatggaatcctactgaatgtaatttttatgacttggtttttattcagccttatgtttttatgattcagccatgttgatgcatacaactaatgacagttctttgttttactgctgtattgtattctgatatgtgaatatgctataattcactcattctg

SEQ ID NO: 163680 - DNA, 509 bp, Homo sapiens
tgatagagtgaatgtgtgtgggactgggtggcaggagaatattggcagatagaggaagtcgtgaaggggatttccaaggttgctctcagtacactggtttgagctactgtcctgtgatataatacagtgtttgttgattttactttggaagtgttgtttaaacttgcatttcatcttcagtccctctaatattgccttaacacacagatgatagcaacattttccttggaggcctatcactagttcccttatctgctttaggctgccttcctcacaattgacagcttgatttttctcaaaaacaaatatgatttcatcactcttccaaaacttctcattggatgtctattgattaaaagtccaagccagttaccgtggcatatagggcccattgcaaactcccacagctcatcgtcataacctttttatattacatttccccaactaacatattttgctccagttctacttaaagcctcacttctcttcaagactcttcccacgggctg

SEQ ID NO: 163681 - DNA, 317 bp, Homo sapiens
ttgcccactacctaattattaactgaccacagttatactcaatttcagtgtaagaaaaaccattttagctgtgcacagtggctcatgcctgtaatcccaacactttgagaggccaaggcaagacgatcacttgaggccaggagttcaagactgcctgagtaacacagtaagaccctgactctacaaaaacttaagaaaaaccattttagtcattgtgataagcaaaactgtaagatgaccccaaatgacccctgccctgtgaatataatgagctatcactctcataattgttatattacagggcaaagggattttaa

SEQ ID NO: 163682 - DNA, 198 bp, Homo sapiens
tacttccactcttgtgttcccatgatctgttcgaacccatgatgtgttcactacccagcagtcaaacatttttgaaaatgtttatcacatcacttcactcaacacccttcaaagggttcctaacacattcagattttactcaagtccttaccatgtcctataaggccctacaattgtactggccctttgtgaccctct

SEQ ID NO: 163683 - DNA, 291 bp, Homo sapiens
tgcatggtagggtcactgaggtcatagaggtcacagcctcatgggagcttaggaggtcaaatattcacagggtcagaagatcatgaggaggtcacagggtcaggaagccatgatgtcctaagagtcacaaagattgttcctctcagggccacagagatcatgaaggtcatggaatcatatcttcacagggctatggagctatgaggggatcacaggagtaagggactcagggtaatgggggtcacaaggggttcacagggccatggtggcctgccgtcctgggcagagaca

SEQ ID NO: 163684 - DNA, 148 bp, Homo sapiens
taaggtcctgggcttatatgagcacaagataggggggcatggcaggccaaaaggcaactttttgggtgcgtaaacagaaatgcttgttctcacttaggtccgtgagcacaggcccgagggtggagcactcaccatgtaccctactcat

SEQ ID NO: 163685 - DNA, 380 bp, Homo sapiens
ggccccagtacatgaagagatataacactgtatctatggcattaaaattttatgggaggagggatgatgtgaaaaaaatgtttaaaatgactccttagaggggctagtaatgaaacactgatccatggaacctgggctgtttggcctgttgtgtttccctcaaactgcattttgctattgcatactcctgatgattgaagttcctttctgtatttccttcagtttggcagatgaatccaaaggcttgatcagtctcaagcctgatcctttggcaagacttacaggtggttttgcattctttcattgggaggcacaccgtgtctgctttgtgcccttttttgatgttgcatctattgaggcttaatgcctacacctctgtc

SEQ ID NO: 163686 - DNA, 152 bp, Homo sapiens
atgtaccaaccatcaagaagcaacttagtcactttaccaagattaatcccatcacctgaaggagagtttagggaatatatcttcttagggttgcctgtaataaatttcctacccgagatactagaattctatttaaaacaaacagtaacaga

SEQ ID NO: 163687 - DNA, 323 bp, Homo sapiens
aattctaacattttcatcctgttcaatatcttggcaatttagatgctttgagatgttcccccacctactgacttcatagaaacatgttaaaacaacaccaccaccacactttctagaacttgaaactaagcctaatttttaaaagtacaacctcatcaatgtctctaaaactaggtcttgaatctaaaatggaattatacatagaactattacatgaagcagttctttcactacaatcatttttagccccccagtgaccaatctcctcaggtaaacaatgtctaatgactgatgattgtttactgtatgccaattactgctaa

SEQ ID NO: 163688 - DNA, 274 bp, Homo sapiens
tgagtgccagtgggaaaaggaagacttcagagtgtacggtcatgtggaagccacgcaggacaggttgagcgagctgaagagagaacacgggtgcaaacaccacatagggaccatgttctggggcaggctccatgggatgtcctcatacccacaactgtgacccgtggtctacaccagaaacaagagcttctgtctcctacactgtccctccagttccctgtactaagaaagtataatatcggccgggcgcggtggttcacgcctgtaatcccag

SEQ ID NO: 163689 - DNA, 554 bp, Homo sapiens
aaagggtggggtttgagatcgggggaaggaatgagaaagtagaagcaatgtcacttcagtgccactgttgactagtctttggtgcttatgtcagtatttgttttatttcctgatttttttaaagttggcaaaactacatatttttatcttgatgaaggcagtgggagggtggaacaaaaacaagccattactgctatttctagttcatttactggagactgtcccttaatagctaatgtagaataaatttgaaacatagacctagatgacaaaaagaatgggaatagaaatgaatctcaggatttgaacaaacagaagacgtttatgctgtgttgatgcccagttctacaactgcactgccaagactgagtggttggatggcaagcatgtggtgtttggcaaagtgaaagaaggcatgaatattgtggaggccatggagcgctttgggtccaggaatggcaagaccagcaagaagatcaccattgctgactgtggacaactcgaataagtttgacttgtgttttatcttaaccaccagatcattccttctgtag

SEQ ID NO: 163690 - DNA, 106 bp, Homo sapiens
ccaagcaaagggtggaattccatctttaaaaactaaacaggcattttggacaacacattcttggcaatagaacctggacaacatttatcaaacacggtagggaaag

SEQ ID NO: 163691 - DNA, 451 bp, Homo sapiens
tattccataacgttaccttcaagttatcctgaaagacacacatgacatacgcttttatttaactctactaatctttttactattttctctttccctttttttatgtatctcttcctttcactatcaatgtccatttcatctcccccaaagcaaatttttacatactgtggctaatataggtatttgttgttaatgtggttgatcttgtaatgtgttactttccctgatgaaacccagagcagtttcagaggcctcaaattctgagatcttcctaagttcaaaatagattgctggtagaaaagcattgacattaaccatgaaaatatatatttgtgtattgttcccacttctatagacatatattacttttcaaaatgtcagctcaaggaccagaaattttttctgaggagaaagagaaagcattgcctttacaaaagtttccctgatcatt

SEQ ID NO: 163692 - DNA, 480 bp, Homo sapiens
gcgatctagacatcccttataggttcgcaggagggaacaaaccaagttagttcccctccagacctaggaaatccacttacaaaactgcaaaatagcaccagattggttattagaaaaagtgggttctgaacctgccctggtagaaaattgtgggcaagtagtttaatttctttagtactctccatacctgcgaacctatgtcataggttcgcaggcaggggagatgagtggttagatataaaataggacttggtttgaggcatttaaaagtgaacttaaagtgcattttaaagaagatctatggcatgatatgccagtggttcccaaatgttgatgcatattataatcacctagaaagcttgtttgaaaacagatttctagtattcacactagacctttctaaatcaaaacctctggggtgaggcctaaaaacatttacttttagcaagataccctgcgaacctatgatgttatttgttg

SEQ ID NO: 163693 - DNA, 920 bp, Homo sapiens
tggatgctctgtcccttttttcttcgcacatctgagacttcctgtaacaaaagttaggcagagagacggctcccagggcgccagggggtggggctgcagggcccttggcggctcctggccgagctccagacaccagccgggtggttttggcgggtggcagggcagagggcatggagatgcccatgctgaacgctggcgaagatgaggctgttctgtaccaggtgctgaaaagcacataggggagaactgggaagattttcttctctagagatttttgggaaagggattagttttcaggaatgagtgtcctgcctgaaggcaggggactggcacttagcctgtggtctccaagtttaaatcaggcagtgaggtgattgcgatagcaccagctggcatggccctggtggaggcaggtgagcagggtgctctgcgctccgtggctgcggctcctgtgtgtgccctgcagtgccaagcatttgtgcgtggctgctccccgcctgcagggggaagcgttgttcccggggcgctgaaggacgcgctggtgagggcttgacgtgggcagccctgagcttctggccatgctgtgaggtgctcttctccgagcaaaggcagctgagagttgcagagttcacctttgtcggaggccacctgggagatggacactatgttattaggtggggccaggcctcccgagtacctgggagatgggagtgttcgcttcagacagtccatccactcgtgcccatccccatacctggcagatctgcaaagggctttgaaaaccttgatagagccaggcgtgggagctcacgcctgtaatcccagcactttgggaggccgaggcaggcggattgcctgagctcaggagttggtgaccagcctgggcaacatggtaaggctctactaaaaatacaaaaaaa

SEQ ID NO: 163694 - DNA, 208 bp, Homo sapiens
gtaaattcactagaatgggatcaaccattagccttgaaaacaataaaggcatatacttctgcccatccatccatcaatccattcattcaatcctccattccttcatccatccattcatcccttaatccattcatccatccctccgttccttcatccatctatccctccatccatccctcccttcatccatccctccctccatccatcc

SEQ ID NO: 163695 - DNA, 260 bp, Homo sapiens
tggaaagctgcccagcccctacctccactgccagcagtgactcctaggaccccggggaggaaataaggggaaaagggaggcagggtggggccaacctgagcgctaatgctgtgcccggcagcaagagcttcatatgaatcatctcgtttaatccttgcaacagtcaacgaggtaggtgctattgatacttccatgttacagatgaagaaacaaaggcatagggcatttctgtgacttagcccaggcccaaagctcggccg

SEQ ID NO: 163696 - DNA, 612 bp, Homo sapiens
attgccttcacaccaaacccaagggaccacacagcccattctgctccgtataccaggtaagtctctgattgcaacaaactggcaattctagtgtactttttcattattagaaattagctaaaggcaaatatgtgtaagcaggttaatccagggtttcaatgggagatagagaatagtggaatatctttattttaagttaaattacagtctggatttgaaaggaccttagagatggttagggctcccacctcagtagatagtcattgaactgggagtcctggagaagattgttcaaatgcccatgggaagttcatagcagaactagaactcaggcccagagcactctcagtaacactgcaatttccccctgacaagatatttatagaaattttaatttattagatggatctctactgagcatttattccatttaaggcagtatgctaggcactttggacaaatcaatgcctaacgtacttacttaacaaacataaaacctagcaggaaggtaatacatatatataaataaatgaaatgcaaagtagatagtaattggcatgacggagatgggcagagaagggctgtgcacttttgggagaccttgctcaagga

SEQ ID NO: 163697 - DNA, 267 bp, Homo sapiens
attgccttcacaccaaacccaagggaccacacagcccattctgctccgtataccagaaaaaaacacattggaagcatgaatcgctaccctctcctcacacattcttaaaatacacggagattctcagacatggaagagggaagggtacagtcagaacacggcaggctgtacacatttcattttgtgtgtgaaagaggtttccccagctaggagactgatttcagatagaaggatcgtgtgtgtgctactatcccggaagtatgtagt

SEQ ID NO: 163698 - DNA, 359 bp, Homo sapiens
catggtgctggcatctgctcggcttctggggaggcctcaggaaacttacaatcatggcggaaggtgaactgggagcaggtacttcacatgcccagagcaggagcaagagggggcaggtggcacacactttgaaaccacgagctcttacaacagattcactattgtgaggacagtaccaaggggctggcgctgaaccatgagaaaccacccccatgatgccgtccctcccgccaggccccacctccaacagtggtgactacaaactacaagttgacatgagatctggtggggacacagatccaaaccatatcagtgcctgacctatgctgagcctcaataaatgttaaatgccaccatca

SEQ ID NO: 163699 - DNA, 249 bp, Homo sapiens
aacatttgagaacattaaataactgaataacagtaaatgtgctattccctataaatttgttatttaccagcagtaacttaagcattagaagtttcatttgctgaccaaatacactgttactatttaaattgatggatttaagggtaaattgaggctggaagctgatggaagcttgggggaataccaaatcttccccaaaacaccttatggcattgctactagtttttctatattatattctcccattgc

SEQ ID NO: 163700 - DNA, 583 bp, Homo sapiens
taattttgtatttgtagtagagacagggtttcaccatgttggccaggctggtctcaaactcctgacctcaggtgatctgcccgcctcagcctcccaaaatgctgggattacaggcgtgagccaccacacctggcccacccttattaactttttaatgaacattcctcccagtgtgtcagtccactgtttaataactactaatggctccctcaactactttagaatcaagttcaatctcttcctgttgacattggagggactctatgatttagcaatagattttgtccccaaaggctttttaatcttgaaaggtctgtctactgtcttctagggctgccatgtttgctctcacttcagttttcactttatccaccccttttacctggaataacctcttcccttctgtccttttatccaaaccctaacactgtcttcaagatgtaactgctaacctttccaagaggctctgatttttccattcctcattcatctcctctctgaactcttaccatgtttaatttgtcccccattaatatctgtcttcggtttgctagcttttgcataaatattttaatatacatca

SEQ ID NO: 163701 - DNA, 196 bp, Homo sapiens
ttattattacatgacacaagtaagactacctgggaaaacagaagctgattctacttaaatactttatttacactttcccatagcctaagaaaagatagtaaatcaggaaaaaagggcaaacagatatattaaacataagggctagtatttgtgctgctaatgaaatttgtatttggtattgaccttcctggcagcc

SEQ ID NO: 163702 - DNA, 488 bp, Homo sapiens
ggcgctccgcctcctctcgttccgcgactttgcggagctgccgccggccctgggctgccccggcgcgcggcggacagtgccgagggatccgccgcagctgcaaccgctgggctttccctgcgaaatcccggccccgactcgcgactctgaaatcgcctggagccccctccccgggccctcggccccgccccctgctttgcattcgaccaatgggcgcgaggccttcccggccccgctggggagccaccccctccccaatgacacactatctttaatgggattagcgttctgctgtgtgcctaaacaagtgcgccgcgagcactcgctaaatgtcaagggctctgcagctgaggggtgaaccagaaccttcaacggaaagcgctggtctcttttacccgagcaagggggcggcgaaaggagggggatggctggaggtacccacggcccaagcaagccagaggaaaggtctggggagaaggactggaggg

SEQ ID NO: 163703 - DNA, 195 bp, Homo sapiens
agtatggagagggaaactggtctaaaatactgttacattataaattcaccactggccaagtgtcatgtgaaaagacagatgaaggactatgaagaaattaaaactgatttgctcagacagtgaagactgaatgtgtttgtaaaagcttcatacatggacagttaaatatgttgatcactgcattttgtttgtaac

SEQ ID NO: 163704 - DNA, 226 bp, Homo sapiens
tgtaaatgtttattggaatgaattagaccatttacatggttacattatatcactagcatttctttcctggaaacagagctgcttgctggtgctcacactaatatctcaagttgacccttcttgagtatgtacttaagcaatcacagtgcagaaatcttcttctttcataagctcagcatatccttaaaggttttcaccatacatgaactgttaaagtcactaatgc

SEQ ID NO: 163705 - DNA, 169 bp, Homo sapiens
aggtgacatttcagcagagtcccaaagcgagcctgagccaaggagataactgtcagaagaacgttccaagtagcacaagggtgccagggcaggcacatgcttggtgtgtttggtgcgggggggaaagccagcagggtgctaacgagctagagagcagtgacgggggaag

SEQ ID NO: 163706 - DNA, 243 bp, Homo sapiens
tcccacccaccccacccaaggaagcccagcacagaccatctcagctcactccaacatcacttctttgccaaatgcatttccaaacaccctcatgagcttgctgatctctttgctatctctccctgccccactccaagggctcctcctgcctggtgaagactgccctgggtaccccagaactgaacctgcagcagccagcacagctgaccttgggggcaataagcagccagggaaaggctttct

SEQ ID NO: 163707 - DNA, 129 bp, Homo sapiens
gtggtggcgcgtggggcgtgcctgtagtcccaacttcccagctacttgggaggttcggctaagcccaggttacagtgagctagaatcatgccactgcactccagcctgagcgacagaaacagaccagtc

SEQ ID NO: 163708 - DNA, 356 bp, Homo sapiens
tatatatatgtatttatcttagtgactgattgattgatacagagtcttgctatgttgcccaggctcaagtgcttgttggttcctctgtaataaaacagctcctcaaggatccactctctgatctgttccctgacctgttttccctcctccttccagtagcttcacttccctccttccatgcacctctggaaaaaggtgaccttccttctctgcctctgtgtcttggacatcctatcctcggcctgccctcccaacagagaaccaactcaccaaagtcaatgtcctttcctcagcccccattctactccacctctgtagcactagaggtttctgggtcgccccaccctagaggggag

SEQ ID NO: 163709 - DNA, 196 bp, Homo sapiens
tgcctgtcaaattgccaaagaaaaacaaaaaactcaaagcgtaaagcatggcatgatgtgggaactcttttgtgttgctagtgagagtgtaaagtgattgtataattcatggtccaacaggaaacagatggcccacttagattaggataattagagggaagtttatacacaaaggatgattcacagagatgtgggc

SEQ ID NO: 163710 - DNA, 222 bp, Homo sapiens
tgctgggactacaggcgtgagccactgcgcccggcctgatacctatatcttgaccaagctgctgtggaaacattgagttccccttgatagttttgtccacagagtgaatgtttaggaaccggtgaggcatctctcacccccacccagatggcggcctggaggcagcgtttctgaccctgtgatgggatttgtctctcttgtccaagagactttagagatgtg

SEQ ID NO: 163711 - DNA, 496 bp, Homo sapiens
gcaggaagagggacaaggtcagatggcctcctgagccagggaggcagcctggaggtttgaatcctagttctgccattttctagttatgtgatcctgagcatgttgtttacctctctgagcctctgctctaagatgggaataattccaaactctataggattggcatgaggactaaatgaaataatgcatctaaagtgtctattagtgagaagatactccatacacagtggcttgttttgatcataaatggttccctatttatttccagggcagcccaatattacaggttcctactcctttcaagagaatgaatttctttgtattaggaagtcaagactgttggcaacttaacaacatttttttttgtatttatgctttaagttctggggtacacgtgcagaacgtgcaggtttgttacataggtatacatgtgccatggtggtttgcttcacccatcaacccgtcatctacattaggtgtttctcctaatgctatg

SEQ ID NO: 163712 - DNA, 272 bp, Homo sapiens
tcctcaaccatcctcaacaaaagttctctcttatttcccaaagtactcagtccttctgccactcatgaatcctgaagtgtttgcttttacaagctgtttaaatgataaacagccatatggtatagcgtcaaggctgctaataaatgtactaaaatacacaattctgtcttcgatttggatttttaaaaatcaagtttttagctggatgcggtggctcaatctttggacttttttattttttttttttttttttttttttttttttttttttt

SEQ ID NO: 163713 - DNA, 338 bp, Homo sapiens
ggattaaagtggtatcactgattttaaaagtttgagaggtaaaaataaatttgttattttagaaacaaaagataaagaagaaaatgcattatttggtactcactcgtatttatattttcttcggtaagcttagaactcacattagttcagtgactttgaaagaatgttaatttagcatttagcctgcttggtatttggaattaatgaatataaaaattaataatcactttcatttgtcaccaaaaatgatttcaagatatatctgctgataaatagaattgccatgtatagcataaatttctatatgagaatgtccacagaaatgatttcaatatatc

SEQ ID NO: 163714 - DNA, 313 bp, Homo sapiens
tctccctttgcccagacccctccagacctctcaagagacgttctggccagtctccctgccccacccagcagcttcaaattggccaggcctacagtagctccagggaatttttaaaaatcagggtctggaagtgggcctgggaattcaaacctaggctcttcccacacccttgctaggacctcacttccctagactggcgactgactccctctcctgtgtccccactccctccatgggagaaggagcctatcccctggctcaccccgggacccacagtccccatcttccaaacaacctccctcctttctccctg

SEQ ID NO: 163715 - DNA, 232 bp, Homo sapiens
ggaaagcaggttaaggattgggaggggggatactggaaatttggcagtattcaatttcctgatttgggtggtagttacgtgatggcattccctttgtgaaaattcatcaatctgtatttttacggtttgtgcacttttcatttggtatatattttaattgaaagttaaaagaaaaaacagccatgacagccatgcacagtggttcatgcctgtaatcccagctactcaggaa

SEQ ID NO: 163716 - DNA, 164 bp, Homo sapiens
tggggaagaataaacagcatgatatgcataaagtctcttgcacaacctagctgctcaataaatggtagcttttatgcttgtcttaaaaataacattaagttaatgtgaaatagtcatttttgtaggccaaaagtggtcatataataacaatttcatatggttca

SEQ ID NO: 163717 - DNA, 363 bp, Homo sapiens
aattgcttaaatgtgaaattattcatgtaagccttcatgtgttagtccatttgccttgttgtaaaggaatacctaagactgggtaacttgaaaagaggtttgatcagctcacggttcagcaagctgtacctgaagcatagtgccaccacctgcttctggtgaggcttcaggaagcttactgttaggacagaaggcaaaggggagccagcgtgtcacatggccagcactaaagcaagaaagagaagggggaggccccagactcttttaaacagccagatctcatgtgaagtcagtgagaactcactcatcaccaaggggacggtgctaagccgttcatgagggatcttcctccatgatccaata

SEQ ID NO: 163718 - DNA, 465 bp, Homo sapiens
cactttggattttatagcttcaaaagaagaacacgaagtcatatgtgttgacctaattttattgaaaatctattcacttgaagaaaacctaaacacaggtggatgctgttttctagtagagcatatgctctaatgagtaatgtttcctagaattagtgaaaatgtatacaacttaagctgcccccaaactgctatggcagattagaacagttcctaccaaataagcataaatatttagttggcagttgatgctgtggtgttgacacgtgttctgttttatatgctgctcaaacatggcatatgaaagtatacctttgttctataggaaagttgaagctttgcaagcatagtagatattcatgacaaagaaaccattggaagaaacccagtagacatttttgggagaggtggtagccagagttaaaactcccatccctatttctttgttaggtttattcttgctgc

SEQ ID NO: 163719 - DNA, 460 bp, Homo sapiens
actagtccacggttggctggtacgtgcctgtaatgccagctactcaggagcctgaggcttgagaattgcttgaacgtgggaggcggaggtggagacagaggttgcagtgagccgagattgcgccactgctctccagcctgggcgacagagagagactctggctcaaaaacaaacaaacaaacaaacaaacatgaaaaaaacttggctggttttgtagactggttctatgctagaaaatacttacatttctgtccaaatttttgcttggaaaagatggtactactgtcaaactatcagctatctcagagtatccaaatgtctgctaacgttagccaagctaatttctttgccacctatgatgacattttcctgtacacattctaattattttgacgtttgatgtagctgaaattctctagtctgggaaagagtgaacttaactaaccttacatttgtttgt

SEQ ID NO: 163720 - DNA, 329 bp, Homo sapiens
aactagttgattggaccgaatatgtcaaacaccctctgacccaggaactaaaagaatgtgaagggattgtcccaatcccacttaaaggaaaattatattacacaaagaagaggacgaagtgagaagattcaccaggaattagccttatatttaatcccttcatatttgagcagcatggatgagaagaaatagtttacaagcttggccttttatatataagagtgtactgcaggtgctgtttgatttttctgagatatttttagcccttgatcccctttgctgcaagaggtgaggaactgctcactgacagcttctctgtaatctgtgat

SEQ ID NO: 163721 - DNA, 693 bp, Homo sapiens
tactcagaaagacatcacctggagctgacctacaaataataagggagatgtggtaattttttaatcaaaatatacctagaagataaatttctcaaaataatcctagaaatgacttttaaagcagaagagaaaaaaggaagggtggaatagcaacaatggaaacaaatgaggaatcctgctccccaccccacctcaaagcccactgtatatgtggggttatggtcagtatttctggtgttagagtgtatatttgcaaatctctgaactgtttatatgtatgaatctcatcataatagattcacattcttcttaaaggcaatgcttaacatgtttcctgatcataagatgttcatattgaagattttaaaaaaatacaggttgaatgtgctgcttaaaatgagctgctgctttatttttaaacatttaaaaaattttgttaaatttagtctcgttcttcctacaaaagagcttaaactttgacagtaacagctgttcttttgtgtgggacatgttttcatgaggatttttgtgcacattaaaaataaccatttttgtgaatcgtagttattattcatagtcactttataagagatataaaggttttccagtgagttacttctgattcataaccaaattatagcagagcagatgtagactaccagtggaataattagccaaaaaatattagggggc

SEQ ID NO: 163722 - DNA, 464 bp, Homo sapiens
ggagtaacattttattatgttctcaacttctctctggtattggtgacagtgaactaatgaattgttgagaacatgaaaatgctattgtttaatgcttcaataggttgtgtggttttgcttgtttgtttgtttttaacttatctatacttttgaaatagccactttgaagcctgatattttggaattctttatatcacctctcttggttcagattgtagacagtttcatagggcccattttctgtcactagattcctcttcactaggtcctacatcttctctaaaacatatttctaccaattaaaattgtggtgtagtgaaaacagtaatggcgtaatgaaaacaatggtttttattataaaatggcagacttaacatacccatttacttttccctacttctcagatgtcattggaaatgacaaaacagacataagacaaagaataaatcattgtaattaaaaaa

SEQ ID NO: 163723 - DNA, 556 bp, Homo sapiens
tttcttttctcaaaaatagcattactgttaccatacaattcacccatttaaattgtacagtggtttttaacatatttccagagttcagtaaccatcaccaatatttaattctagattttcatcacctcagaaagaaaccttgcactcagcagtcaatccccattttatggccagcctccccagccctaggaaactattaatctgctgtctgtctctgtagatttgcatattctggacatttcatagaaatagaatcatacattgggtgcagtggctcacgcctataatcctagcactttgggaggccgaggtgggtggatcacaaagtcaggagttcaagaccagcctggccaatatggtgaaaccccgtctctactaaaaatacaaaaattggtcgggcgtggtggtgtgcacctgcagtcccagctacttgggaggctgaggctgaggcaggaaaattgcttgaactggcaggtggaggttgcagtgagctgagattgtgccactgcactccagcctgggtgacagagcgagactccatctcaaaaaaaaaaaa

SEQ ID NO: 163724 - DNA, 188 bp, Homo sapiens
agagacgggtctttgtcctgttgctcaggttggagcgcagtggtgcaatcatagctaactgcagcctagaccttctgtgctcaagcaagccttccacttcaacttcccaactagctagagctacaggcatacaccactatgcctggctaattttgtttatttttgtagagatggggtctgctatgttg

SEQ ID NO: 163725 - DNA, 429 bp, Homo sapiens
acagttgtaggggctgtgcaggattaaaggggggctctgcagtgggtaagtctaagaaggtctgagttatataaaggttaacaagatctcttttctgccttgtgtctcagagcattgaaaatacaagtgtgcgtggagaactttcgagaagaggacattcccaaacgtatcaactggatgcagtgctgagaactgacaatccacggactcacttggggaaaccattctttaggggccccttttttcatttctcaagttctgttagcaattcagtcattcacacaatgaaaggagactattgctctctcccctaaaggaaagcagagggatggtctctgctcaccatccttcagccagggctcatgaacaagacgggagaagcacttgagtttgttttgttgggatgcaatccaacgttcggtaaaatgg

SEQ ID NO: 163726 - DNA, 701 bp, Homo sapiens
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163727 - DNA, 531 bp, Homo sapiens
ccacctgctctcctccgttgtaggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163728 - DNA, 538 bp, Homo sapiens
gctgccgctactactactaaattcgcggcccgtcgaccaccgaagcgggaggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163729 - DNA, 705 bp, Homo sapiens
tcccagagttatatgggggaagcgaggtacaggctggctagaagtcctcgagagcattagtggatagatgttgaagtccctgagagagggttatgatgcgactttgaggagcgttcgtagtttgagtttgctaggcagaatatgttatgaggatgtaagcccgctgggcgattatgagaatgagctgcgccggggaagctatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163730 - DNA, 654 bp, Homo sapiens
cctgcattattacttaatttcaaatctctctttaaaatacattttataagaaagaaagaaataaaattcatagaaaaattagtagcatttctatatcccaatagaaatcattctgaaaaaaaattttctttacaatacttacaaataccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163731 - DNA, 572 bp, Homo sapiens
  misc_feature (23)..(23): n is a, c, g, or t
  misc_feature (35)..(35): n is a, c, g, or t
tttaaatccccttttctactacnatgctgcgagangacgacagaaggggcttttcccttttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163732 - DNA, 556 bp, Homo sapiens
tacgagacccggagttggtgaattcggtcacgcaggacgtagtgcgggtcagctggcaattaatggaggcccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163733 - DNA, 531 bp, Homo sapiens
taggggcgcggcccgtcgacagcattcgacctgatgctcttagttccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163734 - DNA, 745 bp, Homo sapiens
gctgccgctactactactaaattcgcggcccgtcgaccaccgaagcgggaggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagatcgaaaaaaaaaataaataatggtcttctttctacttcacagatactttcttctcccatgtcggcccgccttgcccccagcccactttagacctcggccaagtttatgcatcgcggccgaaagttgggctccaatttgccaattcgccctataatgaggcggtattacaattacttgcccgttgatttaccaacgattgtaaccgat

SEQ ID NO: 163735 - DNA, 358 bp, Homo sapiens
actactactaaattgccggccgcgtcgacggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163736 - DNA, 459 bp, Homo sapiens
gggctgcatggaattggacacgagccgaagcggggacggcccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaagggttatcactaggctaaaactggacaaagaccgcaaaaagatcctcgaacggaaagccaaatctcgcaggtggaggaaggcatcaggagaccttagaggtcggtt

SEQ ID NO: 163737 - DNA, 515 bp, Homo sapiens
  misc_feature (1)..(1): n is a, c, g, or t
  misc_feature (3)..(3): n is a, c, g, or t
  misc_feature (6)..(6): n is a, c, g, or t
  misc_feature (110)..(110): n is a, c, g, or t
ntngcnttcctgagggagtgggtggagagcatgggtggtaaagtaccacctgctactcagaaagctaaatcagaagaaaataccaaggaagaaaaacctgatagtaaganggtggaggaagacttaaaggcagacgaaccatcaagtgaggaaagtgatctagaaattgataaagaaggtgtgattgaaccagacactgatgctcctcaagaaatgggagatgaaaatgcggagataacggaggagatgatggatcaggcaaatgataaaaaagtggctgctattgaagccctaaatgatggtgaactccagaaagccattgacttattcacagatgccatcaagctgaatcctcgcttggccattttgtatgccaagagggccagtgtcttcgtcaaattacagaagtcgccaagtaggaaaggaaaagggcaaatacaaggaagaaaccattgagaagatgcaggaataaagtaatcttatatacaagctttgattaaaacttgaaacaaaga

SEQ ID NO: 163738 - DNA, 447 bp, Homo sapiens
agtgaaaaagaaacaaatcttataatgaagcacagaagaggctttaagaattactgataccatcttgccttttctcctttgttggtaggaaattagtaaataagccaggtttgatggctaaagagtgatttctggagttttttaaaagttaaaatcttttcttattaggcatccacctaccccaggtttgggaaatggtattgaatgttgggctttcccttgtgttttagtgattatttaaagcttgggagtgtttttttcttatttttctgcaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163739 - DNA, 1015 bp, Homo sapiens
taaatttatttcccagtttactcccctcgctcaaactccgcgcccctctcgctccgagagacataggtctcgcgagatctttggtaaacttacagaaccggaagcagcgtgtagttctcttcccttttgcggccatcaccgaagcgggagcgggtaaggattcggcgggcaagcgggtgtaatcagcagccatccgttcttgggcatggtggcttccgaccgcggggaccccgagagtctcttgtcggccgagtagcagccaggaaggagagactgggatggttttttatctgttgctttcttaaatcaagggccgccgggccggagatggatggagggaccggggatttgggaactcgaaaacgagctgagggaagggagcctgtggaaatagactggagtctgggtagtgtcgtttcctagagaatggtctcgaagtaacttctcggtaaagtcttcacggaatttccagaccacacttgcccactgggaggcttttaggacccgagacgtgtgcaggcttttccagccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163740 - DNA, 1080 bp, Homo sapiens
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaaaaaaacaaaaaaaaaaaaaaaaaaaaaacaaaaaaaaaaaaaaggggggggggcgcaaaaaaaacatcccccggagggggaccacactactaagacgagacacccactgatgttaggctgcaaaaaggagggggctcccacagaggagcgcccgacaatataaaggaacaaggacgacacacgcgcgcggattaaaaccaagcgtcgacgacggcggaacaacacatggccacgggggcagcctgtggcggaaaggcaccctatatctgggggggcgcacaccgcgggcgacccacactcagacagaaatgacaccgtccgcggacacaacaaccacaaggcaacgcggtacaacaggcgactatcgcgcggcgc

SEQ ID NO: 163741 - DNA, 1232 bp, Homo sapiens
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaaaaaaacaaaaaaaaaaaaaaaaaaaaaacaaaaaaaaaaaaaaacaaaaaaacaaagcaaaaccaacggacgcacccccaacaaaaaacagacaaaaaggggggggcgagtcccaaagaaagaccaagcaaaggacggacacaacgcgagcacacagcaaaacacaaacacaagaaagcacgcgcacaacacgagagaagaaatctaacagctcgagaggagaaacacagaccgcccaaccggctgagtgcacacacaaccctgccgctaacatcagcgagagaagaccacacagcgcgcagcaaacagcagcaagcaacacagaaacaaaaagcgagcgacaggcagatccacccgaacaaacgaaagacaactgtgaacaagtgagagagcacaagaaacacaagcctacgcacacaaaaaaatgcaacgcgacaacataacagaacagccacgcaatcagcagaaacacgaacgaccaacgacagacgacacaagcaacgtcacgatcgacacagacgacctga

SEQ ID NO: 163742 - DNA, 1049 bp, Homo sapiens
  misc_feature (789)..(789): n is a, c, g, or t
  misc_feature (792)..(792): n is a, c, g, or t
  misc_feature (801)..(801): n is a, c, g, or t
  misc_feature (803)..(803): n is a, c, g, or t
  misc_feature (813)..(813): n is a, c, g, or t
  misc_feature (826)..(826): n is a, c, g, or t
  misc_feature (832)..(832): n is a, c, g, or t
  misc_feature (840)..(840): n is a, c, g, or t
  misc_feature (847)..(847): n is a, c, g, or t
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaaaaaaacaaaaaaaaaaaaaaaaaaaaaacaaaaaaaaaaaaaaaaaaaaaaaaaaaaaaaacatggtgggccgccttggcccantcnattttagantngggcaagctntgcttgcggcccnattcgngctacttngccattngccctatagggaggcgattaaattactgggcgggttttacaacggggggcggggaaacctggcgtacccattaaaggcctggagaaaatcccttttccggggggggaaaaagaaaagcccccccccaccccttttcaaaagtggcagcctgatggggaaggaaatttcccgtaatttttgtaaaaacccggaaatttttgaa

SEQ ID NO: 163743 - DNA, 984 bp, Homo sapiens
agcggccgccttttttggtacttctagcccaccggcttgggggctaggttggctccatcttccccatggccctgggcctgagaatagtgggcaactccaggggaatggtatggcaaggctgcagccttggggctgcaactcctcactcaggagtctgcctctagacatctccctggtgggtattggcattaggggtagaacccgggcttgcctgacagtctgagggctgtttggccaaattgggtgtgcgatggtctgcaactggagtgtcacctcacttgactgaatggtggtggtgagctcaccccattactgtgtgtggatgtctgctgagctgtgtagagtgggagtgtccctgggtgactttggggtgggtgtagagaagaaacaggcaagcgggaagtgaggggctaggacttcccagaaaaattacagggcatactaggagcttgactggggttctcttcccttttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163744 - DNA, 670 bp, Homo sapiens
gaaaatatgcaaacactctgtgatcaaacttaaaagtcattgccattcatcattaataaaagttgccatttcaactacgtcccaacattccctaatagggtattcagggaacctgtcttaaattgtatttagtctaatacattctcctcccctagctcaaagttccaagatttagataagccggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163745 - DNA, 1279 bp, Homo sapiens
agcggccgccttttttggtacttctagcccaccggcttgggggctaggttggctccatcttccccatggccctgggcctgagaatagtgggcaactccaggggaatggtatggcaaggctgcagccttggggctgcaactcctcactcaggagtctgcctctagacatctccctggtgggtattggcattaggggtagaacccgggcttgcctgacagtctgagggctgtttggccaaattgggtgtgcgatggtctgcaactggagtgtcacctcacttgactgaatggtggtggtgagctcaccccattactgtgtgtggatgtctgctgagctgtgtagagtgggagtgtccctgggtgactttggggtgggtgtagagaagaaacaggcaagcgggaagtgaggggctaggacttcccagaaaaattacagggcatactaggagcttgactggggttctcttcccttttgcggccatcaccgaagcgggagcgggtaaggattcggcgggcaagcgggtgtaatcagcagccatccgttcttgggcatggtggcttccgaccgcggggaccccgagagtctcttgtcggccgagtagcagccaggaaggagagactgggatggttttttatctgttgctttcttaaatcaagggccgccgggccggagatggatggagggaccggggatttgggaactcgaaaacgagctgagggaagggagcctgtggaaatagactggagtctgggtagtgtcgtttcctagagaatggtctcgaagtaacttctcgccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163746 - DNA, 526 bp, Homo sapiens
gggctgcatggaattggacacgagccgaagcggggacggcccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163747 - DNA, 1018 bp, Homo sapiens
taaatttatttcccagtttactcccctcgctcaaactccgcgcccctctcgctccgagagacataggtctcgcgagatctttggtaaacttacagaaccggaagcagcgtgtagttctcttcccttttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaaaaaaacaaaaaaaaaaaaaaaaaaaaaacaaaaaaaaaaaaaaggggggggggcgcaaaaaaaacatcccccggagggggaccacactactaagacgagacacccactgatgttaggctgcaaaaaggagggggctcccacagaggagcgcccgacaatataaaggaacaaggacgacacacgcgcgcggattaaaaccaagcgtcgacgacggcggaacaacacatggccacgggggcagcctgtggcggaaaggcaccctatatctgggggggcgcacaccgcgggcgacccacactcagacagaaatgacaccgtccgcggacacaacaaccacaaggcaacgcggtacaacaggcgactatcgcgcggcgc

SEQ ID NO: 163748 - DNA, 928 bp, Homo sapiens
cacttggctcgcagctgtctcactagcccgtcccttttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaaaaaaacaaaaaaaaaaaaaaaaaaaaaacaaaaaaaaaaaaaaggggggggggcgcaaaaaaaacatcccccggagggggaccacactactaagacgagacacccactgatgttaggctgcaaaaaggagggggctcccacagaggagcgcccgacaatataaaggaacaaggacgacacacgcgcgcggattaaaaccaagcgtcgacgacggcggaacaacacatggccacgggggcagcctgtggcggaaaggcaccctatatctgggggggcgcacaccgcgggcgacccacactcagacagaaatgacaccgtccgcggacacaacaaccacaaggcaacgcggtacaacaggcgactatcgcgcggcgc

SEQ ID NO: 163749 - DNA, 766 bp, Homo sapiens
  misc_feature (709)..(709): n is a, c, g, or t
  misc_feature (713)..(713): n is a, c, g, or t
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaacaanaaanaaacaaacaaaacacacaaaatgtgggcgcaacgcgccccaaacattcaagcc

SEQ ID NO: 163750 - DNA, 867 bp, Homo sapiens
  misc_feature (711)..(712): n is a, c, g, or t
  misc_feature (714)..(714): n is a, c, g, or t
  misc_feature (716)..(716): n is a, c, g, or t
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaaaaaaannananctcgaattcggcacgagtctccctatcaggagttcactgaccacctcgtcaagacccacaccagagtctccgtgcagcggactcaggctccagctgtggctacaacatagggtttttatacaagaaaaataaagtgaattaatcgtgaaaa

SEQ ID NO: 163751 - DNA, 826 bp, Homo sapiens
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaagaaacaccacgaacaaaacctttttgtggccggctcggccccggaaaaattttcttaaacccctccgtgggggccggggcccccggggttagtacaccgcggccaaaccggtcccaggaac

SEQ ID NO: 163752 - DNA, 959 bp, Homo sapiens
  misc_feature (744)..(744): n is a, c, g, or t
  misc_feature (747)..(747): n is a, c, g, or t
  misc_feature (756)..(756): n is a, c, g, or t
  misc_feature (758)..(758): n is a, c, g, or t
  misc_feature (768)..(768): n is a, c, g, or t
  misc_feature (781)..(781): n is a, c, g, or t
  misc_feature (787)..(787): n is a, c, g, or t
  misc_feature (795)..(795): n is a, c, g, or t
  misc_feature (802)..(802): n is a, c, g, or t
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaaaaaaaaaaaaaaaaaacatggtgggccgccttggcccantcnattttagantngggcaagctntgcttgcggcccnattcgngctacttngccattngccctatagggggtggtattaaaaataacgtgccgtggttttcaaacgttggaatgggaaaaacccttgtgttccccaatttaaatgggtatggagcaaaatccccttttgccaatttgggtaaaaaaaaaagagccccacccgatgtctttttcaa

SEQ ID NO: 163753 - DNA, 1267 bp, Homo sapiens
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaaaaaaaaaaaaaaaaaaaaaaaaaaaaacaaaaaaaaaaaacaaaaaaaaaaaaaaaaaaaaaacaaaaaaaaaaaaaaacaaaaaaacaaagcaaaaccaacggacgcacccccaacaaaaaacagacaaaaaggggggggcgagtcccaaagaaagaccaagcaaaggacggacacaacgcgagcacacagcaaaacacaaacacaagaaagcacgcgcacaacacgagagaagaaatctaacagctcgagaggagaaacacagaccgcccaaccggctgagtgcacacacaaccctgccgctaacatcagcgagagaagaccacacagcgcgcagcaaacagcagcaagcaacacagaaacaaaaagcgagcgacaggcagatccacccgaacaaacgaaagacaactgtgaacaagtgagagagcacaagaaacacaagcctacgcacacaaaaaaatgcaacgcgacaacataacagaacagccacgcaatcagcagaaacacgaacgaccaacgacagacgacacaagcaacgtcacgatcgacacagacgacctga

SEQ ID NO: 163754 - DNA, 1272 bp, Homo sapiens
  misc_feature (708)..(708): n is a, c, g, or t
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaaaanaaaaaaaaaaaaaaaaaaaaaaaaaaaaaaaaaaaaaaaaaacaaaaaaaaaaaaaaaaaaaaaacaaaaaaaaaaaaaaacaaaaaaacaaagcaaaaccaacggacgcacccccaacaaaaaacagacaaaaaggggggggcgagtcccaaagaaagaccaagcaaaggacggacacaacgcgagcacacagcaaaacacaaacacaagaaagcacgcgcacaacacgagagaagaaatctaacagctcgagaggagaaacacagaccgcccaaccggctgagtgcacacacaaccctgccgctaacatcagcgagagaagaccacacagcgcgcagcaaacagcagcaagcaacacagaaacaaaaagcgagcgacaggcagatccacccgaacaaacgaaagacaactgtgaacaagtgagagagcacaagaaacacaagcctacgcacacaaaaaaatgcaacgcgacaacataacagaacagccacgcaatcagcagaaacacgaacgaccaacgacagacgacacaagcaacgtcacgatcgacacagacgacctga

SEQ ID NO: 163755 - DNA, 1291 bp, Homo sapiens
  misc_feature (708)..(708): n is a, c, g, or t
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaaaanaaaaaaaaaaaaaaaaaaaaaaaaaaaaaaaaaaaaaaaaaaaaaaaacaaaaaaaaaaaacaaaaaaaaaaaaaaaaaaaaaacaaaaaaaaaaaaaaacaaaaaaacaaagcaaaaccaacggacgcacccccaacaaaaaacagacaaaaaggggggggcgagtcccaaagaaagaccaagcaaaggacggacacaacgcgagcacacagcaaaacacaaacacaagaaagcacgcgcacaacacgagagaagaaatctaacagctcgagaggagaaacacagaccgcccaaccggctgagtgcacacacaaccctgccgctaacatcagcgagagaagaccacacagcgcgcagcaaacagcagcaagcaacacagaaacaaaaagcgagcgacaggcagatccacccgaacaaacgaaagacaactgtgaacaagtgagagagcacaagaaacacaagcctacgcacacaaaaaaatgcaacgcgacaacataacagaacagccacgcaatcagcagaaacacgaacgaccaacgacagacgacacaagcaacgtcacgatcgacacagacgacctga

SEQ ID NO: 163756 - DNA, 733 bp, Homo sapiens
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaacaaaaaaaaaaggatggcctcgctggcctca

SEQ ID NO: 163757 - DNA, 1037 bp, Homo sapiens
  misc_feature (777)..(777): n is a, c, g, or t
  misc_feature (780)..(780): n is a, c, g, or t
  misc_feature (789)..(789): n is a, c, g, or t
  misc_feature (791)..(791): n is a, c, g, or t
  misc_feature (801)..(801): n is a, c, g, or t
  misc_feature (814)..(814): n is a, c, g, or t
  misc_feature (820)..(820): n is a, c, g, or t
  misc_feature (828)..(828): n is a, c, g, or t
  misc_feature (835)..(835): n is a, c, g, or t
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaaaaaaaaaaaaagacaaaaataagaaaataaaaaaaaaaaaaaaaaaaaacatggtgggccgccttggcccantcnattttagantngggcaagctntgcttgcggcccnattcgngctacttngccattngccctatagggaggcgattaaattactgggcgggttttacaacggggggcggggaaacctggcgtacccattaaaggcctggagaaaatcccttttccggggggggaaaaagaaaagcccccccccaccccttttcaaaagtggcagcctgatggggaaggaaatttcccgtaatttttgtaaaaacccggaaatttttgaa

SEQ ID NO: 163758 - DNA, 693 bp, Homo sapiens
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaagcttgtatataagattactttattactgcatattctcaatggtttcttcatgtcgagc

SEQ ID NO: 163759 - DNA, 1045 bp, Homo sapiens
taaatttatttcccagtttactcccctcgctcaaactccgcgcccctctcgctccgagagacataggtctcgcgagatctttggtaaacttacagaaccggaagcagcgtgtagttctcttcccttttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagacaaacacaaaaaaaacaaaaggaaaaaaaaaaaaaacaaaaaaaaaaaaaaaaaaaaaacaaaaaaaaaaaaaaggggggggggcgcaaaaaaaacatcccccggagggggaccacactactaagacgagacacccactgatgttaggctgcaaaaaggagggggctcccacagaggagcgcccgacaatataaaggaacaaggacgacacacgcgcgcggattaaaaccaagcgtcgacgacggcggaacaacacatggccacgggggcagcctgtggcggaaaggcaccctatatctgggggggcgcacaccgcgggcgacccacactcagacagaaatgacaccgtccgcggacacaacaaccacaaggcaacgcggtacaacaggcgactatcgcgcggcgc

SEQ ID NO: 163760 - DNA, 1658 bp, Homo sapiens
  misc_feature (1658)..(1658): n is a, c, g, or t
agcggccgccttttttggtacttctagcccaccggcttgggggctaggttggctccatcttccccatggccctgggcctgagaatagtgggcaactccaggggaatggtatggcaaggctgcagccttggggctgcaactcctcactcaggagtctgcctctagacatctccctggtgggtattggcattaggggtagaacccgggcttgcctgacagtctgagggctgtttggccaaattgggtgtgcgatggtctgcaactggagtgtcacctcacttgactgaatggtggtggtgagctcaccccattactgtgtgtggatgtctgctgagctgtgtagagtgggagtgtccctgggtgactttggggtgggtgtagagaagaaacaggcaagcgggaagtgaggggctaggacttcccagaaaaattacagggcatactaggagcttgactggggttctcttcccttttgcggccatcaccgaagcgggagcgggtaaggattcggcgggcaagcgggtgtaatcagcagccatccgttcttgggcatggtggcttccgaccgcggggaccccgagagtctcttgtcggccgagtagcagccaggaaggagagactgggatggttttttatctgttgctttcttaaatcaagggccgccgggccggagatggatggagggaccggggatttgggaactcgaaaacgagctgagggaagggagcctgtggaaatagactggagtctgggtagtgtcgtttcctagagaatggtctcgaagtaacttctcgccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaaaaaaaaaaaaaattcgcagaaatagttctctctggggcctggagccctgtgtcaaggcctttgaggcccagaatctagaacccaaagcgcctgtgttgcttgttgttgaacaggcctgtgccatgcctagagggttgcggtaatcctcgtggcccacggttaccttggccttggtagtctccagcccagtttttcccaaccaggggtgccctgagtccagaggcttttgtctaaaggttgggggccgttccccttggccaggggcgtttaaaaaatatgggcgcaaagaggggcgaagagcggcttcagattggccacgactgtggcgtgctggttgggcccggacctctccctttggccaaggggagcacgagn

SEQ ID NO: 163761 - DNA, 1096 bp, Homo sapiens
aaatagctagtagagcggtggtaacggcagaggcgaacgggacgccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaaaaaaaaaaaaaaaaaaaaaaaaaaaaacaaaaaaaaaaaacaaaaaaaaaaaaaaaaaaaaaacaaaaaaaaaaaaaaacaaaaaaacaaagcaaaaccaacggacgcacccccaacaaaaaacagacaaaaaggggggggcgagtcccaaagaaagaccaagcaaaggacggacacaacgcgagcacacagcaaaacacaaacacaagaaagcacgcgcacaacacgagagaagaaatctaacagctcgagaggagaaacacagaccgcccaaccggctgagtgcacacacaaccctgccgctaacatcagcgagagaagaccacacagcgcgcagcaaacagcagcaagcaacacagaaacaaaaagcgagcgacaggcagatccacccgaacaaacgaaagacaactgtgaacaagtgagagagcacaagaaacacaagcctacgcacacaaaaaaatgcaacgcgacaacataacagaacagccacgcaatcagcagaaacacgaacgaccaacgacagacgacacaagcaacgtcacgatcgacacagacgacctga

SEQ ID NO: 163762 - DNA, 834 bp, Homo sapiens
  misc_feature (704)..(704): n is a, c, g, or t
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatcgttggctggcgacacgtgtcgccagccaacaggattccaggaaccagtgtttgatgaagctaggactgaggagcaagcgagcaagcagcagttcgtggtgaagatagganaagagtccaggagccagtgcgatttggtgaaggaagctaggaagaaggaaggagcgctaacgatttggtggtgaagctaggaaaaaggattccaggaaggagcgggtgcaatttggtgatgtaagttgca

SEQ ID NO: 163763 - DNA, 635 bp, Homo sapiens
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctgaaggcactcgaactgatgacggcatgaaagccctggaca

SEQ ID NO: 163764 - DNA, 909 bp, Homo sapiens
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaagggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163765 - DNA, 733 bp, Homo sapiens
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaagcttgggagtgtttttttcttatttttctgcaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163766 - DNA, 1117 bp, Homo sapiens
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaagggtaggtgtttttgagaatgcttgagagaaggaaattatggcaattattgttgacatgattgtttacagagcaaggccatagaaatagtccttgattttacatgtgctggaaaaaaacattttaaagtaaatactactgcacttgtattgaaaattctaataccatttaaaatgtttctgacatcaaagtgttaacggtcattatgtttctattagtttgtttttgagacagtcttgctctttcacccaggccggagtgcagtggcacagtctcggctcactgcagcctccacctcccaagtgcaagcgattctcccgcctcagcctcctgagtgtagctgtgactacatgcgtgcaccactacacccggctaatttttgtacttcttagtacaaagtttcaccatgttggccaggctggtcttgaactcctgacctcaggtgatttgcctgcctcagcctcctaaagtgctgggattacaggcatgagccaccatgcctgtcccattatgtatattgggcggaggttgcagtgagccgagatcgcaccattgcacttcagcctaggcaacgagtgaaaacgccatct

SEQ ID NO: 163767 - DNA, 1487 bp, Homo sapiens
agcggccgccttttttggtacttctagcccaccggcttgggggctaggttggctccatcttccccatggccctgggcctgagaatagtgggcaactccaggggaatggtatggcaaggctgcagccttggggctgcaactcctcactcaggagtctgcctctagacatctccctggtgggtattggcattaggggtagaacccgggcttgcctgacagtctgagggctgtttggccaaattgggtgtgcgatggtctgcaactggagtgtcacctcacttgactgaatggtggtggtgagctcaccccattactgtgtgtggatgtctgctgagctgtgtagagtgggagtgtccctgggtgactttggggtgggtgtagagaagaaacaggcaagcgggaagtgaggggctaggacttcccagaaaaattacagggcatactaggagcttgactggggttctcttcccttttgcggccatcaccgaagcgggagcgggtaaggattcggcgggcaagcgggtgtaatcagcagccatccgttcttgggcatggtggcttccgaccgcggggaccccgagagtctcttgtcggccgagtagcagccaggaaggagagactgggatggttttttatctgttgctttcttaaatcaagggccgccgggccggagatggatggagggaccggggatttgggaactcgaaaacgagctgagggaagggagcctgtggaaatagactggagtctgggtagtgtcgtttcctagagaatggtctcgaagtaacttctcgccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaagggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163768 - DNA, 734 bp, Homo sapiens
gggctgcatggaattggacacgagccgaagcggggacggcccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaagggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163769 - DNA, 426 bp, Homo sapiens
cacttggctcgcagctgtctcactagcccgtcccttttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaagacaggtgtatactgctaactgacaagccaaaagtctgacgaagcattgc

SEQ ID NO: 163770 - DNA, 1390 bp, Homo sapiens
taaatttatttcccagtttactcccctcgctcaaactccgcgcccctctcgctccgagagacataggtctcgcgagatctttggtaaacttacagaaccggaagcagcgtgtagttctcttcccttttgcggccatcaccgaagcgggagcgggtaaggattcggcgggcaagcgggtgtaatcagcagccatccgttcttgggcatggtggcttccgaccgcggggaccccgagagtctcttgtcggccgagtagcagccaggaaggagagactgggatggttttttatctgttgctttcttaaatcaagggccgccgggccggagatggatggagggaccggggatttgggaactcgaaaacgagctgagggaagggagcctgtggaaatagactggagtctgggtagtgtcgtttcctagagaatggtctcgaagtaacttctcggtaaagtcttcacggaatttccagaccacacttgcccactgggaggcttttaggacccgagacgtgtgcaggcttttccagccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggaggtttcaatgtttggtcattgaagaggcagttgaggaccagtaaacagaattgctcccaatctagattcaggagctgtaactgaagcacagtcacgttatcgtttgcacttacaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagagaacgaagacacacacaacaacacctcaggggggaccggacccataggcctatggagccaataaatacaggcggagataacagcggcgggcaaccgggtaccagaacccctgcaaatccctcccagcgcgataaagggggaagccatcaaatgccctcagacgatggcgactgaaccgactggccttcaaggggcctaacgggcgcacgagccgcttgcggaggccccccgccccccccccccagcgcccccaccccg

SEQ ID NO: 163771 - DNA, 528 bp, Homo sapiens
actagttctagatcggagcggctgcccttttttgtgttttttaaataaaatgtcagatgcaaaaatgctgcacttatttctcttaatacattgaaaatagtggaagatgcagattttaatccttcatgagtccaagctggaacatgacttctgctaatcagatgtcatcaacatagcgaactccaactttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaatggggtgaatgcctacgtggacaattgtgccattagccttttcccgctgcagtcgatgc

SEQ ID NO: 163772 - DNA, 1056 bp, Homo sapiens
taaatttatttcccagtttactcccctcgctcaaactccgcgcccctctcgctccgagagacataggtctcgcgagatctttggtaaacttacagaaccggaagcagcgtgtagttctcttcccttttgcggccatcaccgaagcgggagcgggtaaggattcggcgggcaagcgggtgtaatcagcagccatccgttcttgggcatggtggcttccgaccgcggggaccccgagagtctcttgtcggccgagtagcagccaggaaggagagactgggatggttttttatctgttgctttcttaaatcaagggccgccgggccggagatggatggagggaccggggatttgggaactcgaaaacgagctgagggaagggagcctgtggaaatagactggagtctgggtagtgtcgtttcctagagaatggtctcgaagtaacttctcggtaaagtcttcacggaatttccagaccacacttgcccactgggaggcttttaggacccgagacgtgtgcaggcttttccagccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcagggtgtgtatccctacttgttctcgttgtcttgatggatattttacgcacttagcttagaagagggattgcattcctgagaaagatgcttctgagactcttgctcccaaagagtggcaagatgagttgagccagggaccaaaaaacagtaagtaagctgcttttcagtttttaattgtattatttggtgaaaatctttttttttttttttttgagatgaagtctcgctcttgtcccccccaggctggagtgcagtggtgccatctcagctcactgcaaccttcgcctcccgggttcaggcgattctcctgcctcagcctcccgagtagctgggattacaagcgcccgccaccacg

SEQ ID NO: 163773 - DNA, 223 bp, Homo sapiens
  misc_feature (29)..(29): n is a, c, g, or t
cagggcttcccaaggatgtccagcccccncacccacacgttaacataatgagtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163774 - DNA, 207 bp, Homo sapiens
  misc_feature (34)..(34): n is a, c, g, or t
gcggccgactactactaaattcgcgggggcgtcnagtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163775 - DNA, 528 bp, Homo sapiens
  misc_feature (26)..(26): n is a, c, g, or t
tcagcatccgaaaccccacgcgtcgnccgaagcgggaggcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163776 - DNA, 399 bp, Homo sapiens
gcggccgcctactactactactgctcgaattcaagcttctaacgatgtacggggacatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163777 - DNA, 544 bp, Homo sapiens
cggacgcgtgggtcgacccacgcgtcgcccacgcgtccgatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163778 - DNA, 639 bp, Homo sapiens
taaatttatttcccagtttactcccctcgctcaaactccgcgcccctctcgctccgagagacataggtctcgcgagatctttggtaaacttacagaaccggaagcagcgtgtagttctcttcccttttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163779 - DNA, 554 bp, Homo sapiens
agagagggagcacaatggcatgagtgagagcgtgtggatatctggacgaggcacggaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163780 - DNA, 812 bp, Homo sapiens
  misc_feature (22)..(23): n is a, c, g, or t
  misc_feature (593)..(593): n is a, c, g, or t
atcgaaaaccttgggatgaacnncgtcattttgatcgaaccctgcaattcggccattatggccggggctcttcccttttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaantaaataatgctctacatcatgtcggtcggcttggcccaagcgtctttaaacttgaacaagcttattcaatgcggccgaatttcgagtctatttggccaattccccctattatgagttgatttacaattaactggcgatgttttacaaccgcttaactggggccttgccgttccccaatttaatcggcttcgaatacattctcctttctcccttgcggcg

SEQ ID NO: 163781 - DNA, 348 bp, Homo sapiens
ttgatccgaattcggatccaaccggatcaactcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163782 - DNA, 284 bp, Homo sapiens
gctgccgctactactactaaattcgcggcccgtcgaccaccgaagcgggaggcgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163783 - DNA, 549 bp, Homo sapiens
cacttggctcgcagctgtctcactagcccgtcccttttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163784 - DNA, 536 bp, Homo sapiens
gagctccttggaaaggaggggacgaataatcatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaaga

SEQ ID NO: 163785 - DNA, 1121 bp, Homo sapiens
  misc_feature (538)..(538): n is a, c, g, or t
ccacctgctctcctccgttgtaggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaaaanaaaaaaaaaaaaaaaaaaaaaaaaaaaaaaaaaaaaaaaaaaaaaaaacaaaaaaaaaaaacaaaaaaaaaaaaaaaaaaaaaacaaaaaaaaaaaaaaacaaaaaaacaaagcaaaaccaacggacgcacccccaacaaaaaacagacaaaaaggggggggcgagtcccaaagaaagaccaagcaaaggacggacacaacgcgagcacacagcaaaacacaaacacaagaaagcacgcgcacaacacgagagaagaaatctaacagctcgagaggagaaacacagaccgcccaaccggctgagtgcacacacaaccctgccgctaacatcagcgagagaagaccacacagcgcgcagcaaacagcagcaagcaacacagaaacaaaaagcgagcgacaggcagatccacccgaacaaacgaaagacaactgtgaacaagtgagagagcacaagaaacacaagcctacgcacacaaaaaaatgcaacgcgacaacataacagaacagccacgcaatcagcagaaacacgaacgaccaacgacagacgacacaagcaacgtcacgatcgacacagacgacctga

SEQ ID NO: 163786 - DNA, 1094 bp, Homo sapiens
  misc_feature (26)..(26): n is a, c, g, or t
tcagcatccgaaaccccacgcgtcgnccgaagcgggaggcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaaaaaaaaaaaaaaaaaaaaaaaaaaaaacaaaaaaaaaaaacaaaaaaaaaaaaaaaaaaaaaacaaaaaaaaaaaaaaacaaaaaaacaaagcaaaaccaacggacgcacccccaacaaaaaacagacaaaaaggggggggcgagtcccaaagaaagaccaagcaaaggacggacacaacgcgagcacacagcaaaacacaaacacaagaaagcacgcgcacaacacgagagaagaaatctaacagctcgagaggagaaacacagaccgcccaaccggctgagtgcacacacaaccctgccgctaacatcagcgagagaagaccacacagcgcgcagcaaacagcagcaagcaacacagaaacaaaaagcgagcgacaggcagatccacccgaacaaacgaaagacaactgtgaacaagtgagagagcacaagaaacacaagcctacgcacacaaaaaaatgcaacgcgacaacataacagaacagccacgcaatcagcagaaacacgaacgaccaacgacagacgacacaagcaacgtcacgatcgacacagacgacctga

SEQ ID NO: 163787 - DNA, 1098 bp, Homo sapiens
taaatttatttcccagtttactcccctcgctcaaactccgcgcccctctcgctccgagagacataggtctcgcgagatctttggtaaacttacagaaccggaagcagcgtgtagttctcttcccttttgcggccatcaccgaagcgggagcggccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatcaaaaaaaaaaaaaaaaaaaaaaaaaaaaaaacaaaaaaaaaaaacaaaaaaaaaaaaaaaaaaaaaacaaaaaaaaaaaaaaacaaaaaaacaaagcaaaaccaacggacgcacccccaacaaaaaacagacaaaaaggggggggcgagtcccaaagaaagaccaagcaaaggacggacacaacgcgagcacacagcaaaacacaaacacaagaaagcacgcgcacaacacgagagaagaaatctaacagctcgagaggagaaacacagaccgcccaaccggctgagtgcacacacaaccctgccgctaacatcagcgagagaagaccacacagcgcgcagcaaacagcagcaagcaacacagaaacaaaaagcgagcgacaggcagatccacccgaacaaacgaaagacaactgtgaacaagtgagagagcacaagaaacacaagcctacgcacacaaaaaaatgcaacgcgacaacataacagaacagccacgcaatcagcagaaacacgaacgaccaacgacagacgacacaagcaacgtcacgatcgacacagacgacctga

SEQ ID NO: 163788 - DNA, 1624 bp, Homo sapiens
  misc_feature (1060)..(1060): n is a, c, g, or t
taaatttatttcccagtttactcccctcgctcaaactccgcgcccctctcgctccgagagacataggtctcgcgagatctttggtaaacttacagaaccggaagcagcgtgtagttctcttcccttttgcggccatcaccgaagcgggagcgggtaaggattcggcgggcaagcgggtgtaatcagcagccatccgttcttgggcatggtggcttccgaccgcggggaccccgagagtctcttgtcggccgagtagcagccaggaaggagagactgggatggttttttatctgttgctttcttaaatcaagggccgccgggccggagatggatggagggaccggggatttgggaactcgaaaacgagctgagggaagggagcctgtggaaatagactggagtctgggtagtgtcgtttcctagagaatggtctcgaagtaacttctcggtaaagtcttcacggaatttccagaccacacttgcccactgggaggcttttaggacccgagacgtgtgcaggcttttccagccaaaatgaagtttaatccctttgtgacttccgaccgaagcaagaatcgcaaaaggcatttcaatgcaccttcccacattcgaaggaagattatgtcttcccctctttccaaagagctgagacagaagtacaacgtgcgatccatgcccatccgaaaggatgatgaagttcagacggggacatgcccatccgaaaggatgatgaagttcaggttgtacgtggacactataaaggtcagcaaattggcaaagtagtccaggtttacaggaagaaatatgttatctacattgaacgggtgcagcgggaaaaggctaatggcacaactgtccacgtaggcattcaccccagcaaggtggttatcactaggctaaaactggacaaagaccgcaaaaagatcctcgaacggaaagccaaatctcgccaagtaggaaaggaaaagggcaaatacaaggaagaaaccattgagaagatgcaggaataaagtaatcttatatacaagctttgattaaaacttgaaacaaagaaaaaaanaaaaaaaaaaaaaaaaaaaaaaaaaaaaaaaaaaaaaaaaaacaaaaaaaaaaaaaaaaaaaaaacaaaaaaaaaaaaaaacaaaaaaacaaagcaaaaccaacggacgcacccccaacaaaaaacagacaaaaaggggggggcgagtcccaaagaaagaccaagcaaaggacggacacaacgcgagcacacagcaaaacacaaacacaagaaagcacgcgcacaacacgagagaagaaatctaacagctcgagaggagaaacacagaccgcccaaccggctgagtgcacacacaaccctgccgctaacatcagcgagagaagaccacacagcgcgcagcaaacagcagcaagcaacacagaaacaaaaagcgagcgacaggcagatccacccgaacaaacgaaagacaactgtgaacaagtgagagagcacaagaaacacaagcctacgcacacaaaaaaatgcaacgcgacaacataacagaacagccacgcaatcagcagaaacacgaacgaccaacgacagacgacacaagcaacgtcacgatcgacacagacgacctga

SEQ ID NO: 163789 - DNA, 859 bp, Homo sapiens
tgaggctgactcgtgtggaagctggagattctgtgttcctcataggcagattccagaacagctgcctttaaggaccgttttaaagtgggggcagtgagttgatcatgtttgaggctgcattctcttgtggctgtatctgctgttgtcattacagaagggtgtcaacatggaatgtgagtttctcctattctgaattatcattgcagctcgatccacggtatgctcaagttgtcactttatttttgtcctaaacactgacctacataacctcggaagaacaagcggtggttttagatgaagggcttcctattcaaattttcctgtaggccaatggttattagtgctgtatctactgtagtgctgtgtctattagtagtgtgtattactgtagctagttatcagtagtgtgtatctactgtagctagaggagtctttctgagatccacgaccccgggccttccccctctagtctgtctccttccctccttcccctgttgcttagattgttgttagctgttatgtaggttgtaaacttttcatcctaccaaaccccatactggatcttatggtgtccatacatttcagatatgggacagttgatatttttggagtaatatagcgggtaagatgtggagtactccaagaagcttttgcttcacatatgcagctccctctgtagctgtttggcctgtgctcttttgagtgccagtctctgagtaatcattactctcatttattgaccacccactatgtgcaaggcactggcacacaattcagagcagcagcttgtagctattaaaagtttttgttcttggctgggcgtggtggctcacgcctgtaatcctaggactttgggagg

SEQ ID NO: 163790 - DNA, 588 bp, Homo sapiens
gatcccgagcagacaatattgcctaggctggagtacagtggcacaatcatagctcactgcagccttgacctcccaggctcaagtgatcttcccacctcagcctcccaaatagctgggaccacaggtgttacgccacaacacccagctaattttttaaatttttgtagagatggggtctcactatgttgcccaggctagtctcaagctcctgagctcaagcaattctcctgcctcagcataccaaagtgttaggattaaaggtatgagtcaccacgcccagccttaagttcagttttcttgtgctaacattccttgatcacttagtgctaggttctgcactaagaactttacacaaatcattttacttaatcctcatcacagccctatgatgaaaatcagactcccagggttcacacaccagctctgatgctcattaactgagaatctacttagcctctctgtgcctcagtttccctatctgtagggtggagaccctagtagtataccatatagacactgtgaggattagaatgagttaatatgcacaagcatagcactctgcctgtcacataatagacattcagtaaa

SEQ ID NO: 163791 - DNA, 248 bp, Homo sapiens
ctaagtgtaggaaggattgagaagactgccatttgagctgtcagtaatgacttcaaagccacacagcagagccacaccgcttagggagctgctgcctctcctgtgaccaggaactgcactgccactcccacagtctgaaaaactgctgtgatcagggtgctacttttgctaccagctgcagacccatgcatgccacatctgctaggatgcataacaacatggatgcttgtaccttgcctcttggtgtt

SEQ ID NO: 163792 - DNA, 320 bp, Homo sapiens
ctacttaagataataatggggcatacctcatagattttaatatcattaagtgataattaattataagataatttggagaactggaaaaagttatttgaagtatggaatcagaaactgcaaagagtagggctgttgcttttttccaaacagcattatttctgtcctgtttttttgagacagagcctcactctgttgcccaggctggagtgcagtggtacaatcttggctcactgcagcctctgtctccaacctctgtttcccaggctcaggcaatcctcccacctcagtctctcaagtagatggcactacaggtgtgtgcc

SEQ ID NO: 163793 - DNA, 321 bp, Homo sapiens
agcaccctcccagacacacccaggatcaatactttgcatccttcagtcccatcaagttgacgcttagtattaagcattacagaaggaaacaaaaccaatccaaagagggtttagtttaaagttgtcctggtataagagtgaccacaaactcctggcagaaaaacataagtccttctggagtgagaagctacgttctgaatgaatcagtgaacagaaaacatgaaaaaggttcacggaagctctggattgagatgttagaccccaaatacactgcctttgcctctctcccaaggtctcatttaagtatcccaaagtattttt

SEQ ID NO: 163794 - DNA, 667 bp, Homo sapiens
gtggtggctgatatatgtaatcccagcacttttgggagactgagtcaggaggatcacttaatcctcatttaaaaggagtttgagaccagcctgggcaacaaagtgaggccttgtctctacaaaaaaattagctgggtgtggtggtaggcacctgtagtcccaactactctggagactgagctgagagaagattgtgtgaggcttggaggttgaggctgcagtgaacggacatcacaccactacactctagtcaggtgacagagcaagactctctaaataaataggaacattagatggtctctctgcactcttgcctggtggggacgtgttagataccctcgttaggttgtgatttagtttttaatctgtgagatgtttgggccaaacaacttttagctgccatggaataaactttacagtcagcgtgtgagtttgtgtttgcctttacttttttttttctatattgttttggtccatttttatcttttaatttcagaaagctgattaatctcttccttttctctttaaaaattttctttatcatgtttgtgctacagtggttattttgagaacttgttggcaggataagtggcaaaagttacgaagtagaatagagatgatttctgtttttttttttttttcttttttttgagacagtctcactctc

SEQ ID NO: 163795 - DNA, 180 bp, Homo sapiens
tactgcctcagccccagtccccgtgggagatttggggctcgccctccgtcctgggtatttacacacccacacttgcgctcacacatgtgcacacacaggcgcattcacacacttgggccacaccacgcactcacaggctgcattcttgccttgtcaggtggttttccacattccacaaga

SEQ ID NO: 163796 - DNA, 629 bp, Homo sapiens
gatctcactatgttgcccaggctggtctcaaactctgggttcaagtgatcctcccgccttggcctccccaagtgctgggattacaggaagagccataatgcacagcagggaaactgagattacaggggtgaggcataatgcacagcagggaaatatttcgggttacagatgtctgggcaccattcccattgttgtttaggtctgagtgtgtgcagtttggaaaagctgtaaagatagttgttatattcccctattaatttagaaccacttctcatgtggaatgagaggaattgaaatgagtcatgaaataactttataggattttaatttagaagacaatataaaaccataaaatatttagtgatgcagtatttgaacatgaagcatttgtgttaaagtgcaaaattaattgccaagattaatgataccaaaaggaactatattagaagctcaatgacaagtgaataatatttatcctacctatattgagggcttgttatgtgctatgcagtgggggtacattagtgaaaaagacaaacctgttccctacactcatacagtttacattctactgggagagacacgagtaagaggattacctatttgataagtactatgaaggaaagaaa

SEQ ID NO: 163797 - DNA, 282 bp, Homo sapiens
tgattgctcacagttcaatgaatatgtattgaacatttgcttggtactagattctggagctataaagaagaaaagagcaattccctgtacctgagatgcttatatattttcctggggaaatagacatgcaaacagatatttaaaatgcagcatgggctgggtgcagtggctcacacctgtaatcctagcactttgggagctggaagcaggcagatcacttgaggtcagtagttcgacaccagcctggccaacatggcaaaagcccatctctactaaagatac

SEQ ID NO: 163798 - DNA, 402 bp, Homo sapiens
gtctctgtaaacattaactaaaagtaaataaaatcaattttcatgaatacactaaaataaattcttattttattttatttattgttgacacggagtctcgctctgtcacccaggctggagtacaatgatgagatctcagctcactgcaacctctgccttccaggttcaagcgattctactgccgcagcctcccaagtagctgggactacaggcatgcaccaccatgcccagctaatttttgtatttttagtagagatgggttttcaccatgttggccaggctggtcttgaactcctgacctcaagtgatctgcctaccacagcctcccataccctaagtagttttgttaattattgtatttcctttctctactgttagaatatagatacactgaaaatctaa

SEQ ID NO: 163799 - DNA, 308 bp, Homo sapiens
aaatcagctcctacctcttagctgccacgcctggctgactttctggatttttagtacagaaggtgtttcactatgttgcccagactggtctcgaactcctgagctcaggcaatccactcaccttggcctcccgaagtgctgggattacagtcatgagccactgcgcctggccctagctggaactttcttagtcttttctagttcatgcatttctggaaaggattccccatctcctcattatttcttttgcatccactttggattcatttacttttctacaactctggctggagagagcagcagtagcc

SEQ ID NO: 163800 - DNA, 193 bp, Homo sapiens
tctctggggaggattgttggggtcttgctagctgctgtctgggttggggaagctgtgccaggtgagcttggcacaccagcctctactgctctgtagcggggcctcttccagccactctctggggcccgagcgtgatgtatcccatcagcacatacgagaactggtcatttcctatcacctccctcagccggtg

SEQ ID NO: 163801 - DNA, 265 bp, Homo sapiens
agaagggataggagagtactgagggattttaccacctctagaccctgaaggcacatggagcaggcattattactagatcctggggaaagcctggagacatggaggaagggcttcagtagcagctgtatccagagaacacagaagcccctacaaggagagggagatggggatggaggcagaggtagagtaggtgcctgacttctttctcttccactctgtaatctcctgcaagagcctcacattagctgaatacaaccagagcccc

SEQ ID NO: 163802 - DNA, 496 bp, Homo sapiens
atggttgtaaatgaacctatatgattgtaaggtctctacattctatgtgaaatggtataatatgaactctgagaagactgttaaaagttatggatagatatttaaatttgtaaagcaaccactaaaaataatgcaaaaagataaaacaaaaaagccagcagagaaattaaaacagaattctttttaaaaattcaaataatccaaaagaaggcagaaaagggggtatacaaaagaacaaaacacagagaaagcaaacaaaaagcaaattttaaaatgacagacctaaccatatcaataaggacattaaattggactaaatactccaattaaatttcagagtcaacagaagaaataaaaaagcaaaacccggctgggcacggtggctcacgcctgtaatcccagcactttgggaggccaacgcgggaagatcacctgaggtcgggagttcaagaccagcctgaccaagatggagaaaccgtctctactaaaaatacaa

SEQ ID NO: 163803 - DNA, 448 bp, Homo sapiens
attgagtaacctataaggctgcagggttggagtggggtccagagaaaaggaaagtttccaggtggtccagaatgaaaggcaagcagctctgccacatggccctgatagcccagccgatcccaagatggctcaagtgtctgcggcagatgggatggtatttgaacccatggcaaactctgatagaagaatcaaaatggagtatctacaatttaggagtgaagcctggtgctccttagcaagcagttttcctccttttggggaaggactcttggctcactgctggctgggcttagctgacagtggtctcagtgtgggaggcaccaagggattgtgaaagtaattaatgactgtaacacacagtgtgttcttttctcagggatacttgggttatatgtgctcagtggttgctaaatgagatgtcagtaaattatgcatcaggtatgaaaac

SEQ ID NO: 163804 - DNA, 513 bp, Homo sapiens
tctagcctggtgctaacacacaacaggcactcacttttgtgaactaaatgaatgtacatacttaattctcataatagatcaataagtattaccgccccattttacaggtggggaaactgagactcatagaagtaaagtgacttattcaaagtcaaatagctagtggctaaaattcaaacctagtttcctgtacttcctcgctgaaggatcctaaacagccactgctgaatgatttcattctcctttttgaaagccttgtgccctcaaaggagatagagctgaggcaggatagaaacccaggaaggggcccggctcggtggctcacgcctgtaatcccagcacttagggaggctgaggcaggtagaccactttgagctcaggagttcaagaccagcctgacatcatggtgaaaccccgaatctactaaaaatacaaaaattagctgggcatgcttctgcgtgcctataatcccagctactcaggaggctgaggctggagaatcacttgaacatg

SEQ ID NO: 163805 - DNA, 515 bp, Homo sapiens
cctcatatgacattgtttccttactcccttgcttatctcagaagctccaattagatattatcattttttgactacctcaaaaactgacactagagagtatccctttgccattaggagataaatctgtttttcttgagttatctcaaagtgatcctatgatatacagaaattagtgttgtataaggccagatttgaattacacaatccacaaggctgcccttagctagcaagcctacatcattacccaacacgtgtgtctcaacacaactttgtgattcctcactgcatacccagcaagtctcatgaagtgatcagaatgttctttgcataaagagacagtaagtggaagttaaaacttcagcagaagcaaggaatggtggcgcacacctatagtcccagctatctgggaaacagaggtaggagaatcgcttgagcccagaggttccaggccagcctgggaaacatatgagatcttgtctcttaaaaaaacaaaacaaaagtggcggccgcagcta

SEQ ID NO: 163806 - DNA, 457 bp, Homo sapiens
aagctgggaggtcagagggtaagagccaggtaggcgtggtcttaattctagcaagtccagtttaagaatcctccaagtcccctacatctcctgcaaaacacagcccagaacctcatccttctgctgaagggattcaggtatcatcaaccgaagtgagaaaaagcaaagcagattgggtctgggctcggtggccacgtctgtaatcccaacactttgggagaccaaggcagtagaactacttgagtccaggaatttgagaccagcctaagtaatttagtgacaccccttctttacaaaaaatttaaaaattagccaggagtggtagtgtgtgcctgtagtcccagctacttgggggactgaggtgggaggatggcttaagccgaggagttggaggctgcagtgaaccgtgatcatgccactgcattccagcctgggcaacagagtgagacgctgtttc

SEQ ID NO: 163807 - DNA, 166 bp, Homo sapiens
taaaaaaatgtgcattccttatcctaagcaaatccatctctgggcgactatcccaaggaaattatcagacatgcggacaaaaggggtgttcaaaaatgtccattacagcatgagttaggacaatgtaaatctggaatgagcgaaacattcaacaacaatgcccggg

SEQ ID NO: 163808 - DNA, 306 bp, Homo sapiens
gcttgaaaataatcacttccacatctggctataaaacaaggactaaccagatgttttcattttaagacattttttcactagttattttaatcttctacataacacaatcattttaacatttagttgcagtaggttattagtaatatctgcaagataaaggcgaatagtagactaactcaagtttttttttttttttttttttttttaaattgagatggagttttgctcttattgcccaggctggaatgcaatggcacgatctcgggtcactgcaacctccacctcccaggttcaggtgactctcct

SEQ ID NO: 163809 - DNA, 234 bp, Homo sapiens
atatgacgtgtggaagctatcaactatcgcattgtccccaatgtcagaatgtgctgaataagattttgctttttctcagggcccagcatttattaagcactcagcaaatgcttactaaatgaatgaatgactctacccaagcttgtgtctttgtctcgaagctgtatcttccatcacagtattaaaatgttttttatgaacatgagcatctggctgcacatacagagcagcaca

SEQ ID NO: 163810 - DNA, 147 bp, Homo sapiens
gttacaatattgttatataaccatagctagctaatacaatggagaatttggagcttatcttaaaatcaatggcaagccagctgctaaatattgtcaagcaagaaagtggcttgacatctttcctttaggaaagaaaatctagggctg

SEQ ID NO: 163811 - DNA, 922 bp, Homo sapiens
atgaattggagttatcttgtcatacccaactaaatttagagtcagtggaccaagggttacggtaaaaaagtgcttggggcacaaaccgcttgcccagggattatattgcaggccagctgccacaatgacatgctgtaaccttaaatccagttttacctactagctgttgagatgaactcttgtgactctaagtctagttttaccaaccgtgttcactcaccaatcagagcttaccagctcccaaaagctttagtagttccagtgagttttctttcaaaacaataggtcacatttctttttctaataaaactcccaaccttctttgtgttctttggacacactaggaggctaccctagtatgtgtatgtatgtatgtcctggattgcaatcctacttatatattctttctaaataaaaccttttttacttagagatttgtttctctctatatttttgactttaacagttcataacaagttgtcattactccaaacccaaatgtataatgtggaaatgccatcttttaaaaacccatctctccctttgcttttcccttttacttcatctagttgtcacgacagtggtgctcttggctgtggcactgggacttattggttggttatgattcaggaaaatgattgtctgatttagggatagtgagagtatatgtaaggtccttacatttacagggaacaattgaggtaagattttcagtaagggtagacactgaatttctgtaccaatgtctttttgggtataatgtagcagtattgcagcagttaaactgaggtctcagcaggcataggttgggatgaacaggccaaagcacctggagtttgtataatcacccacccacatggcctggaaaggccttttgaaaagtgctttaaaatgcaaaaaatgtcaacaactcccacttatc

SEQ ID NO: 163812 - DNA, 299 bp, Homo sapiens
caggtattcattaaagcaggggctgcaggggcaaccagcgagaagccaaagtgcatcttgggaggtgagatggtgctgtctatgccagagggcaaatatcctgacctggctaagctcccctcctctgggctcccacagcttccgtctcagctgatgccacctttccatctttctgtctctgccctgtcccctgaccggcgtggtgtggagcactcagcagcaacgtgaagtaattagcacaggacctgtgtacgccagggcgaggctgtgtggtggaaaccaggtgtgcagttagatcc

SEQ ID NO: 163813 - DNA, 640 bp, Homo sapiens
tggttgcctagttaataaatgactactgtctagccactggccaactacagtccatcatctacttattcacatatgccatgattagactgtatttgtcagatatgatattcaccaatttggggatccctatgtatctttcatagatagcccaaatagaaggtataagttttgcagtctgttgatttactataatgtaagaaaagggggaacattttattacgcattaggacaaaatatttttggagctggctgaccttctgtgtgagcaggaggtcaatacatgttggcttcatatatgcaattttcaactacggtctgccttccacccccactgacaaaaatcccatgtgctaaatattagaggaataatattttcagcttgatcaacttcatcataatttagctttgtcatgttggacaggtaagatgaaagaaaggaaagaaagaaaaagagtattaaaaacaatgacattctttactaaaaagaggcagcataactcaaatttcaaaagaagtaatctgcttagtaacaccaaaatatatggtaaattgaagcgatatggtaaatctcatcaaaaaaaaaaggctggactaaatccatacatattgtgaatctgttgatactctggctaacaaacgc

SEQ ID NO: 163814 - DNA, 299 bp, Homo sapiens
ctgagggcatcaaacacgccgtcaagcagggaggcaacaaatctgagttgttccacagatactttgagtgcagtacaagttggtaatgggtaacaggctaaaccatgtggcaccccttccctcttatcagcttcttgctaccatgcagaaaagtgctgaaggtggcctgccctaaggcagtagcactagagcagggatggggaggacttggtggccagatgcatgtggacatgatggaaagggaagagaagaactgtcaagattttcactatcagtggtataagccccgtagtaatatg

SEQ ID NO: 163815 - DNA, 341 bp, Homo sapiens
aatcagctcggccttatttgtgtgcacttggtttgggctagaagctatgtcaggctggaggacacaaagacaacagggagagatgatcacatccagccaggggagtcaggtgggtagacacagttataatacaatgccatgaatgctataacagatgcatgcacagagtaccatggaaaaacaaagtgactgtaactttagctgggattctgagaaggctaatacaaaggaagaacatgtaagctgaatctcaaagagtaagttcacaaagcctggaaggtgggaacgagtattccaggcaggagagctgtgtgtgtgtgtgtgtgtgtgtgtgtgtgtgt

SEQ ID NO: 163816 - DNA, 145 bp, Homo sapiens
acttagaaagctttcagtatttaaaactgctttttcttttcttttatcctcaaagtacctttgtgtgaaacttgcatcagaatccatgttgcatcctgatcaccttggtgtgttgaaaatcaagtcttatctattatatctttag

SEQ ID NO: 163817 - DNA, 185 bp, Homo sapiens
cccatactcaataatcatgccatcctgcctttccatggaataactgatggatggttagaaatgttaaaaacaaagcaaatgcaaacatctctgcttctgctcctctactaagcccagttaacttttgattttatatgtactaagtatacatttttattaatttatgtgagctgagtgtttttatt

SEQ ID NO: 163818 - DNA, 369 bp, Homo sapiens
ctgtccgactgactccttatctagatttatatccccctacttgtctttcagtgctcaatgtgggcactacctctccaaaaagactggagagcacagactataaaatttctgtaattgtaagcccagagcccaatatagcacctaacgcccaatgggatattctgcaaatgtttctgcataaacaaaccaccttcagagcctatttgtaagtcatttttaaaaaaaagaaacaatttattcatagttatcttcccgtctttttttgtggagatggggtctcactacattgctcaggctggtcttgaactcctgacatcaagtgatcatcccaccttagcatcccaaactgctaggattacagacatgagc

SEQ ID NO: 163819 - DNA, 126 bp, Homo sapiens
ctctgggagagacatcagtgcaacttttccaacagtgcctgagtccccacatgaatcagaggcaacagcctcatgggttactcatcctgcagtcaccagcacaacagttcccaggacaacccctaa

SEQ ID NO: 163820 - DNA, 111 bp, Homo sapiens
gttgttgctctatgaagataagctaattttcttcctggaatctcataggattattactaagggccagggagatccacttcgttcatttagtcactcaggaagcattgctaa

SEQ ID NO: 163821 - DNA, 581 bp, Homo sapiens
taatcccagcactttgggaggctgaggcgggcagatcacgaggtcaagagatcgagaccaccctggccaacatggtgaaatcccgtttctactaaaaaatacaaaaaattagccaggcatggtggcatgcacctgtagtcccagctactccggaaggctgaggcaggggaatcgcttgaacccgggagctgagattgcgccactgcactccagcctggcgacagagcatctgaaaaaaacaaaaacaaaaacaaaaagccacacacaaaatctgtctgaaattatgttcaacgagctaaaacaagaaaacagagaacaaatggaaatctagaccctctactcccacctcataactgtctagaaaagttaacttaaaatagatcacatatctaaatgtaaaaagtaacacataaaacttttggaagaaaacacaggagaaaatcttcataaacttgacataggcaaaaattttttaggtataaaaagcatgaattataatagaaaaaaatgcatgaattataacagaacaaaatgacaaatcaggaaaatttttaaatttaaagtaaaaatttaaaacatat

SEQ ID NO: 163822 - DNA, 214 bp, Homo sapiens
cctaatcaccatctgacgtcatttgtcaggtcccaaccaaaagtatatacatgcacgtttctttatggtaatttttttttcagataaccttcagattatgcatgtatcctggtcatttttcttttgctcattagcaataactacaagatcttaaacattaaaactcagacataaaattaaaggtttctttccgtcctgcttcctcacgtggaca

SEQ ID NO: 163823 - DNA, 504 bp, Homo sapiens
cctggcatcactcctatattaacctacaatgtataagttttcctagctaattagaacaaccattcactttcttttataatccccttccttaaaattagacgttaaggaaatccttaatttttttgcctgaataaccctgctaccactgaaaactcatagggaaatagagtttcaaatgataaaataattcaagtcaaagcttgcgtttcttgaagataactagctggtcatttctgagtaataattggtatttgcacctcaacaatttgtagtgccttaggcaataccaattcaagaaaaataagaacaatggacaaatgagaaattaccctgcacaatgaataatcacacaaaatttagataaattaacccggaataaagcaattttctacagagaaatatgtttttcctgctttcatctataaagataaggtccaagatacacatatataaccacataaaattcaccactaaatgctaagaaaatgggctcccagtttttct

SEQ ID NO: 163824 - DNA, 315 bp, Homo sapiens
atcttcaattttccagtcaaatattaatcaaatctaaacaatgaactttttaaggcacaaccaagtacttttataaaaaaccaagttcacatgaaaaatcaaagggcaaaaatgtgtgcccacagatcacattaggaaattaacatttactgagttcatactatgtgcaaaagaaagtcactcgctcattcaattctcgtaaaagttccactagaaaaaaaaaaatggagaagtgttttgaggcagagccacttagggatacagcagaggcagaagctgcaaccaggagcaggtctttctgctattcatataact

SEQ ID NO: 163825 - DNA, 368 bp, Homo sapiens
gcagtgggtacttagtagaagggacagccgccagcccaccagcgccaggccctgcgggctgccacacaaaggccaggctcctgcttcccttgggaggggctgctttcagcaacggggaggaaagcaggggaaacttgtgagactgagcaaagcggtggggtcaggcgaagggttttccctttttgtcaagaatctgacttgggtgaccacagtctggggcactcctgggtgaggtttcaatctcagccggcccaggatgcctgctgtggggaaaacttaacagtttttaaagtgaatcccacctgccttcactcaatgtatgcttttcttcttaaatggaagaaatacagaaataactagaactcaga

SEQ ID NO: 163826 - DNA, 178 bp, Homo sapiens
gagtgtagaccaaccacccagccctgtgctggcttccggggcctatgagggggctgctgctgttcagggggattggaggagggtttagagaaggggaggagctattgtcatgtgagtggaatactgccaccatgatgagacaggtaaaaataaatctgtaggttggagtccgggtcac

SEQ ID NO: 163827 - DNA, 338 bp, Homo sapiens
agccaattaaaattatctattaaaggaatgttttaaaaaagatatataaaattttgacattaccccttgcaaaatagtttataaaggttgttagtttaacctgtatttgtcaagaaacacttgtatagattagagaaattgactcctaagagggaaccaactcagttttcttctgaaatgccctcaaatcacatgtaatatgaaccacatggtaatcaccattgtggagtgcagtcagagaaaagagcatggtcaccagaaccaggcagatggaggggccaatcctgtctctgccacttcttaaaaagtgacaatctttcctagcctcagtttctcat

SEQ ID NO: 163828 - DNA, 416 bp, Homo sapiens
ggtactggggatgggacctatgtctaaacatgaaattcatttatgtttcatgtacacctcatatacatagattgaaagtaattttatttttctcttgggaatgctgaataaactgtacctgcattttgactatggcctgtcacatgaggtcaggtgtggaattttccacttgtagcatcatgttggcactcaaatatttcagattttggagcatattggattttagattttcagatttggtatgctcaacctatatggcctttcctgcattaccaaaccaaagcataggctagagtacattccaaagcatctaggacttctgaaaacacacctagcctactctgtgtactacagggctgctggtgtgagcagagtattggctttctagctaaagaaccacctgagttccagcccca

SEQ ID NO: 163829 - DNA, 542 bp, Homo sapiens
acactgagtttgagaacctctggtttcctaagatcttttcctctgaagagccagagaataaatatttcaggcttgtggccacacagtttctgtagcaaccactctgttctgctgttgcagtgtgaaagcagctatagatgataataaataagtgaatgggtttatttatggagactgagatttgaatttcacctaatttttatgtgttaggagatattattacacttttgatcttttctaactacttaaaaatgtaaaagccatttccagctcctgagccgtacaaaagcaggtggtgggccgggtttaggcaatggtttgccagccctccatcagactgctcaagattcatcccctgaaactggggagagtctaatagtcttaaaacacagagagccccagattctttagaaaattggaatttgggctgggtgtggtggctcacatctgtaatcccagcactttgggaggctgaggtgggaggatggcttgagcccaggaatttgaggccagcctgggcaacataatgagaccccatcttt

SEQ ID NO: 163830 - DNA, 312 bp, Homo sapiens
gggatttctatacattgacctcttgttggttatcaaaaacaggagtccaacgacgtgtcacacaatgacgctggctgatgggaggtcttgcgtccatcagtgtcatctgtcatcatgtcagaatgctacctagctctgttatgacctgtcttacccatacaagtagtcagatgcactttgggtcaaataaattaatattgcagcagtctgatttgatgttgatagtgttgtctgtcgtcagcaccaggaaaggactactctgtagcatacgtatgtgaacttcaaaaagaagtttcagttttaatattttaa

SEQ ID NO: 163831 - DNA, 360 bp, Homo sapiens
tgctgcactgcctactggatgaagcccaaatttgttcttagagggaaaagtatcaaataaaagtttcaaaagatgtaaataagaaaagcttactctaatgttgctgtttctctttctgtctttggagaaatggaccagagaatgagaatgggccaccatgattccacttctgctaccactgtcatcaaattattttaaaaatcatttagaaaagatctatttaattttctacttcatttagtccacacctgctcttttccgaggaactctgcaattgagtggcacccaattattcatccattaaacatgtgagacaggaaactcaggctgaggagaggaggctcccattgagggggagag

SEQ ID NO: 163832 - DNA, 481 bp, Homo sapiens
cagtttttgggttatgtttaccgtcctgataacatatgaattttaaataggaaatagctgaataaggttatagtttaaaatatatgaagttatattacaaaattatttataacaatttctaaagtagggctgattattttggacattatttgctttgcttacaatcatctataacaaaatattacaagctaaaatgtagtaaaaggttaatatctgcaaataccagatgggtagagtaaaggaaattctagaactgaaatatttgggattgtttttatacctattcaatttttaagcaattgcattggtacttttggtggccacctgagaaaatgccaaaggttctgacatttattagtgtgccagaggatttaacacataaagtgtatcagtttgggttcacggattatgagcaatatcatctgaataacctgaacaaatagaaaagttattaaaaaatataatgaagaaccatgataga

SEQ ID NO: 163833 - DNA, 196 bp, Homo sapiens
gggaacagcgagtgactgcttgatgggtacggggtttggtctcctttgatgtgaagaaaatattttagaactacaggtgatgtttgtcacaaccttgtgaagatactaaatgcctctgaaatgtgtgttttaaattggctcattttatattatgtgaatttcacctcaattttttgcaacagagactccttcaggg

SEQ ID NO: 163834 - DNA, 477 bp, Homo sapiens
gggagaaaaaggctccacacaatctttctctgatgcaaggaggagaaatgctgtgaacacattccatggagaagtttctctcagggcagtcctcccaggcaccaagcctcatgacacagccagcacctgtgctactgcgaccccctaaaaaattgccggcaagtcacgctcatcatatcccacccttcgaatcaagacaggaagtccaagacaggagacactgcagcttttcccgtcctctgtggttcctaaagaagctactgcttgcctactctccaccccagaaagtgatacagaaatattttagtcaccctctctattcagtattttcctttacatcagtagattttttaaaaaacagatcccagcttagaaataatgctacaagtttgtctgtttttctaatctagcaaatgacccaacaaaagacattctggacaacagctcagtggaaatacatttccagaaatgctcaag

SEQ ID NO: 163835 - DNA, 330 bp, Homo sapiens
ttgcctaccctagagtcttttatacatgttttgaggtgctataatcttgtgtgtgaggtcagtctctcaggttcattagatggacagtgtaaaaggtattatgaggttttacatattatttatctattaagtaaaagaaatatatggaaattgaagagtagcttttatctattaaagaaaagaatgtatggaaattgaagggtactttctatttgtggaaagtcttaacattttaatttccttattgatcttgtcacagaagttggaatttaagttttgcctgtcactcaaagagaagctttttagacatttgattgagggattctagta

SEQ ID NO: 163836 - DNA, 339 bp, Homo sapiens
catccactcatggcggaaggtgaaggggagccagtgtgtgcagagataacatatcaagtgaggaagcaagagagatagaggcatggtgccagactctttttaacctccagctattgcaggaactaacggagtgaattcacttcttccctagagaaaagtattaatctattcatgagaaatctgcctccatgtcccaaacacttcccgttacgccccaccttcaatattgtgcatcagatttcaacatgaggtttggaggaacaaacatcccaatgatagcaccatcagactaatagtaagtttttcagccaaaactttacaggccaggagagaatggga

SEQ ID NO: 163837 - DNA, 409 bp, Homo sapiens
agagcccggagtggaggctctgggctcagccctcccaggcctaggccaccgtgccctgagtccctccccaagacttctcggactaagtgggccagactcttgtcaggggagggatcaccaggacctcagattgctgggggcggaggggtggacgctcgtgagtgcgaagttcgggtgtcacttgggtgtgtccagtgtctacaagtgggaatcctacggtttcaaaagtcaggcagggatggggttgcctacactcggtggggtcaatcgctagtctcaccagaggcgggagcgggcctgggggccctctgagctcgcggaggcggcgggttcggggcccgtgcgggcggggtcgcccaggggagcccgggccccgcgcgtcaggaggcctccgccggccgagcggccg

SEQ ID NO: 163838 - DNA, 115 bp, Homo sapiens
gtataccaagtgatactggttttccatttataatggcaatgtagcttcccttgagtttgttttaaattttaattcaatttcagacatacggaaaagttgcgagcatagtagagtt

SEQ ID NO: 163839 - DNA, 403 bp, Homo sapiens
gtttttctctcccttctttggaaagcacgtggttgctactgccattgggaagagtgatacctgattagccaggtagccttctgaaaattgaaacaagtggcctgaggatgacttggatggctgttgggtagcagagagccctggaggcagggtttcataactgcgaacagcagttttcattgtaattgacacagcagttttcattgtaattgacaagcttcccttatgcagaaacatttaacgatacctttttaaataatgtttactagtcatctgattagattttattaaaaatttagatgattcgtcctacataatgtcaaagcatttgtttaaaaacttggaagcttttgggggtggggaaggtggtcatagaaatatgatcatcttcaggatttggcag

SEQ ID NO: 163840 - DNA, 140 bp, Homo sapiens
taagtgctataactaaggtacctatgagatgctgtgaagagtctcagaggaggctgacctccttcagataggaggagaggctttgggcaggtcttggagaaaaaggaaactgacattatcagcacccactagggcccagg

SEQ ID NO: 163841 - DNA, 360 bp, Homo sapiens
cagaagcttattcctcctggccagcagctttgttatttagggcacaatatcaaggatctggtatcagcccaccttcccttgggacctggtttttatcaggactttgcaaagcaaaatagcaaaggcagaagaaataaaacatgtagccaatgtcttctggatttggtgggcctctagtcaactggaggaaggtgctgaaaatctgaatgcaaaacttgtacttgcctctatatcagtcaagtaaataaacaaggcccacatcattatgtttattagtcacattatcacatggagaaggcagactcctttaaaaagaaaagatgtaggctggtaatatttacatataggctcttaagatgt

SEQ ID NO: 163842 - DNA, 418 bp, Homo sapiens
tcccccaaacctcccttttgtgccccagtttgatgattaatggaccagcatttcccttctacgcgggaaggccacccctcacagttgccatggcaatgcagaccgctcccccgtcaattaaaaaaaaaatccctactacttctctcctccttctactgtagcaggagaaaagctacctcagaatgcatctcctgggctctcttctcagctcctttagctgtgtttgctgtgtgtcctagaacacagtccttcctctctttctggggattgcctgagtttcttcactctgagcaaattgtgccccttctggagccagcagcccctggaacacttatatcaagaaacagagaaaatttctgtttatttattcatccccggtgcaaattaaaaactagagagagctccttttgggtaaaaa

SEQ ID NO: 163843 - DNA, 701 bp, Homo sapiens
gtaggtggagataatgttaagatatttaaagagtccaagattatataggtaagaagtttttatggatcaaacctgaatgaggcacatatgacatcaaaacatattccactggtcagaaatcaggtattcatacctgactttgaggagactgggaaattttgtctagctagatgcccagtaggaaagaaaaaagaatttggtgagcaaatttccgtctgtgatctaggcaagttgaaataaaatgtagatagctaggtttgaaatacattaataatttatgagttgtaaatatacatagtggttgtttaaatcatggaaatgaaggaaatatccaagcatgatcaagtatattgaaaaaactcaagaatttcagcattttatgaatacataaaagagaagcatgaaaaatagactgaacatacttggcagagaagcagaaagaagacgacgagagagaatgtcaaaaatacaaagggagaaagacatgtcaagaggcaggcagaggccaaaagcattataagctccaaggtagttaagataggaaccattggccacattctaaaattttaactacttcagtttcatataaattcattatgccattttgatggttgaatgacctacagaaaggggtccatgattgtatctagagtaataaattgccttcatttatgtctcaacttgttttaaaatgtaatatg

SEQ ID NO: 163844 - DNA, 312 bp, Homo sapiens
ccaacccagggtttttctgcactgcaatccaaccagcatcactcccctgcttaccagcctgcagtagctcccgcatcccttcaggttaagattcagacttcttagcaaggcactgcttatttctccagcctctgtgacagcctcaaaccctgcaatcgagctctgctgatcctggagaagctccctctgagcctttgcacacctgtccctgctacttgagggtgatttccacctggttacctgctggcatcacctcccacctggaagccttcctcatctctggggtgggtcagatgtagccgtttttgccct

SEQ ID NO: 163845 - DNA, 342 bp, Homo sapiens
tatgtacgaaatatcattggatatagacggattccatgtgtgatactagcttatactcgtctatttcttaaattatttcagctttggccattggctattgagctcttttagttacatgccatgtccctttatcttatccccagattgtggtgctttttggattttggggatgtgtttttggtgtgtgtgtgtgtgtgtgtgtgtgtgtgtgtgtgtgtgtgtagttctcttgtttgttttgttttctgtttcagcggggaagagggttaggagggtttcattgtgtgtgaatgtgagatcttccttttacttttcttctattgtctctgagacagtatatca

SEQ ID NO: 163846 - DNA, 358 bp, Homo sapiens
ctggaaacagacgaggagttcatcagtgcaacctctgcacatcctcctactgcccctccacacaccaggcaggctccctcccacctcagggcctttgcacctgctcttccttctgtctatcccagaaaacacatcacccaacgtacacaaggctgaccacacacacacacacacacacccattacctcctaaaagtccctccctaaatggcactttatcagcaagaccttcctagccatactattcaaaattgcaagctccacccaccccaacactccttagccccttttctttttcttttcttttcttttttttttttttttctttttttttttttattcatattttttttttttct

SEQ ID NO: 163847 - DNA, 427 bp, Homo sapiens
caccaaaaaatacccctcacgtcctctctcggagtttgctatacaaacagtctttttcttaattgataaagagaagtacaaataagctgtgaaacagtggtttttataagtgggagctaaatgatgggaacacacggacacatagaggggaacaacacacactggggcccatcagagggtgggaggagggagaggatcaggaaaaataactaatgggtaatagatttaatacctggatgatgaaataatctgtacaaccagcccctgtgacacctgagtttacctacataacaaacctgcacatgtacccctgaacttaaaattaaagttaaaattaaaaacaatagtcaggtcaggcacagtggctcatgcctgtaatctcagcactttgggagaccaaggtgggcagatcacgtgaggccaggag

SEQ ID NO: 163848 - DNA, 388 bp, Homo sapiens
aagaatgcaaaaaaatgatctaggaccagaatgagacacagattttaaaattcagagttacaagggactttagagagtatcctctaaatacacagagaagcatgtcttctctataatatctgattaattctgttcaattttatttagtaaaactgtatttttattctagaagtccataaaacagtatactcttaataaatatgcattttattaaagcttaagtcatccaaaagcattaaagaaaaatactggcataaaaattccacctctctgccagtttaggttggtttacttgttgtgtgagaaaatatcaggggtatagatttaagaagacggaggcacgctgaaatttagaggagtctctaaaagtctgttgtttgttgcaact

SEQ ID NO: 163849 - DNA, 222 bp, Homo sapiens
acttaaggaatgcgtagaggcttagaaatattcgctaaaacagaacaatcagcagcagtgtgctcaagctcagggtctggggagggcaatgtggcagtgaagtgaccaagtctgcagctccctacagcatcatggttgacacagaaactggactgatggatgtctggctccaccactttaaaacaggcatgcagtaagcaatagaaaaaaattaaggaagat

SEQ ID NO: 163850 - DNA, 143 bp, Homo sapiens
aagggtcggcggcaaatatgcaggatcttttgagaccatctccaagactggctctgagactcctcaggccttgccaaagcaggaagggatggagtgacagcagcagcagccagggaagaggagacttcagaaagggaaactga

SEQ ID NO: 163851 - DNA, 755 bp, Homo sapiens
actaaaaaaaaagttaggggaatttatattcattaacttgatacctcagtttcacattacgaccaggaaatagattaaaaattacaaggacaaagaagggatccagaagagcacagacaataaagagaaaaggacaggggggtgatcttagtaaaaggtaagtggtctcctagttccatctctaacactgtcatttacccttttcacttacacttggaaatgtgtcttcccctactgattccatgctgccaaatgcctgtgccctactgattccatattcatcattatgaccctccaatgctacctaatactatctcctcaagcaatcattgccccttatcctcactattcttattggagcactcatcctcgtctcaaatgtaaatgattccaaacaccttccttaagaattttttggcctccaccttcccagtttcaaaaaaatgcatatacttctttcaggtaaaatagtggcatactttgccagtggctttaaaactcccaaatgactaaaggataaagtctaatgtgcttacatggttaatttgggcactataagacagtgctcttcccagaaatctaattcaattgaatttttaaatctgacatagctacctacctcttattcaactcaatatgtgactggcacacattgcaaggtaccatgaatggcacattatgcagcactaaagggcacagatatagtctctgcactaaagggcacagatatagtctctggggttaactaggagtta

SEQ ID NO: 163852 - DNA, 568 bp, Homo sapiens
tgacagtgtatcgctcattcctgccctctgaagcctttccattagaaatgctgcaatttaatctcacatgtcacaaatcaaaccccaacttgaaaactgcttcccctgaaaaggtgaacacattccatgccttgtggaaggaactccagtgcccctcagaggaagtgctgtgtccccgatagcagctggtaatatcagctccacatttgaaaggaccccaggcatcagtattcagagactgcgattgttacattagcgtgactttttgcaacttatgtgactttgggtgagttgttgaaattccacttgactcagtttctttattcactaattgagcataatctccaccattcagggtggttgtggggattaaaggagagttaaaaaaaaaaaaaatactcagccggggagctaagtacttgataaatagaagctgtaacttattattgcttactgttacttccagactctgagctaagggctttatattgtttacttccttaattcccacagaattagatagatattataaaaagccattttgcaaagaaggaaactgagtcttaga

SEQ ID NO: 163853 - DNA, 517 bp, Homo sapiens
ttcctgtccctgctcgtgtgtaaggctgccatcccctcaacttgtgccttagatcccatcccttcttccctgatcagcacttcccctcaatacagaattatccccagcattgcctagcatgttgcaacatcctccttgtgaacgaaaagaaagaaaaaatgagcagaccttctttgagcccatatttgtcttcagctactttgccttctctctgcccctttctataaaaactccttgaaagaaatggctgttctgtaggctccacagccctacctcctgttctcactttcactcatcccacgtgggaaacatacgtcttcattgctttactgaaaggctcttcgtttgatctccgtcttgccaaatccaatggccagttttgttcttatctgattttttcgatagcgttgacactccctccctcttgaaaccccctcttccttagttttggtcacgcctggcctattgttccctctctcgctgaagtagttttatcctcaggagtcagctatggcat

SEQ ID NO: 163854 - DNA, 472 bp, Homo sapiens
ttcctgtccctgctcgtgtgtaaggctgccatcccctcaacttgtgccttagatcccatcccttcttccctgatcagcacttcccctcaatacagaattatccccagcattgcctagcatgttgcaacatcctccttgtgaacgaaaagaaagaaaaaatgagcagaccttctttgagcccatatttgtcttcagctactttgccttctctctgcccctttctataaaaactccttgaaagaaatggctgttctgtaggctccacagccctacctcctgttctcactttcactcatcccacgtgggaaacatacgtcttcattgctttactgaaaggctcttcgtttgatctccgtcttgccaaatccaatggccagttttgttcttatctgattttttcgatagcgttgacactccctccctcttgaaaccccctcttccttagttttggttccttctgccttgctgtccc

SEQ ID NO: 163855 - DNA, 513 bp, Homo sapiens
ctgcgcccagcctgttatgttttatttttaaaaagatacctaataaccacaggggaggtctgtggggagggggagggggaagatacctgaaacaaaatgtcagcattgatgaaatgtgggtagtgtgtccatccatggtgttggttgtatagcttctggatatttaaagcatttaaaatactttatacttaaacaaaaaatgagcagaccttctttgagcccatatttgtcttcagctactttgccttctctctgcccctttctataaaaactccttgaaagaaatggctgttctgtaggctccacagccctacctcctgttctcactttcactcatcccacgtgggaaacatacgtcttcattgctttactgaaaggctcttcgtttgatctccgtcttgccaaatccaatggccagttttgttcttatctgattttttcgatagcgttgacactccctccctcttgaaaccccctcttccttagttttggttccttctgccttgctgtccc

SEQ ID NO: 163856 - DNA, 472 bp, Homo sapiens
acaattttaggaaggtccacagacctcttgaggtgtatccatgaactctcatgatgtacagattaagagtccctgattttagagaaagaataaatgaggcataaagatggaatgctagaaaacactggcacttaagaaatgggtaaaggagaagttcatgaaaaaaaactgagaaagataaacccaagagttagggggtatcacagaaggcaagggaagagagagtttcaagaaagtaggaataattagcagagtttagtgctgcagagagaacgaataagataaggactgaaaagtgatcattggctttagcaacaaagagtctcagtgacctttgaaagggttgttgtaaaatactgtggacagaattcagaatgcattgattaaggagtggatgagaggagaggaagtggaagagcaaatgcaggccacattcttccaagggggtagagtagctgagtggggtgccttt

SEQ ID NO: 163857 - DNA, 691 bp, Homo sapiens
gagaagagaccaccagcttgaagaattcttcctgagaaataataggaggtaaaattgggttgttagggtggggccaaattatagagggcctgcacaggaaggcagaggaatttggatttgatgtgggagtcagtgaggctttctaaattattgagtagtggtttaagaggttaccctgctgcgtgatacaggagaaatgaaagaatctaagagcagccagcaatccagacgggtaaggggtcacagggtggaggcagtaggagtcacaggccaaatctgagagttgcagcggaggagtcccttgtgagtcttctgatgcctgaggatgagagaggaagaagaaggcaagagaggtgactccatcaattatagttgtgcctttaattttaaaaaggacaaatgagcaaatctgggtcttggtagtaatgtttgagtttggctttagacatggtgaattacctgcaaatgatgaactaaggggtagtattctgaagatctaaaataggcattggggagtccctctgagccttttctggctcaggaggttgccgataaaattttaaaaaataaaataggcatcggaatccatgaaacgtatggtttctctaagggaggcaagttagaaatgagcagaaacagaggcaggggctagggctaagggcctggcttgtggagtctgaagatgagtcag

SEQ ID NO: 163858 - DNA, 270 bp, Homo sapiens
ccaagaatgtcatctctgagctactcacaatgaaaggtgatgtctgggacccaggtgtgttgaggtccccatgtctgggctatgggtgctgagtgggacttacttatccatccattttctatattctggcactgggaaacttgggtttatccatcttgataaaaggtcatttaaattccacttggcaagaaccacaaatggaagaaaggtcacgaaatcacaggctagcccttgttctcaagggaatcttcagcttaggtggctctgtaa

SEQ ID NO: 163859 - DNA, 255 bp, Homo sapiens
tctgcaatgtctgtaaaatccctgtatataatacaaaccctcaggagagggtgatatttactgaggctctacttctcaataaatatgctttatttactcattcaatagttatttatcctatttagggaacacttatacactgttgatggaactgttaagttagttcagcctctgaactaacagagttcacagatttttcaaagaactaaaaacagaattaccatttgactcagcaatcccattactgggtatata

SEQ ID NO: 163860 - DNA, 345 bp, Homo sapiens
acagcttatattaataacttccctataggcttcccacacttctgccaagttagatcctttctgtgccttgaaaacacctcaggctttcttaaatgtgctccacctatttggagtgcccttctcccctacagaaatatctgaactatacctactcgtcaatgtttgaaatgccattgctttttctgattctccttcaaaatcaggttctgactctaagtaaactgtctcctagttaatactcctttatatctttcctaggatactttttattgaattttatgtgcacttgtctcctttccccctactgaacagcaggtcttataatacatatgaaagtccaacatg

SEQ ID NO: 163861 - DNA, 267 bp, Homo sapiens
ctataaactgaagatgacataagcaatgtaacataagaaacaggtcaccaaaagtggtagaacatattgtttaagcctacataaatcctttttcagaacactggctaaaaataaatcttcatctagttcaagcactagaaaagtttatactttctataaaatttgacatctgggccgggtgcggtggctcacgcccgtaatcccagcaccttgggaggccaaggcgggcagatcacctgaggtcaggagttcgagggcagcctgacc

SEQ ID NO: 163862 - DNA, 691 bp, Homo sapiens
agcaatttgaggctctgtcatcagtttctgctacgtttcaaagatcctggagaagcctagtgttgtgtcaagacgccgatggacccatcacagtttaatccaacctacatcccagggtctccacaaatgctcaccgaagaaaattcccgggacgattcaggggcctctcaaatctcctccgagacgttgataaagaaccttagtaacttgactatcaacgctagtagcgaatctgtttcccctctatcggaagctttactccgtcgagagtctgtaggagcagcagtcctcagggaaatcgaagatgagtggctttacagcaggagaggagtaagaacattgctgtctgtgcagagagaaaagatggcaagattgagatacatgttactcggcggagttcgtacgcctgaaaagaggaccaaccaaacaaggagcctaagggagttaagaaggaattaagaccattcaatggcccctgcagttctgcgtggctaagggaaggggaccttttgggaaggctgaattgggaataaagaccccagacccttttagccataaattttatttttggcccttttttttttggttggaaattttattaacagggttgaggaaactacttcttagctgtgtaagactttcccccaataattttgataaggagttcaaggaagtatttttcctgggatct

SEQ ID NO: 163863 - DNA, 168 bp, Homo sapiens
ctagcctcgtcagggccaagaactgccttccaattcccactggagtaattttccagagagaagtgaagctgtctctgcctctgtacaaggagagtccatatgaagaatggggagtagcagcttggtagtaagccccatccagctcccacacacttggcaaggcaggtc

SEQ ID NO: 163864 - DNA, 202 bp, Homo sapiens
gccagagttgctgctgtgacagcccctgcagcaggggactgaggcttaaatatgggtgtgggaggaagcagtcaagggacattaagctgactcaggagtaccccaacccaaccacgagactgaccaggaataccccaacccaaccacgagactgaccaggaataccccaacccggccgcgagactgaccaggaataccccaa

SEQ ID NO: 163865 - DNA, 837 bp, Homo sapiens
ccctgtgatgctctggcctttcgagttcgtgtgaaaaatctgggacactcagtctgtcaaatgcgggggtgggaaggggacgcaccagtaccaaggcatggagaactggaaggaaaatatctagaaaatctgtgacatatggctgctgtagatataggcacttgcaaatgagactgtaatgctaaacagagcctttccaaccaaataggcaaagcacatttctgaataattggactggggagaagagtaaagtttcgccatctgaggcaacatggcgcagtggaaaagaatggatggggtttagagagcgcgccagggatgaacactacctattctatttactggttgtgtccctttgagcaagccacttcatctctttggacttcagttgtactcatctgtaaaatgggttcttgagtgtaaagtacttgtacatgtagcggaggggcagtgaacagcttccatgagaaccataacaattcaagacggcagctttgccagtggaattgattggtttaaaaaagagagagagaaaattaagattttgtttgaaaattttatctgaaagtcctccatggtctacaaattggctcattatctttcctcttgttttacaaatgagtaggagagaacctggaacaaaatctagtctggaacagtgcctttgtaaagaagcctctatggggaccaatccgcctgcaggcagtagaggaggaatcaggtttagccacagcaagagagaaactgagttccttaccctctgccatatcaggatgctccttggtttggggtctaatgaacctgctatccaagattactcagtcggggatctctaga

SEQ ID NO: 163866 - DNA, 335 bp, Homo sapiens
aaaaaaagcaggggggagtctggacagagcaagacgctgtctcaaaaaaaaagaaaaaaaagaaagaaagaaatggggttttgccacgttgcccaggctggttttgaactcctaggctcaaactgtcctcctgccttggcctcccaaagtgctgggattacaggcatgagccaccacgtctggcctgttctgcttttttcactcggtgtaatatcgtgagcatcttccctgtccctaagcagcccaggagctcgtgagcagtcatgctgagttttcagcagctgcacagtatctgtcccatggctgttctgtcatttgtcttggagcccgccttt

SEQ ID NO: 163867 - DNA, 326 bp, Homo sapiens
ctcttttctgtctccatgtgccaagatgtctggattgggtcattctcgtttcaccaaggttttatctaagtgctcagcagagggctaagtggctcagatgagatttcagctgcaggagccaacacagcctggcttccaacccagctcccaaactcactagccaagtagcctcaggcaggttttacaacctctttcaaaaccaagtttctccactgtaaaatagagataaaaataacacctaccacatagtgctgttataagaatacacttttataacacttagcctggcacccagcacataggaagtgttcagtaaatggaatcta

SEQ ID NO: 163868 - DNA, 473 bp, Homo sapiens
tagcctcaatttgtgaccatttggacaggcagtgacagtgacaagatgtgaattcaagggctttcactcccagttgtgtgaccttgggcaagataaatccttctgaaagcctcagtttcttcattgatcacaaatatgggggcaattataatactatcaaagtcaattaaacaaagagttactgagcactgtgatgaaacagtgaaaaatatatcgaaaagctataatccttgtggaacttgcagtctagagttagatgcagagaagcaaagacagttaatattatgcattaaagtctatgataggaacaatatccatcttacctcataaagttactgtgaggatcaaatgaggtctaataaatgtatttaagctctacataaactgtgaaatgccctacaaatgctcattactgccataaagcaaacaggccctgatgtcatctgagtgccactacatccctgccactactc

SEQ ID NO: 163869 - DNA, 416 bp, Homo sapiens
tgggtgttatattgtagggattctcaatcttgttatctttctttaaagaagttttcattttgttttgacaagtagttaggttactgtagttacttaaattactgtaagtgactggtcgttaagttagtttgaccctgccaggtttggttttatgctttgttagtatgggtttatccttggtccagacacccggcccttagaatagagggtactctttagacttaatgcttggcctttttggggtcgaaacaaaataacagaggtgctcagcaaagtctctccaccctggatgaactggtacttgaatgtcttccagcactgtgaaacctctgtgtctgtgcagttctcagcctcacagccaccgctgtctgctaaactgcatagaatctggaagccatggacccacaggatgcctc

SEQ ID NO: 163870 - DNA, 253 bp, Homo sapiens
ggccagggccctcctgcctggtgttgccgagagtgctgagtgctgagctgcccgccatctcccagcccagggtctcagcctgagagactgcttgatttgctcagttacacctggacgagccttgtcccctgtcttctgggcctccaccactgtgcctgtccttcctggaaaagctctgtacactctggtcagaggcttccttcagtgagcaaacatgtcctagagctcagcttcctttttctctccactccct

SEQ ID NO: 163871 - DNA, 554 bp, Homo sapiens
tcttgttgcccaggctggagtgcaatggcgtgatcttggctcaccgcaacccctgcctcccaggttcaaacaattctcctgcctcagcctcccgagtagctgggattacaggcatgcaccaccacgcccggcaaattttgtatttttagtagagacagggtttctccatgttgaggttggtcttgaactcctgaccttaggtgatccgcctgcctcagcctcccaaattgctgggattacaggcgtgagccaccatgcccggccttatttttaactttcatgttgtttcatgtgaaattgagaaaataaccactctatttttagacacctggttatttccaaatgttttgccattactggagataacagaatatcacaataattggagattatagtgaatacttttgtatgaaaaactttttactccttttccattattcccttaggattaattaataggagtcaaaagatgtaagtttccatggcaaagataaaaatatattggatatagaatatttcattctctacaccagtactgtccagtagaatttctg

SEQ ID NO: 163872 - DNA, 400 bp, Homo sapiens
atcataaacctaaatataaaatgcaaaattatataactcatagaagataacaggaaaaaacttatggatatggcaatgtgtttttaaacataacaccaaaggcatgatttataaaagaaagaattgataagccagatttcatttaaattttaaacttcttctttgcaaaatataatgtcaaaagaatgagaaaacaaactacaaactcggaaaaaaaattttcaaacatatctgaaaggactgtcattaaaatatacaaataattcttaacgctcaacaatgagaaaacaaataactcttaaaactcaacaacaagaaaacaaacagccagattacaaaatgggtcaaagatcttaacagacaccgcaccaaagaagacatataaatgatagaaagcatg

SEQ ID NO: 163873 - DNA, 354 bp, Homo sapiens
acatgtatttgttcaataaacaaattaactggaaaaacacagaatatttacatttgaaaggaggccaaacataccataattaaaaatgacaattgatcgagagcttctgatgtttcaacagttaggtttacagtgccttctttttgggagtctgagatgggaggtgtcaatggagagatgtgtaaagcttatgtagggaaatgtgctttgtcattcaaattttgatttaaggcaatttaaaaagtcttgtgattagtattttagtcgacagagattataagtcttaaatattaattgcagagttgagattttaaatatttcattaattcttcatattaggtcaaacaataaata

SEQ ID NO: 163874 - DNA, 544 bp, Homo sapiens
tgctcacaatgactccttgtgtgtgcctacatgcttcgcagtttacaaaggggctttgacataagcgctctagcctcacaacaaccatgtgagttaagaaaatgcaaatattcttcctctccttaaaaaaaaaaaagcgggggggtgctcaacgaagatacgttaggtgcccaaaataactggtcatttatacatacctctccaagactaatgagaagtcctcggaccccaaagcccacagttctctttctctatgccagtggttctcaaacttcacagtgcaatagaatcacatggagagatagagtttgttaatacacatactgctgtgtcctttgcaggaatgtccattgctgattcattccacgtagagtggtgcctgagaatttgcaatgttaacattttaccaggagatgctgatgctgtttttctagggacaaactttgagaaccacaggcctctgtcagactgatatgctacgaaggtgtggtctaacatgaactacgaaatctatccacagtgtcacacgatgtgagagctacat

SEQ ID NO: 163875 - DNA, 185 bp, Homo sapiens
ggaatgctaaagctgcagtgagccataatcacaccactgcattccagcctgggcaacagagcaagactctgtctcaaaaaaataaaaattaaaataaaaaaggtcacgcttcagaggaaaactttgtatcataatgcaatatttatgggattttttaagtaaaaacagaaaaaagaatatctgtg

SEQ ID NO: 163876 - DNA, 341 bp, Homo sapiens
cctgctttgcaattgggtcaggtacatatgtggggaggagagagtgggcttggaagaaaaaaaattggtttgttacctccacaaaagcagacattctgattttcccccagaagttccattaagaagaaagcaagtttttaagggtttaattgctaattcagggttgctttcagccattagggcatctgtatcaaggcgcctagtttgggaggtggaacagaagtttgacgtgctaacatttgggaactttctcagacaggatgtctttgttatctaatttctttccatttttcagtacctgctttcagatttctactttttctcttctgcttcctttggtt

SEQ ID NO: 163877 - DNA, 159 bp, Homo sapiens
tgctgggattataggtgtgagccactgcacctgaccagaaccaatcagcttgtgatttgaagtacagtacacctttaagaataaggccacaatctgctttgggattgagttcagggattaaggcaaataaaaataagtttatatcactgaagaagagac

SEQ ID NO: 163878 - DNA, 265 bp, Homo sapiens
atttaggaagacaaaagaaacaaagcaagcaaaccaccatggacgtatttctgaaaggagtgacgcctctagaagaggctcaggcaggtccttcaggaggcgtctgggagaaaccattgttaccataggaggactttctggtgggagaagatgtggcactggaagacagtgacactgatggtcctgaccctgtgcaggcctaggctgatgtgtgtgtttgtgtcttagttgttgacaaaaatgtttaaaaaggttaaaaaaaaat

SEQ ID NO: 163879 - DNA, 488 bp, Homo sapiens
ataaagccccatcccaaggtttcaggtagatgtgaatttttcaaggacactgttcaacccactgcaatccatcctctcacttcctcagaagacttgcagcggagggttcccctggctgggctagtggctcttccttggtgtccccacggtccctggagcatgatatgcagtgtcaggtaacagcctggtcctttctctgtattcatcaccatgaatatgagctccatgagggcaaatactttggtttggttagttctgcagcacaagtgcctaccttactgtgaggcacctcctagacagtcaacaaatatgcgcttttcttgaacactgtgcactgcagtaagttatgaaaaatctgtttccagatgtttcctgagactgtgctgttccattttggcccagcacattcgctaatcagagcaacactcgctggtccccaaatgtgtgtggactccatccttcccccttttatcaatatcaaatggccc

SEQ ID NO: 163880 - DNA, 274 bp, Homo sapiens
gggctcctaaagtagctcctattaaatggagcctgactgtgtgagatcgtctcagggagattgtccagctgcactcagtatgaactttgtgattgtatattcacttagtgaagggatatcccttaggcgtgtttggtgtaagcaggccggccatatttcttcagatgacaggtgcttcctagaaaacatctgaagatgggagaagttccagcttctttgtctgctgcagagatgatctagatgatctagttgagaggagaagcactgatgattc

SEQ ID NO: 163881 - DNA, 463 bp, Homo sapiens
gctgccctgctactcactagccaccacctcccttctttaatttttgcctcctgatgaagccacatttcgtggctagcccagcagtaggctgggcttttggaagggagggcaccttttcttgcctttaggggaaggtcatttctgcctttgtgggaaaccacctgagcaagtaatgacagggcacatcatgtaaacaatatctaaggggtcaaatggattttatttttgatatgcattaatggcaaggtcactatgtaatttttttggccaaactagcacattttttagagtaaaaaggggcacgaatgtaatgaaaattatatatttggaatatctattggcttacaaatatattagtgaacttatagaatagtttcagaccattttcaaaattaacattttaaaagataatttatatccttatgtgttaaaataaaaatttatattacatgaacattcagca

SEQ ID NO: 163882 - DNA, 471 bp, Homo sapiens
tcatgtacccctaaaattattcttcatgtgggttacagtccacggacctacctaatcctgtgatcattctatttcaggctggtcttaccagctcataaatgtggtaagttcccccctggttgggcttcaaacgccctgaggtatcttgatttacaattacgtgtttgggctattagaatatgacatagtaacttgttagatgtcttgtcagtgcccctttgcccttagggggaaaaataacttaaacctttatttggcttatgttcgtggtcaaaattcaaaatgatcaaaaaaggacacactgaaaaaaatctcccacccttttcccttcccaccaaattattttttctccaaggcaaccactgttaccagtttcttatgtgtccatccggagagattctctgcatatacaatcattaacagttcacagactatctccccttcaactgatttcctactttatctataagc

SEQ ID NO: 163883 - DNA, 245 bp, Homo sapiens
ggcccaaagaagttaatcactttcctaaggtcacacagctggcatgtgatagcagcgggaggtaatccccagccatctaatgcccttatccccttccccgctgcctggcacagtgctctaagtctctatctgccaaggcttttagaagtcatttgatgcacggagtgatgtatctcagggccccgacattcgccattaaacccgaggtcaggagacaggagactgcagttgtcctgcttaatccc

SEQ ID NO: 163884 - DNA, 234 bp, Homo sapiens
ctttatctcctggcctcaagcgttcctcctgcctccccctcccaaagtactgggattataggtgtgaattgccccacccagccagaaaaagtgcttttgatgccatgctgctttctaaaaataagataaaatattggtttcatttaggaaaaagaaaatttgaaaggaagcgtcattataaggacattttatatgaactaagagaagtagatcaagtagcatagaaaatatctg

SEQ ID NO: 163885 - DNA, 248 bp, Homo sapiens
cagcctgagttacttttataaccctcctgtttccttttcaaaaaataaaacccgatggctgctttttcagtgctaggtggggggtcatcaaatggagccgtcctgatttggagtcggaaagtaaaattcctcttcctccaaagaggcggtgtcttcacatctcacgaggtctagctcctgccatgggcatctggacaggcggctctggagtcttctgattggttcccatctgtaaactcagttcaaaa

SEQ ID NO: 163886 - DNA, 1085 bp, Homo sapiens
ggcacgaggtggagctgcgcgtggaggagtccaggctgcagccgagggagctgagtagggcaaagttaggagtcgctgtttggatggcaagttcagaagttggaacttgtctcagtttccccgctccagaaatggggttgtgatataaagacagggatatgagtgaagaaaacacagagccaccctggaaaggcaccctcttacgcacagtcggatggtctatggagactcacaatcatgtgcaatctggaagcaaagaatgagtggggagatctgagaatcgatactgaacagcttcagtactacgatgtcataatggggctgtgagctcagccgaaagccccccgcccagttttttttggaagtggtcatagaatctctctggagaaacaacatggaaatggagaccaaaagagggaaggagggatgccaccagatgacactgggatcccggaagacggaacactgtgtgcaacgggcaaagaacttttcaaaagggatttcaacctctgaccacctggagacaggcgactggcgctcattgtaaatgcaccgacatgacagggaacagctgctggggaggtggagacgggtgccgggagagacaggaaaccccagaggcttggaaatccaggagccacaggaagcagtgagctttctgcggagccggatccggtggagccaattcaccagcaggtcccggcagcaactcttctacaacagattcctgcccgtccctgtgccccatcgcccccctgccgtcaatctccacctcaagggagccagaccaagcctttctgtgtgtagcgcacatctctcctgcgtagagctcacctagtggcttccatagcttttttttttttttttggagacggggtcttgccctgtcacccaggctggggtacggtggcatgatcatggctcactgcagctccctcctgggctcaggtgatcctcctgcctcaaccagctactcaggaggctgaggcaggagaatggcgtgagcccgggaggcggagcttacagtgagctgagatcacacgccactgcactccagcctgggtgacagaacgagactccgtctc

SEQ ID NO: 163887 - DNA, 689 bp, Homo sapiens
gaggggtcctcttacaggacgaatctgccctatcatcctgaccacacatcacctgatgccacctcactcctccaggtgccaccacttccttcaacagatctggaaattgaggctcagagaggcacacaagtcacccagggtcacacgtggagtcagtgggatactaagttccgttttcttgcctcctcccctccccctgccactcgctggcgagctggtgatggtggcaatttaaacagaaaacctttcgtcccttgctctcacctatcgcgctggctggactccaccttctccggccaacgttgggggtgggacggggtgtgggccctttaagagcgcccgggagggatgggcaggcgcagtggtgctgggcacgaggtggagctgcgcgtggaggagtccaggctgcagccgagggagctgagtagggcaaagttaggagtcgctgtttggatggcaagttcagaagttggaacttgtctcagtttccccgctccagaaatggggttgtgatataaagacagggatatgagtgaagaaaacacagagccaccctggaaaggtgagtgtctactaacatagcttcctctatccaaatctgcgcctgagcccccgtggccttctggggcagctctgatctctctgtaaggtcacctgtctctgacctggggtgatcttctaatggtcac

SEQ ID NO: 163888 - DNA, 1024 bp, Homo sapiens
ggcacgaggtggagctgcgcgtggaggagtccaggctgcagccgagggagctgagtagggcaaagttaggagtcgctgtttggatggcaagttcagaagttggaacttgtctcagtttccccgctccagaaatggggttgtgatataaagacagggatatgagtgaagaaaacacagagccaccctggaaagcaaagaatgagtggggagatctgagaatcgatactgaacagcttcagtactacgatgtcataatggggctgtgagctcagccgaaagccccccgcccagttttttttggaagtggtcatagaatctctctggagaaacaacatggaaatggagaccaaaagagggaaggagggatgccaccagatgacactgggatcccggaagacggaacactgtgtgcaacgggcaaagaacttttcaaaagggatttcaacctctgaccacctggagacaggcgactggcgctcattgtaaatgcaccgacatgacagggaacagctgctggggaggtggagacgggtgccgggagagacaggaaaccccagaggcttggaaatccaggagccacaggaagcagtgagctttctgcggagccggatccggtggagccaattcaccagcaggtcccggcagcaactcttctacaacagattcctgcccgtccctgtgccccatcgcccccctgccgtcaatctccacctcaagggagccagaccaagcctttctgtgtgtagcgcacatctctcctgcgtagagctcacctagtggcttccatagcttttttttttttttttggagacggggtcttgccctgtcacccaggctggggtacggtggcatgatcatggctcactgcagctccctcctgggctcaggtgatcctcctgcctcaaccagctactcaggaggctgaggcaggagaatggcgtgagcccgggaggcggagcttacagtgagctgagatcacacgccactgcactccagcctgggtgacagaacgagactccgtctc

SEQ ID NO: 163889 - DNA, 524 bp, Homo sapiens
tggggctggatgggatcctggcacacaggccaggcttggggatgcaggagttagtgactgccttggacggtgacctgcagctctgcccacctgtcagctgcctggtgtctgcaagttctgtgtctcacgccagctcctgagataactgagccctggccagagggacattcaaggtcaaagatgccctgaaacatcgacagcaggttgctttcatggctgtgtagtttgataaggagattctgtgcagggagagggcagcagccacagggaggtgagcaaagacatttggtatcagtgttgcggtttgctgcaacttagcgctgatcacgatactcccggtcatcagaaccgcactttatactttgctaaaaatgctcttgcagctgctttttcttttgatcatgtatgaagtattccaggggaagaaaatatggtccttgagatcctggagaagaatcctctctccaataaagagtgatttttttaaagctagttttcttataaagcccaaatcagaatgacct

SEQ ID NO: 163890 - DNA, 191 bp, Homo sapiens
aaatatctgttcaaatcactgccttcaattctttttggtgtatgtccagaaatggaattggtagatcaaatgttaattcttttttttgtttgtttgtttgtttgtttgtttgttttttgagatggagtctcgctctgtcgaccagctgagatcgcaccactgcactccagccagggtgacagagcgagact

SEQ ID NO: 163891 - DNA, 295 bp, Homo sapiens
cctctgaactctcactatccaaacttaggaactgatgtgaacctttggataaatcccttactaaccaaagctttactatttactgtcagaaacttaagaactgaatatatgcagatatgttgatatccttatctggtctacctggacatacgagccaaaggatctggacagtgcatgtgtgaaaggacacaggtgcatgccaccacacccagctcatttttttgtatttttacattttttgtagagatggggttttgccatattgcccaggttggtctcaagctcctggtcttga

SEQ ID NO: 163892 - DNA, 325 bp, Homo sapiens
acttcattaggatgttgcaaagattaaatgagttcgttatagttaagcacttaactgtcatcatcatcatcccacagatgtagacaccgatgtccaggtaggcgatgtgatttgtccaaatcataaaactagcattaagcacgcagaagaacccaaatctcttgacaactagccctgagttccttccactgtgccatgctgcctgtattgttctatactacgccatactttctgatgcataaagtccttatcaggtacataacttatgaaggaaagaactcagaaagaagaaggcctaatgatgccattgcaacacggtctctca

SEQ ID NO: 163893 - DNA, 372 bp, Homo sapiens
cagcacacacaccccaacacggcacacacagaggctgctgctccaagcagcacaacagctcatgggacattcaggtgctgcctccccttccctgggctcagggccaaacctaaactacctctaaggaacaggtatctaagccaacacatgcacccccagcccctttacaacaagtttcacagaaccttaggtacagagaggtgagaaatttcatccaaatgtaagaaaacagccttctactctcataattgaaggaagtgtgctcaaatgccaaagtgtagtactaagtttctggaaaacttacttccctggctgagggtggtggagggaaggacactgattcatcaagaagaggaaaatattccaagtaca

SEQ ID NO: 163894 - DNA, 207 bp, Homo sapiens
ggtgaaaccaactatctccctaattgaaaacaaaatactcaaatgggcacacattatggagatgttcacacggtgtatggagggggcacacagaaagtactaaataagtattatgtaaaagaatgaatgagaaaaaatgaaccaagtaggctttctagattcacaaaaaacgtacttctaaatacctgtatctttaacaataatggg

SEQ ID NO: 163895 - DNA, 204 bp, Homo sapiens
taatacgaagaggaggaaacaacacccaagtccagccaacttccctttcaactctcctggaattcaggtccctggcgttggagaggaaaaaggagctcttgtaattttgtatcatcagtataacgatggtgttgctgggttttttaactttatggttgatggggtattgattgtcaatattgtgcgcgtgatcagtttaatgag

SEQ ID NO: 163896 - DNA, 291 bp, Homo sapiens
catttctagaaatatataggtctacaataaattaactacaaagatgtttattttgacattatttacatcagtggtagtctagtgaaaatctagctttccatcagcgtagctaggttacataaattatgcaatatccatatttttcacctttactttaaactcttctatactgtgttaagttcttatgagcgtaccttcttttataccttaagatgcttgtctcgtttgattttaataataagatcctatatacgagggtatgtaacagtgactgtcatatggtagattctt

SEQ ID NO: 163897 - DNA, 441 bp, Homo sapiens
gaaaacccccccctacaattagttaaagcttccattgagccgagatcacgccactgcactccagcctgggaaacaaagcgagactccgtctcaaaaaataaataaaagataaaaatagataaatataattttggaggtaaagtttagcagttttctttaatgtggaactttcaaagcttttcacattaaaattcattttgaatgtttattggggtggtaatactgataatatccaactgataattaccagtaaatctttagaaaacctattttgacaacacaggttggacaattctgtaatgagataatttttaaaatacgatactataagacaaatgtatacttttaaaatacttttgattagctgtgtttaattttatgattcctgggaagattttatttgaacaaaaagtgtttactgctaaaaagtttaactgtcac

SEQ ID NO: 163898 - DNA, 367 bp, Homo sapiens
acacacacacacacacacacacacacacacacacacaccaaacagcttcgtaggactacttccgcctgcaggtcctctgaacagccatatctcaaaatatgtgaaagaagtatattttggggtaaaattttttggtttccttcactacacatctcaccttgggtgttattcttgccactggtttcatgttctcagactcacgaagctgaaaaacagttggggatgcagaatttgatgtgcttcatcctttgtgggcttgaagagtctcttgttcccaaaattattccctggggccctctgcttcacaggcaaataaaagcaaaaagaagcttgctcagccttaagtgaggaaatgactcacaggttt

SEQ ID NO: 163899 - DNA, 328 bp, Homo sapiens
gggaccctcccttcacattcgtgcctccctgccaggcgggtctgtcctccagaactcccaccctactcccttctgcggaagcggagcctgcgcaccttgctggaataacacagagccttagcatagcaattgcgctggccgctctataccaagatttctacaaagaatataaagtacttttaacaaagtatccaaaaaggtgcttaagaagactccatacagctctagagaaaaggaggtttataataatccatgaaaacagaaaaacagacaaaacaggccctgattaaatctacataaaaatgtgtatacctcaagaagggaaaag

SEQ ID NO: 163900 - DNA, 328 bp, Homo sapiens
gctcctattttatgggtaggaaaaagttgaagagaatttctgcatgatctacaggatggacagtgctggtgcagaagcatacgttgcagtgttttagagctggacgggagcttggcaatcatcctgtcccaacctggcattgttttcaagaagactcagaaagatttagacaaaaaagggatctgtccaaggtcacacagcttgctgatggcaaaagtatgcagagaaatccaggtcttctgacctccagccccgggctttattaacaaatgcttcagaaactttaaaccctaatattcatcacactctgggaagaggcaaataagta

SEQ ID NO: 163901 - DNA, 475 bp, Homo sapiens
gtgtaaaaggggcagtgtggggaggaagaaagagcagtagacagaaagacaaatgtgcaagaaagttctccaaaagaagatcatgggggagcctgcccctgaactagggcaggaatagacaagcagatcaatgcagtacactagtcctgcaactcacccatctgtcagggaaattaattggtagtaaagcagttctatcaactcacagggaaaggaccatttaaacacagacatgcagcaatgggctactgatttggggaaaataaactaccataactcctcaattctacgatgcaccttcccatattttaatgttttaaaaatcataatgtgccttacaatgaaagtcgtcagagaagggaatcttacctgctactcaacacaattgcctgtacatgtgtgaatgcagccatgtgtacaggtatccattcattcaagtgtcacctcagctgaccacagcaatccatacagaatt

SEQ ID NO: 163902 - DNA, 384 bp, Homo sapiens
gcccaactcctggagcttacagtttgaccacaggagagctgctgcttggcagttttccccgtgcgttcaccccagctgagcagtgtgaccacaaccgtcacttctgtgcaggcagacctgccacgtttttatagcttggtgttcatgctctcatgctgtcattttatgtggttgacaaaggtgcgcctagaatgttcaagaagccaggcatggcttctgtggcaggcctgtgtctcatagccacacgacccggcattctaactgtggtgctgcttgggccttgtgtgtatccatgtaacacttttgggcttgagtgtggatagctctgaaagttaaaatggagagcttcctgaattggtggattgtggagaggctaaatgaaca

SEQ ID NO: 163903 - DNA, 394 bp, Homo sapiens
tacaggtgtgagctaccacgcctggccttccttcctttaattctaaatgcactgacaggcattatgtatcaaaattaaaacgtccatgccttgaacccagcaattgcgcactgagatgtttatcacacagataaatttccacgtgtgcaaaatgtcttaataatgactgcagcagttgttcgtaagaggagagatttgaggatagcctaaactgattaagcaaattatgacatatccatgcagggaaatattttgcagctgttaaaaaatgaggcgggccaattttaagggagatggaactgtaagatgtgcttttaatgcataaagcaagatgtagggagttagtactgccaagtgtggagagagccagtgtgtggagccagtgtggagagag

SEQ ID NO: 163904 - DNA, 918 bp, Homo sapiens
acccacatgaccccattattatgctgcagataaactaaaaggaccttacaatggaataagaatgtttaatagaataatatgtgtagtgaatataaaaactcaaatttgtaactcctcttgcaaatgtaagacatcatcagtttttttccattttaagctacgttttataattctttgcattatctgaattcacatttacttcaaatttcattttattccaaaaatttcaacttttcattacaaactaaaacaacaaaactgtgcatttattgaattagatccactagattacttttctgaatactttcaactacccctgtttcccaaggacaaaaaggatccccacaaccgtgactaataagcaattttaggcacatttcattcaacacattcattctaaaattagcggtgatgagacaggcttgtaaaagtgtctggaattctcttttcagattagcaacacagcaacatttgttaatctgaggaaccacccgacacatgtgtctataaaccattacatcaccattgcaataacaacaaaaactgaacttaaatttaggtggaaggataggagaaaagggaagtaaaaccttttaaggaagtaaggtaaagaagagctgacagttaacaaatgccataaaatgagaaatctttaagctactgcatgaatcaaagcaagcagtattaggcaatgcattttaattagcacaaccatggcagaaaccatctggcagatagttcagacaaagcaaaacaggattgcaatcaacaaatacttgttgctccaatattaaattttaagtcataatttagaaatatgaatgtaagaaaaatcaacctcctattacttcaaatgaaaattactgggtgtgttctcagtaaatttgaattgattctgaagttttttgcaactgaata

SEQ ID NO: 163905 - DNA, 414 bp, Homo sapiens
ctctcacgagtaaacacaataaaggcacaaaagctatgggtattgtatgtgcagctcgaatcacacacacacacgccccacacacacactcccaaaggcaattaatgaccgcaagcaccgtccaccggactggccaacacaaaatacgggagaagggctgccaaggctcaaacgaattcccgtcacaaaaacttttctagccaaggccggttaataaaatagcccagtcgcgggcaccagcagcccagaagctcgagctctagccaatctctgccctggactgcgcagagaagggaaagtagggagacaagctcgggggccccggcgacaggtgagtggggctcaagcctcaccacgcggccgttcttcggtgtacaagtcgatgacgacgtcgcctaaagtggtctccagtag

SEQ ID NO: 163906 - DNA, 162 bp, Homo sapiens
cagccacagctctgagccagcaggcgggcgtgtcacctgatgttcctcatggcagccgctgagccagcaggcctacactaccttcccttgataaatcagaccagctccttcccttgacaaagcccctgggcacagctgtgttctcaacactcctccccacca

SEQ ID NO: 163907 - DNA, 112 bp, Homo sapiens
acaggattgaaatgagtatgtaattttaaccactaacggagataaatttgtgttagctgattctaaattctctactgtagtgctctcaaactttaatgtaaatatgaatcaa

SEQ ID NO: 163908 - DNA, 246 bp, Homo sapiens
tgggtgatctagaggatcccattaggcgcgtctgcgttccacatatatggtcatttgtaaattgacagagtataccaggtgccaggatcataatatggaaggtagtgtaacatggcagttaagaatgtggactttgaagtcagatgactcaggttgggatcctggcttgtcacatacttgaacaacacctaacaataagacttcttttttggctgggcatggtggctcaagactgtaatcccagca

SEQ ID NO: 163909 - DNA, 249 bp, Homo sapiens
ccttgttctgcacagcagccttactgtttttgcgaagattatttatatgggatggctcttaggggtttcctagaaagtgatgggggtcctaaggctcctaaggctggcccctcgctcgcttttggtgcaacaactttatgtctgttataaataaggtgaccatataaactttagcattcaagttggggcacttttgagaataaaaagtgatgccaataattagtttcaaacagtcccaggtaaactggg

SEQ ID NO: 163910 - DNA, 229 bp, Homo sapiens
cacacaatccaccttcacgtttctgaactcggtgtcttttacatcatctaagactcatattgtggtacccagtgccctgaaaaccctggtatccctcaagatggccttgtcttttctactgacttcctgttcaagctctttggtttctttcgcagagtgagatcagcaaggcagggtctgggatttgcaggttatatcctggatggtggcacgacagcgcctggaacac

SEQ ID NO: 163911 - DNA, 352 bp, Homo sapiens
agtgaatgcagtagtagagcagtgtctatattcaacaaagaagggtgtttggagattgtgttaaagtatttaagtaggtttcctaccaatgttgacctggctatttcagtagcatattgtttgcagacagtgactgaggataacccagagctgctgaagtctttcagtgctacagcattgaacatgctggaatcagcactgctttctcctgtcagttccatggaatctcttctattgaagacattggtagcaggtaaaatttggaatctaaaggacattattccatgcaagagtcaagcagaaattataaatgccttactaaagatcttatctgaagttttgggaatggatg

SEQ ID NO: 163912 - DNA, 435 bp, Homo sapiens
tcttcacaggatgctggtgagtagatatgtgaggcatgcgggcattcaggtgctcatcaccaactggaccacagcccaggagcacgacagcacccagaaactcttttaacctcacaggctcaaatccatgaaacatttcccaactttaccccagatcatcacctaatggtagagctatgtagaccacacagtggctccacctctaattacagcttacttcacctgttttatctgaggatcagaagctggatcgggggcacagccagtgcaaacagaggtggaagatgggccctggagccttgaccaagaccctctgcttgtaggtctcagggttcctaccatgttccttctaacactaacttgcagtcagaagaacacacttcagtctacaggttggcctgctttctctcctttccatggctttttccataagat

SEQ ID NO: 163913 - DNA, 446 bp, Homo sapiens
acagctgaccagccctcagctgctcccagagtctggctgcctaaacttttcccagaggatggtccagcagtgctggtccagggtgggcttgggagagcagagctataggcaagagaggtgtgaatccatgtggtccccctggttctgggtaaaggccagggctggggcagaatcacagtcagaaccagggtcaggtcgtcagtgtcaagggcaaatatctttttctttaaaccacaagtgcacctctggtaccatgctcagaatcccttgtagagagtggcatccgtttgctgcatgagatgggagaaaaattagcggccctggctcgagtcttcattgccccttggctgcctgccgtgtcctatttctcatcaggccagtgtccccagtgcctgtcctgatccagaattaccacttaaccctagtggagcaggactctcagactg

SEQ ID NO: 163914 - DNA, 779 bp, Homo sapiens
aggaggcccaatacaagaaagaagtgaacagaatcctcagggatgatggtgataacgacttgttctagaactaaaatccccaaagataaaactattggtacacttgatgcttcagtgtattaagaggagatttagacaaacaggggagagtttcaggatcaagttctatgtactaaatacatagaaaacaaaacaaaacaaaaaaacagaaaacaagcattaacacggagtacagtaatctcctcttatctgaggtttcagttacccacagtcaactgcagtccaaaaatactatattgaatggaaaattccagaaatagacaatttatgccttaaattgcacggtgttgtgagtggcatgatgaaacctagtgccatcctgttcagtcccaccaaaatgtgaatgatccttttgtccactgtttccacactgatatgccacctattcatttgtcacttagtagctgtctcagttatcagaacgattgtccctgtattgcagttcttgtgttcaaaataacctttgttttacttaattctccaattttattgttagctatttattgctgttaatctcttactgtgcttaatttacaaattaaaatttatcattgatatgtatgtataagacaaaacattgtatatactgtatagggtttggtactatcagtgatttcatgcatccactggtattttgcaatgtatccactgtggataaggggggactattgtacaataaagaaattattgaataacacaatactattttcagctacaaa

SEQ ID NO: 163915 - DNA, 367 bp, Homo sapiens
gttttagggtttactggcccatcttttccctctccccacaaaaccaccactcaaatttaacatgcatttgattaatctgattcagaatcagccttatattaaaagtcaggccataacagaaaaatagggggacagacagtaagactcattaagaaggactagactagttgggaagacgggatgactcaggtattagacattactatgttgaatcttcctcttctataaatgattgggtgccctggacagtgagttaagtgcatagatatagactgctgactgacccagtctaagaattttctgaagggtggatggcaaataaatgaacagctctgaggccttaacttggctttctagcaaggattcc

SEQ ID NO: 163916 - DNA, 543 bp, Homo sapiens
tgtctttaaaattaaattttacatatattttcaagatatatgagaagacatacaccacctacctcactatggaatgtggtaaaacaaacataatttatatctgtgtcatggcagccaaatggcataaattctttagatgttgaactttgctaaaatagcaacagcaaatttcatgaacaaagtgaagtggaagagaaaagagaagaacaatccaatacaaaaactgtctaattctttctggttgccttatagcctaaaagaaaattttaaactctccttaagccataactgcaaaaaatttaaaaagaaaatccatctgttaaaacaaattacgcaaatggtattgaggctacttgaatttatgtcacagtgcccttagtattaaccacaccaactgtgggccacacacgtttgactaaatgtgcttagtggttgattccagaaatgtcataattcaagaaatgtacaaggaaaaaaactagtggaaaagcaaaagtaacaagtggaatattttacaaaattgaaaataataccacacaggtc

SEQ ID NO: 163917 - DNA, 203 bp, Homo sapiens
tccagagaatgagtccctcgtcctctccccgtggtcacaggattcttgcccgcagcacaaacttgaaatgttcctcaggccaggtaccactgtcccacagaaagacaggaaatgccacagacatcattttaaatttctagcatctacatttaaaaagtaaaaataggccaggcacagtggctcacacctataatcccaacact

SEQ ID NO: 163918 - DNA, 171 bp, Homo sapiens
atgtcgcttgggggtgatctcagaggatttcgttcgacggaagcattcgaccagaagcaatgaccacagatgactgtctctaaatactctatctcatcaaagtagccagggcatctccagtcaggttctacagaagcacaccgtgaggtgagacgggcttccagacgggaa

SEQ ID NO: 163919 - DNA, 196 bp, Homo sapiens
ccagcctgggcaacagagcgagactccatctcaaaaaaaaaaaggaaaaacccatcctaaaattcatatggaatctcaaagagccgcataatagtcaaaactatcttgaaaaagaataaagttggagaactcacactttcttatttgaaaacttactacaaagctacagtaatcaaaacaatgtggtactagcata

SEQ ID NO: 163920 - DNA, 582 bp, Homo sapiens
agcctttccggcgggagtgattttttggtaagtttaccaagttatgcagccatcaccataaatgtcttagaacattttctaacaactttattgagatgtaattcaaataccatgtatttcacccagagtttacaattcagtgtttttttaagtatattcacagataactgcagcccatcaccaattttagaacattgtcatcccctcaaaagaagaaccttacactctagctgttgcccccttagttttagaacacattgctcaccccaaaaagaacctcagtgtctaaatacaattaatctccattctcaccccccgccagcctttccggcggggggccactgcactccagcctgggtgacagagccagacgctgtcccaaaaaaaaaaaaaaagaaaaaagaaaaaaagaattccatacaaccctcatgttccatgattccaacatcttcagttccatgtttcaggctaaacattttgttgatagtcatagagctgcttgttagttcctgaagcaagcttagatggagagatagagtgctttatcctcttagtggaagccaaattacatcgagcatttgc

SEQ ID NO: 163921 - DNA, 237 bp, Homo sapiens
acgtgcgtacatcttattctgcctggatacctattctgacctgtagagctttactacggtcgtccttttccctaccttccatgaaatgaatgagtagattcgtttcctgtttcctaattcttataatgacactgtcatttttccactcacctagtcttatatttccttaaagttatatttgacttctccattttccgtcgtcccctgtggtcagctatttgccaggtccccttgatt

SEQ ID NO: 163922 - DNA, 106 bp, Homo sapiens
tagaatttttttaaaattgtaaagtacagcattttaaagaataaataattgggcatttgttttgtctcttcaaaatcccagttagaggtcccctctcttacccttg

SEQ ID NO: 163923 - DNA, 698 bp, Homo sapiens
ttgtctaaatctccttaagacattcagactcattggagatcctgttggtttcatctccttatagaactttcttcttgatcctcttaactgcagtctaggcttattgccttttgtacctagtatgtaacttcattttgagatcttctttcttcatcagcctggggtgtcttttctctcttgttgtgattggatatcattattatcttcttgagtaaagtgcatgggagataaaatgttttgaggctgatgcaggagaattgcttaaacccaggaggtggaagttgcagtgaactgagatcacaccactgcactccagccggggcgacagagtgagactccatctcaaaaaaaaaaaaaaatgataacccgttgcatgttaacataaataacatttttaaaaatgagaaatcattgtattttccaaaaagagacaaaacaaaaaaaaaaacaacaccatctttgggcgggcgggctgggccccaggaaagaagtttactaaaccccactcgtgggggccgcggggggcccccaggagagttacagcgaacagtggccaaagcggggcccacaaaagaagacgggccatgagacgaggtggggtctcaccacaaaaaaacggccgggggacccggcgctttgcaacacccgaggggggttggaggcaacggggcaacacagggccaggagcgataaaacag

SEQ ID NO: 163924 - DNA, 316 bp, Homo sapiens
gcagagtcccatgccctgttggacttggtggatttgggtaaaagctcagctctttctgaatcagtcccgttctcagcctctccttgggtctcctgggccgaagctgtgtgatcctctgcctccttccctgggggaggacgctcagtgggatcatctgtcacaagtctgcctgtcgtcttggtggtttgtgttctgtttggctgacgtcactgaagaaggaaccaccacacacagtgggttttccaggcaccggaaatcccttcccctttgcacggacccagcacctgtgaggtgggagaatctgtactgcaccgtg

SEQ ID NO: 163925 - DNA, 1587 bp, Homo sapiens
  misc_feature (980)..(980): n is a, c, g, or t
  misc_feature (1244)..(1244): n is a, c, g, or t
tgcctcatggagtttctgggaaagtaaagaagttaatatatgtaatatttcttagctaatagcagtgactacaacctgaagcaccctcctctgttcctttagtttatttcagtcatagttgtcttgcaagtcccagcacaaaatccctcttccagaaagcatttccattgatctctcttgtatttgcacttttattgaatctacttacaatcactacccacccaatttagcacttaattgagcttaaattttatcatgtggattaattctcttctcagtttgatttcaaacacattcatttttagtcacaaaatggtgtgagttatgagggatgaaggtaggcaagaatctgacttgaaggagccccacagtttacttggagagtgatcctaatattgaattttcaataagaatgtctatggggggtactatttatgaatgcttttatgtgcttgggcacttatattatctgacaccctagtaatcttgtggtgatcattgccactttaccaatgaggacagctgtaattaataatggttaaggaacttgagggtcacccagcttctcagtgtcagaatcagctacgtttaacgttgctttttttgtgatacaaagtggcaacttaaatgccaaaagcatgttaggtaagacagtcatgggaaatcattgatttttgcaggtcttgaagaattattctcattattttatcatgtttaatgaaaaatgcatattgaaataatgccatctattgattagtagatagaaactgatttggttaatttaggcttgcatttccttagtgttggaaatgtacttcctctgacttattcagtgtttgtggtataaagaaaaatagcaacaagtactgctttccatttgtatataccccttgcataattgagagcacttacttgtgtgttattatttggtattttctcaattcattgagaagatggaatagagtattgtggtcaccatntatcacatgaaaacataatgatcacttgcttaaatctcagagataattgtaaccattgtgagattatcgcctagaacttctaacacttaacctttagctaaagggtttaactgcctgcatatttcaagtgcctgtatatagtttacggttttcagtaaaaactgtggatggacaagatccccagaaatcatcgtggacttaagagatagatgttggccaggtgtggtggctcacgcctgtaatcccagcattgtgggaggctgnggcaggcagatcatgaggtcaagagatcaagaccatcctggccaacatgggggaaccccgtctctactaaaaatacaaaaattagctgggtgtggtggtgtgtgcctgtaatctcagctactcaagaggctgaggcaggagaatcacttgaacccgggaggcggaggttgcagtgagccgagatcatgccactgcactccagcctggtgacagagtgagactctgtctgaaaaaaaaaaaagagatcccagcactttgggaggccgaggcaggcggatcacgaggtcaggagatcaagaccatcctggctaaaacggtgaaaccctgtctttactaaaaatac

SEQ ID NO: 163926 - DNA, 318 bp, Homo sapiens
aagccgctacccctcacggatactcaagtgatcttcctgcctcggcctcctaaagtgctgggattgtaggtgtgagccaccgtgcctggcccaaagacatttattaaacaaataattattactgttgctgtaaatgctgtggagacagctaatggttagcccatcccaggttgattgagaggaagggcagtcagagaaggtctctgaggaattgacttttaagggtgaaacctaagaatgaagggaggacaaaagactgacctaggtagaggagatggcacaggtgaatgtcctgaggagggaaagaatgtttgtatt

SEQ ID NO: 163927 - DNA, 213 bp, Homo sapiens
atccctccgtgcaaggctggaatcagtccattgttcaactgtgccctttggggctgtggttcatttggctctgatttttcctatatgttctctcctccaacgcctccggccattcaacgcctccgggccattcaacgcctccgggccattcaacgcctccgggcccattcaacgcctccgggccattcaacgcctccgggccattcaacgcct

SEQ ID NO: 163928 - DNA, 366 bp, Homo sapiens
gtcaatgggctcggtcacgtgtgagattttatttatgtatttattttgtagagacactttctcaccatgttgtgcaggctggtcttgaacccctggacaacatagtgagatcgtctctataaaaagtttttttaaaaataaaatactgttacatgttatattattaaaattataaatgcatgcaaaactgtactgtatgtttatagatacacacatagacacaaaggctatcctaatatgtatggggttataatcctaatccaggatagtggttacctctagacaggagaaatggatgaaagtgttcacaggtcaatgggctcggtcacgtgtgagattttatttatgtatttattttgtagagac

SEQ ID NO: 163929 - DNA, 326 bp, Homo sapiens
cgaaagtgctaggattataggcatgaaacaccatgcctggcctgatatggaaaatgtatcagacgcagagagacataaacatgagactctaatcatgtcctctgcagccatacctgggggcaagtttttaaaggcattttgattttttttccctttcttctagtttccaggctagctgataaattacctaaaatgttaccacaagttgcacaatgtaactctcatccataatcttcatgttcatggaatttgtgatacaaagaaaaatgtatagccaaccaatcacttttgttattttaataaagcaaagtaaattattggtaaac

SEQ ID NO: 163930 - DNA, 421 bp, Homo sapiens
cacataatctttaatgtgaccttgtaactccccatcaaaagatggggtcttccagagcccaaggtgggagaatcgcttgaacccgggaggtggagtttgcagtgagccgagatcctgccactgcacgccagcctgcgcaacagagtagtctcaaaaacaacaacaacaacaaaaaacaaaattaaaatttattttattttattcttggacttgactctgattcctcttttccatgcatttttactctgcacacatgtgtgcatgaatgcatatatgtatttatatagaatataaagccttctgggcagggacctcattttaatacctctttatggcacccttagagtcctctaacagcccttactttttatttgcttaaaataaagtatgtgtgtgtgtgttcacgcatgtataaatgcca

SEQ ID NO: 163931 - DNA, 329 bp, Homo sapiens
cacataatctttaatgtgaccttgtaactccccatcaaaagatggggtcttccagagcccaaggtgggagaatcgcttgaacccgggaggtggagtttgcagtgagccgagatcctgccactgcacgccagcctgcgcaacagagtgagaacctgtcactaaataaataaataaacgaataaatatcgggtctataactgggtgcagtggctcatgatccagtctctttaataattattagcatatttggaatctctattcttgagtcaattttaagaattttgttgtctcttttgaaatttcctatcataaaacttttcacagtagcc

SEQ ID NO: 163932 - DNA, 199 bp, Homo sapiens
gatgtgattattatggactgtatgcctgtatcaaaatatctcatgtaccccatgaatatatacacctagtatgtactcacaaaaattaaaatgaaaaaaggaaaacatagacaaattggacgtcataaaaatttaaaacttgcacatcaatgagcactctcaacagagattagaaaaagtaaacacataggtggggtgc

SEQ ID NO: 163933 - DNA, 156 bp, Homo sapiens
tttattgcattatatcggaagagagatatttagcacatattgtcattatttttgtatccaataatattgcaattagacagaaacacatgaaattattaaaaacccatggtgggctgggcatggtggctcaaacttataatctcagcatttgaggga

SEQ ID NO: 163934 - DNA, 184 bp, Homo sapiens
gttagcaggagaattggggagatagactattagtcacatctgggataagctactcattaaaataacgttgggcaaggttacctacatttgatccttcaagaggatgggaaaagtgtttgcagagtactcactgcaataacagagcccccataatagcctcatgcactggcaagtttttccaaga

SEQ ID NO: 163935 - DNA, 430 bp, Homo sapiens
  misc_feature (329)..(329): n is a, c, g, or t
  misc_feature (338)..(339): n is a, c, g, or t
  misc_feature (363)..(363): n is a, c, g, or t
  misc_feature (365)..(365): n is a, c, g, or t
  misc_feature (368)..(368): n is a, c, g, or t
  misc_feature (372)..(372): n is a, c, g, or t
  misc_feature (383)..(383): n is a, c, g, or t
ccctaacattacaaaagagaaaaagaaaattttagattcaatatggaagtaacatatgcttatttctaaataatgggcagagatggccaaaagaccctaacttcactgtaaatacacattcgattcactgttaatcatattgtgacctgagcatataaaagaaatcggtgagattcactttgaaagtcatcttctcagacttttatcctcctgccaaattctcaaattctcatccaaagggtgaatgtgtgtgaagagggcattgtgtgtgtgtgtgtgtgtgtgtgtgtgtgtaaacttaccaaaatagcacactatatatgtgcagntattgtatnncagttatacctcaatgaagctgtntnaanatanatacgtttatncaattaacaaatatttgagtgccaactatggtctagtgttagagata

SEQ ID NO: 163936 - DNA, 520 bp, Homo sapiens
gggaggaggccctcgctgtgccaagtcattttcctgccgcaccctaccctgagcatcaccggcacccactcgccaggggcccagctctgcccggatgcagcaccctgccagctgacatgagcagatgagccacgtgactttcagtgacgcctagggcagcggccagcctgcctcaggcccacgagccaattcagccacgccttatgtgtggcatctcaccacatcagaaaggaaatatgaaggcccttgcacacggcttagcggcttgtggattccattaaaagaggaaagaaaaaaaatcacacagtagtgtttaaacacctcattagggttatgttcacaaaactcaagataatcatcagctattaccatgtctgaaatacttagactgatgataatgaagtttctgggttaggacaattgtcggaaattcaaaaatcgatcttgagttgtgagaaggtaatgggagaggcatcctcacaggaatgtgaacagattttaaagcacaaagctttccagg

SEQ ID NO: 163937 - DNA, 598 bp, Homo sapiens
ccgagagctcaggaactttatttccaagaacaaaggatacagggactgttattaaattataccaccagtgcctgctcaagcacacacaccagacgcacacacacaccagacacacacacagggccacaagtgaaactggccaggtctggctgggtgtggtggctcacgccggtaatcccaacactttgggaggccaaggtgggaggatcacttgagcccaggagtttgaggccagcctgggcaacatggtgaaactccatctctacaaaaaataaaaaaaattagccgtgcgtggtggtgtgcacctgtggtcccagctacttgggaggttgagtcaagaggattgcttgagcccaggaagtcaaggctgcagtgggtgagccatgtttgtaccagtgctctccagcctgagtgacagagcaagaccctgtctcagggaaaaaaaaaaaggaaaaagaaagaaagagagggaggaaggaaggacagagagagaaaggagggagggatggagggaggaaggaaggaaggaatgaaagaaaaaagacaagaaggaaagaaagaaaagacaaagaaagaaggaaggaaggaaagaaagaaa

SEQ ID NO: 163938 - DNA, 523 bp, Homo sapiens
atccaagagggtccttatcatcccaggcctcctggcactgcagacccagggattttgaaccggtagctcagtggttttcagagtgaagtcccaagactagcagtatctgcatcacctgggaactctctagaaatgccagtcttcagtttcacaaactctgaggtggcaggatgagagcagcaaactattttaacataccctccgggtgactgtgatgcaccccagcgtttgagaaccactgcagtagtgtgaagaaaggggaaagaacaataaacatctattgagtgcctactgttttccatctactttattttcattattttctttaggctgcacagtgtccctgggttttatatctccattgtatgaacacgagtctgactctcagattaaccttctcatgcatccaagctggaattcaaacccagagtctgctgcctccttctgtaaccatttcaccttcttactgggtttctcatagcctgagatcaagcatggatgactaaacgtgtccatagctttc

SEQ ID NO: 163939 - DNA, 133 bp, Homo sapiens
tgttgtatatcttaaatatacatagtaacatttattttaaattaattgcttactattgtacaatgacatggtaagtactcaaaaaattttcttcctttacttcaagtctggagggcctgggatcaacatctgg

SEQ ID NO: 163940 - DNA, 155 bp, Homo sapiens
gtgttagaaagacaatttggattgtaccagggatggggtaggacagaaaaacaagcagagcaggctcccttgcttttgttgtctccatagaacagtagaaaaggtgaattagaccattttgtggttgacattaccaattaattttaaattcaatg

SEQ ID NO: 163941 - DNA, 539 bp, Homo sapiens
ggactgggcaaagcggcctccccaagcccagcaatgcttctccttcccccagctccgtccttgtatgatattacatgtctgcgtttgcccaggtctttcctgggactgcctgagatagtgtatgattcagtagcggaaacactgcctttaaaacaaattataatttgcatgcagaactttgtaggagatgacctacacaagtggcatttggtgagtgctgcctttggaagttattctgtggggagctgattctgatgacttctgcctctttgtgatctaggcgtagtagacactgtaccagctgtgattctggtccagaagtgttagaagctaaataagactccaaagtacacagaaggcaggagcggacttggtcatgaggttgtgggagaagaaggggaggaatggatgagaggagagctttggtctacgcaggtggcagttcgagaaattgtcataagaacaactcaggtgaatttagtatcagggaggcgggtgggggcgggggacgtgaatcaatgtggatggtcgacagttcc

SEQ ID NO: 163942 - DNA, 361 bp, Homo sapiens
tgtcctaacacaaacacaggtgggagtggctctaagccctgttatttacccttcactttctaacattttatcaaagtcagtctccagtatagatgagtagctatgggaaaatactaggaataatcctcccaggccctcttatttttttcctggtttcttatttcttaactggattgtctcctcctctatgctattatattccactgctggattagtcttactgacagctcttaccttgctattctgctttccaagagtttcagtgattcctcagcacccgcagaggaggtgtaaatacactttatctggagctaccaagacctctagcatctttccaaagtgacgtttccaaacttttcca

SEQ ID NO: 163943 - DNA, 345 bp, Homo sapiens
aatgagctgagaccgggccactgcactccagcctgggtgaaagagtgagaccctgtctcaaaaaacaaacaaacaaaaaaagagacaaagaaaacccttttgtagtcattgcattctcttcaaaagatgttccttagtccgccctccttgcacacgcttcatgcaccatcctacactgcaaggatcttcttccccactcacctgcttatctacactctagtccacccttcttgcacaatcatcacatttctcacactaacctatgctgcttgagatttctccacacccatctcatgttcatctagccctcttggcacactcataacgcgttccacacatctctcc

SEQ ID NO: 163944 - DNA, 254 bp, Homo sapiens
agaaaaatcaggacaggagtagagcacaagcattccctccctgctccctcctggtcagcgtaatgcgtgagttacacttcaccagccagtctcggcacctttccagctaaggctttattccgcttgcctcagtctcccctcctgccccctttctgtcccaggatcccgtccagggccccacgtggcacttggccgtcacgtctccttaggtccctctcactgtggcaggtctctcagacttgcctcattttcaa

SEQ ID NO: 163945 - DNA, 333 bp, Homo sapiens
acccccacacgaacacacacacacgaacacaaacacccacacaaacacgaacacacacacacacacacacacacacacacacgaagctggtggctcaacctgccccaaggacagatctccaagaattcaggagggaaaagcgatccctcttctttccagcccccttgggggtattcccctgggggtcttgaaagggagaggggtacctcagatgttggggataaggctctttgggagttagcaaaggaactgggggtctccttggcggtcccagataaagaggaagtgcccccctcggatcggggatggaaaaaaggttccccccagagatgc

SEQ ID NO: 163946 - DNA, 226 bp, Homo sapiens
gcaggcgggatattccaggaactgccatgaaacactctcttaccaagcaattggtaaaacttacaggttgccaagtgttgctaggggaacttcaccaagaacctatggcttaaatcactaggcaaaggatgcagataattttaaacaggtcagtgatgggggcaatgatgctgcgctccccaaatgagtaaagaatgggcccgccctgagtgttgtgtctgcctgg

SEQ ID NO: 163947 - DNA, 248 bp, Homo sapiens
tggagaggtgattgctggactgcctgcttggtttacctgcaagccacaccctcactcctgcacaccagcccagctcactggagcacctggcagaaatcagaagcacatgccatttctgttgccgtggccagatggacatgatccactgatgaaaacccacatgtgtgtgcacacatcttccacactcacacacccctgcatttgaggcagagataccatgcagggctcttcccaggaaaccagcagct

SEQ ID NO: 163948 - DNA, 242 bp, Homo sapiens
taacttcccgaagttacaggaatacatttctgagcttctgattatttaaattttaatggaaaatagtctatagaaaaccatactttccgtccctcccctcagtattcccatttatctgcagaaataagaatttatcttttaaaaagaggctgaaatgaaacacaggcttttaattgtttttcttatataaattaagctgaaaaagaaaaacaagagctttactaactaaagttccgttgaag

SEQ ID NO: 163949 - DNA, 302 bp, Homo sapiens
cctctgacccacccaggattgcaaactggtattaccctacacaaaccagaattcacggagggccctgacagctctgtcctggcttcattttcatccagtgtgatcctaacgccaagggctggggcataagacccatggagaaataacacctgcccaggagtcgtagcttttctctttcaactgctctgaacaaacacaacttctagaatctggtttttatcttcctcagaaggcatgccctaggtaatgatcccaggaagagggtctgattatttccaggctgatggtgggcaggaggtttc

SEQ ID NO: 163950 - DNA, 359 bp, Homo sapiens
  misc_feature (33)..(33): n is a, c, g, or t
  misc_feature (35)..(36): n is a, c, g, or t
atggctgactctagaggaaccccccctccccgntnngagaagagagacgcacggccaagcatttggtagagcatgtagcacgttggggttccggggctgtgcagctatgtgaccttgaggcagtggaggcctagagttggaactgccccaggacaccttcaaaggaagaaaggagacccacaggagaggtctcgccgacagcggctcaggagacaggggcactgttgctggtggtagtggtcggggctggacggatagaacagagccatgtccacatggaggcagcacgcactgcagcctgagccaccaggtcagggacccctgtcgaggcagcagctgtaccggagggagtcaggccg

SEQ ID NO: 163951 - DNA, 255 bp, Homo sapiens
gtctacactcttgggcgtaccatcaaaccactgtaaaattaggacgtatcatcaaaccactggtaaaaattagcttaaaattagtttaagctaacgtcagagaataaacataagggaacaagccaccataagcagaggttgtccataaagagacagattgtaaacatttgagcataaaggccgcatatggtttctgttattaactcgccattgtaacgtgaaagcagccatagagaatatgtaaatgaatgagca

SEQ ID NO: 163952 - DNA, 154 bp, Homo sapiens
ttaatataactttctagttttttttccccatgcatgtatgttttgtgtagaaaataaatacccattttctggctaaaattaattaaattattgaacacatatttgttgagcactgactatgcactattgtgcttgacactggattcttatgtaa

SEQ ID NO: 163953 - DNA, 248 bp, Homo sapiens
aggcttccttgtgtacccaaacccagcagaggacaaacacttaggtttttttttggtgctggatacagcactgggctaagtgagctgaaggaaaggggtaacaaagggaaggaggagggggtccgggagttcagtgtctggtgcagtgtagggcagtcaccagactgggtgaggaaaggcctcagatcccaccgtcatggcagagactagaccctcatccttggtttgagacgaattgagatgggctt

SEQ ID NO: 163954 - DNA, 224 bp, Homo sapiens
aacctaaactagggtgaaattcaaagagaaaacaaagcatttcaagtctgaactaaagaaaaatgatacacttccctccttccctagtaaaactttattcatccatttatttctacttttcctatccctggaagcttttggagaaaaaaaaaatctagttttgttatttgattaagcattgatatagcacttaaggtgggctaagcattatggtaaatacatgt

SEQ ID NO: 163955 - DNA, 539 bp, Homo sapiens
gagtggccctgagttgggtgcacttatgccatgttcagatgcatgcagatgttgcaggagagacttagggttaagctgatcataacagtaaaactaaaatatattgagtacttagcacgtgccaactactcttgttattttcttagtggcttatgtgaatcacatcatttaatcctcaccacggccatttcagatagttttttttttactagctccatgttaaacaggagacagctgaagttcagaaacattaaataacttatctgggatcacatggtcagtaaatggcagagctgggatttagccaaattaactagtactgccaggagtagctctggagccatggcagtactagttaatatgttggtcatctccaaaaaaaaaaaaaaaaaaccgaagggcgggcagggacggggggctcacaccggaaatcccagcactggggaaggccgacaaggagggtccacctgaggtggggagttcgagaccagcctcaccaggagggagaaacccggtctctactaaaattggaaaattag

SEQ ID NO: 163956 - DNA, 670 bp, Homo sapiens
gtgtgactgtcccccaatttttcctaccttgatagcattcctaacttctgcttatattttgggctgttggttcctctggtctccctttttctatctagccaaccactctgctttatatcttttagaaatatctaaaaagtttatgccctgctccacccatatcacccttccttgttttccattgcttttatgaaagcattccctctgtattgtctcaaaggaattctgttaggaggaagtagatgtgggtaacctgcctgccattttaacacaattgcccccattcttcagctacttcttgttactgttctttatagtccttccttttgtctagtgctatatcaaagcataacttaaattatgtcactccccagatcaaagccttcaaagactcccaaaagtctcccaatggcagcaggtacaaatttcttatcctgacatttaagatcattcattatccagctcatataactctttctggaaaactgaccatttgccttcttgaacctaattcttcattctaaagtgcccatttgctgctcttctccaaagagtcgccacatgtaagcgttttctactataactttgctgatctctttcctctgccttactgcttatgccaattccaaccccaacaaccattaatcctactgactctcaaacattcaga

SEQ ID NO: 163957 - DNA, 443 bp, Homo sapiens
caacaggactgagaagagggtgatattttgccatttgtgttctattgctgggatgctctatgacagggtattgaaaaatgatgctgggaaggaagggtggaccatgagctccaagatgtcaaaaactggtggcgggacatggggcttccactggtgctgatgggcttaaagatcactgcagtacccaaggcccataataccctagtcctgttggactaagaaggtatcttcattgagggataacttcatcctatagttatctcagaatctctagaacctaatctatgcctggttcatcgttggcactcaataaatgtttgctacagggagggagagagcaagagaagcttctctttggtccagggaacatccccatagcataattagtatggcgtaattcagtgcaacttatggttcccaagagtctcaaacaagagctctcc

SEQ ID NO: 163958 - DNA, 514 bp, Homo sapiens
tagcaactgtacctattagctgtgtcattacagtaaaaataaaatattaaaatcttatgggcctactgtcatacatgtggtctgtccttgactaaaatgtcatttttagtgcatgaccatacttggcttgaaagcttcaggaaaccaactctcttctcttaaaatgtaagagttccaataaactcctcttagtttctttgaatttaggaacaggtagtcttatgaacaacctttgagaacataactaattcataggcaggggtgattttacatgcagaaggtccatgttactagtagtcggtccagtagtaacaaaggtataaataattcatttagggctgggcacggtggctcatgcctataatctcagcacttcgggaggcagaggcaggtagatcacaggaggtcagcagttctagaccagcctggccaacatggtgaaaccctgtctttactaaaaatacaaaaattagccgagcgtggtggcaggcgcctgtaatgacactactcggtt

SEQ ID NO: 163959 - DNA, 345 bp, Homo sapiens
ctatcaccatgaaaatacaaaagtataaaacttactggtaaagcaaatacaaataaggaacaaaaaggattcaaatgttaccactacaaaaaaaaacaaaacaaaaaaaaaaccaacaaaccacaataaactagaaagaaacatgagacatacaaaataaccagaaaacaattttttttttttgagagtcttgctctgtcgccaggttggagtgcagtggcacaatgatgttgatgatatcagctcactgcaacttctgcctcttgggttcaagtgattctcctgcctcagcctcctgagtagctgggactacaggcgcgcgccaccacacccagctaatttttg

SEQ ID NO: 163960 - DNA, 393 bp, Homo sapiens
cgtaggtgggtagggctggggggctgctgttggggctgacccacctgctacacagggccaggagaggtctcctcaaaacctgccagcccctaggctccctggatctccgggaggacaccccaccaggatcaccctggccttgtgggggccccgcccatccttcttagtggccgcccaacccctctaccaccctccccggcagggcctaagtggaccaagcctggtctgggtccccccacgtttcccacttgctggcttctcccaaagccattctggggctcgttcaacaaaacacgaaccagcgcatctgcaaataacacgcgggtgacacgggggccgtgtatctgtgggtgacacgcgggtgacacgggggccgtgtatctgtgggtgaca

SEQ ID NO: 163961 - DNA, 199 bp, Homo sapiens
tcgtccagctcagagcaattaaaacagattccttatttgtaataatacttggcttttatctggtgtttttgcaggggaacatgcctccctgctcctgagacttatgggaagaaggcatgatatatatttgccaagtcattacatctctctctctctttttttttttttttttttttttttgggggagggcggagagggg

SEQ ID NO: 163962 - DNA, 294 bp, Homo sapiens
gaaagatgggggtcatttggaatttttagatgacactcttttgttatacttttcttgtattgtgtattatgtcctacaaatcgtgcatttgttacagtaagccacagtgtgtatgtgtgtttgccaagtgctgcttggccaaaacagtgttaaataaaattgtaagaaatgctaccagggccttgcatgggttatttaattctatcaatgataaacaacgttaatgtgtagcatctcagttggcacagtatcatgtttcatttatatatgctgagatatatttaagcatgaaag

SEQ ID NO: 163963 - DNA, 674 bp, Homo sapiens
gtgacttggacccatccaacagagacgaagacaactaaatggattcaggatatattctagagataacgagtcctaactctttgccaaggatatggcaaagactctgatggaaaaggcagtaatgtgtacacaaaggtgaacataaataaatgtgtgtatgataaacactgggaatggacatagaaaaacgggtatgcaattggacagagacgacgggagacagaaggaaagatacttgctcagctgtatctaagtaagttcataggagtttcatggtctgaaaaatctgtgacagtggaatttctactaagaagcttaaaaaagtttcaccttctccttggacacttcagaataaggccttcttagaatataatgcattataccacaaatatacttttatataaaatatttgggaccaaaacaagagtaaagaaccaggatccgaaagggtgaatgcctactaaatatctttgattatctaaagctgtttaaaagctattagattggcacctggaaccccaaaatatccacttttcactgggaaggagtggctgtgcctcttcaatcatcccctaaatgcaaagaagtttgacccccacgcaatggataaaagtcacccaaaaaatgaacaaaagaggtgtttggaaaaaccagaacaccattcatcccagcta

SEQ ID NO: 163964 - DNA, 273 bp, Homo sapiens
cctcaaaaaattatattctaggagacatagaattaaacacaaataactctaccctggggtagcacatagatgctatataaatatcccaatagttaaaattaataggtgttgggagttgaaaaggccaaagggattgtgaccaactcagcattccactggaggctatatgatcaaacagcaaactgtttatcatgaatgcaggatgtgggcaaactcacgactgtgcctaccgccaggtttgctgagggcaatcactccctggcaccgtgctca

SEQ ID NO: 163965 - DNA, 806 bp, Homo sapiens
ggtttggcctttctactgtgatttcatgtcatcgactgaactcgacaagtgtcaggctgcattcaaatggcagaattgattgttgaaagtgatttaagccacctgcttctcctaggaaactggttgcttgttcaaattttgtcctgtcctttcaaactgatgtgaaataccattcattgtgtaggcactaagttaaaaatgctggtattgaaagggacagttgtatgtcatgcaagttctactttcttatgttaatgtccatgttgcacaacttctatatattctctttggtaacatacctttctaagtttatatcctacacaaaggtataacgatgcaggtggaggaccttagaaagtataagtgtgtgtgtttgtgcatgtgtgtgtgtgtgaaaaagagaaagagaaacagagagagagattgaatgtgtttatggtggaacagttacccaattggctaggttggtaataactggaaaaactgagcttcagaatattggaagaagtgaattttgatttctaaaataacctctgaaaatgtaagtcttcaagggatgggcaacgtctacttggaatgcctttatatacttaaaattcaacctcttcagcttgtatttctgcacggtgtggattaattgatgggaatagataccgaggctggctgttatagaaaatctgccaatctgaatccatggggcccactgaaatccatgtgaatggcagcatcaggataccattttacagctctcttcatcctcctccaactggactatccacactgtccctgtgttgactcaagtaccc

SEQ ID NO: 163966 - DNA, 413 bp, Homo sapiens
tgagcccagaagtttgacactgcagtgagcgataattatgccactgcactccagcctggcgacagagtgagagcctgtctttgaatgaatgaatcaatgaatgaataggattggttctggctttcagagtcaactgcacttgaccaaggcctggaaacacatgtaaagtatcctaattctcaaggagtatttttctaagacagtaagtatattttagtatgcaaaactattgcttcggacttaaacaaaaataagtgagagaaaatgctagtgttatattatcttccagcaattcccattttttaagaaaaagaaattactgtcaagctttactgaaaatttgcgtaactagatagaatggttacattttttgtctttatttatattttatgtaccaaagagttttcagaaaa

SEQ ID NO: 163967 - DNA, 347 bp, Homo sapiens
ctgtggtgacttattaaaatgaatagcgactccatctccatttcctactctgtggtctttctcatatttggatgctgtgcttttctggtttgaaggaccgttgcatatttttttgagtaaaggggagggggtttcatcttgatgagacacttactccttgtttggtaggctgaatagagctttagtggctcaagttccctctctctgtgctcatggccaccaggggacattgttgagctgtttaatgttcattgagatgcctattttccaactctacccactttaaaggactcgtaattttaaagaagcataaaaaaatcaagttgctttgatcttatgaaagagtt

SEQ ID NO: 163968 - DNA, 565 bp, Homo sapiens
gcagaactctttacctgcagtcttcccagcatcttagtgtgttctacaaacgtaagcctagacccgctgctagtgtttgtgtttgaactcctgggaaacatgcaaattgaattatactttgcctcttctctggtttgttttactttctttaaaagtaggtggatttttgctaaaactgttgctgaagcctgtgaaggaaaattttattattttgaattactatattcagatattgagttgcctagataaaaacattgaattgtcaccttatacaagtaatttttcttaaaatatcttctcttctgtttgcttccttcatgtctttcttctctgaataaagtcaggttaatttttggatgaaatacatcatctccattgcatctgtttgtatgtagatgcccttctctgcccagcctaatacttataatatggactggaaactgaaaatgagcttacaagctgtgttttttttcctcatgcttttgttttgtttcatctgtgtgataatctacagatatctactcataaactctgagaaataaagtaatatgttagaagaatgaag

SEQ ID NO: 163969 - DNA, 460 bp, Homo sapiens
gcaggggttggagagagagaggtagggggaatgagagcaggaacacagggaaggaggaaagtcggggaggcagtgggagatgccaaaaaaaaaaaatctctgcactatcttcgtgactttctccttcctttttcatgttcaaatcaaattatccaccccccatcatgcaaccatttcactgagattttgaaataattgagatgtgttgcaaacacatcctcgcacgtcaagtgagcaagtgacttcaagtctgaacacctctccagagcaatatttcactttgacgttaatgatggccaagagtctagcttgagatgaaggcaaaagggccaaacacatagacaaggtccttggaggaaaggaagggggaaaaattctgactaaaaccccactgggctagagagggtggagaagcacagcagccagtggattttcatttctttggctttatggaactgaa

SEQ ID NO: 163970 - DNA, 461 bp, Homo sapiens
atgggccagagaagaaacggctcagagagggcaggtgtgtggcctggggtcatacaacgctctttgattactagccacattgtgctgtccccacgggtaccatctgctagtcaaaatctttttatctaacaactagattcacacaggaagttaatgctctttccaagtctctgtcaaaccctccaattaaaccaaagagaaagtttcattagttactactagctctaacacattctacacttcctcatttaatttcataacactgctttcatctcccttgtattcatttttgtggcaaaggacactggttttccgtttactttaaggatatacgttttcctttcaaacgaaaccattttaaaatccacttgctgtttatgattatgttgtgatgtttatgtccatgagcaggaatcagtttaagggaggagaaagactggcacagatgttaagagtaacag

SEQ ID NO: 163971 - DNA, 296 bp, Homo sapiens
actccccacacatacacatgcacactttgctccagccatacagaatctctgtctttggctatactattccctctctggctagatgcccagccccacgtttgttttcaggtccatttttatgtatttgtaaagactgggcagcgatttcatttctctgaagccttgccatatccccctaggaaaaactgtcactccttgccagcctcaagctcccacggcatgctgctcattcctctattacagcatttatcacacttgagggtaattatctgcaggctattatgtttctcccttgc

SEQ ID NO: 163972 - DNA, 419 bp, Homo sapiens
ctaaatgagcttattttggatcttttctcttcttttcttggttaatcttgctaatggtctatcaattttatttatcttttcaaagactcagctttttgttttatttatctttcgtatttttttttcaatttcatttagttctgctctgatcttggttatttcttttcttctgctgggtttggttttggtctatttttgtttctctagttctttgaggtgtgacttgagattttctgtgctctttcagacttcttgaggtaggcatttaaggctatgaactttcctcttaatactaccttttctgtattccagaggttttaatagcttgtgtcactattactgtccagttgtaggaattaatttccatctagatttcattgttgacccaaagttcattcaggagcaggtttcttaatttc

SEQ ID NO: 163973 - DNA, 442 bp, Homo sapiens
aatgcaggtttcactatttcaaaaacaacaaaactaagaaactagagaatacaaataatccttaccagataagtatcatcattagattttaaaaggaaagtacaaaataaagcaccactatatgaaaccttagggttttctcttcaatatactaaatcttcgttttaggctagaaatctttatcattcctattttccacaaatttttacatgcaattcctttaagtctatcataattatggattcaaaacccttcataccacatgtagtgtatatattaccagctatttaacaaaattgcagttgctggatggcccataatcagagtggcaacttcaaactgccggtcaccttcgaatgggtaaggtccaggttttgtgttgaccacacactgtcgagactcaggtatagggcatatagaatacgagtggtggactggtttg

SEQ ID NO: 163974 - DNA, 284 bp, Homo sapiens
atgtggataacatctcccagttaagagtgtataggttgaaagaatatttgaaggacagaagtgggagatggagaaggaagggaagaagatcagtcacttggcctctggagattcagaacataggttaagcaatttgagacgcataggaagagaacttggagaataccaatattttacagaataggcatagagagggaaaaatcattaaggaaactaataaaaactactctacaaggtaagaaacaaattatagaaaaagaatgtagtatcatagaaggcattag

SEQ ID NO: 163975 - DNA, 206 bp, Homo sapiens
attcctttctttataaattacccaggtattctaagcaacagaaaatggactaagagtataatatactgagtaaaataagtgtctgcggatatcaatacatgaataaataagtgggaaggaggggaaaatcttccatagagtagaatgccaactgataaatgtagaaggaagaatggaattagaaatttaccatccagcaactatta

SEQ ID NO: 163976 - DNA, 315 bp, Homo sapiens
catgtttcccctctgcgtgtgcggctagaaagccaaacactgcactaatagcaaacccttaacagggacttcatggtatgtatttagtgctttatttctggcttgacttgtctgccagcattctttgttttctctttgcctcctttttaacttatctgattccacaaaatctaccaattatgtgacagactttgctctaggacctgggctgatgactgagacatacctcttcctgccgtcatagaggtcccggtctcaaggaagacaccagtcagtaataggcaagcacaatacaacatgataagcgccatggta

SEQ ID NO: 163977 - DNA, 357 bp, Homo sapiens
accttatccgctatcactttctgctcatccttgctactgcccagtattctcctgctttaaggtagaagattatcccacttcattcacatgattgttcacaaggataggagtctttgttttacttgcacatctcaagcatcaaaaagtacctgggaagaagggactttctttcttaccaaccttaccaaaaccttaccaacactggaaagaagggaagaaagaatgaaagaaaaacgaagtaagaggtccacaaattggcaagaaaaggtctctgcacctttcatttgtaaaagataaattatagtgatgtcttctttgaaatgctactcccctaagaatttcgtatttggagagact

SEQ ID NO: 163978 - DNA, 249 bp, Homo sapiens
tctctcctaaccaggacaggtcctcctaattctcatagcactatgaagccctcctttatagaactcaacatagctataattgaacattcatttatgtagttgtctaattaacatatgtctatcttatcaaactgtaagtccacgtaagaatttttgtttttatccaccactgtatcctagtctcaataatttgttgaaaaaaatcaatgagtaatattcagcttgtctccctaactgtactgtgagaac

SEQ ID NO: 163979 - DNA, 251 bp, Homo sapiens
tggatgttcaggatgaagaagtggagaagtggaaaaggacaggtaaaggtaagccagagccaaagactccttggtcttaaaaatagtccaccacatgcattgttagcttgactgcaaagctcttttcagtgagaaaagaatgaacaaagtgaggccgacacatttcagaaagcatatctgcaaactgcctataaggcaaaagcgaacttttcattttctgtctcgtaagttctgtctttgcctgccacaga

SEQ ID NO: 163980 - DNA, 533 bp, Homo sapiens
gattattttgtaaatttcttacatcagcttccccactaaatccacctttttttcctttggacacaaaccataaagtaattattagctaaaccacaaggaatctgtaaagtttaaattactgtttcaaagtgtgcagatcattgccagtaaagccacaactgcaaacttatttgcattcatgagatgaaaagaatgattgatgttcataatgcaccaggaatagatggctgtgtttctatatccacgttattaaagtctgcagtttgttgtacactgtatgcatgaaaatgtcttcagtgtcagtaatgcctcagatcatctggaagctacagaataattatcaaaggaataaattaaatggataaagtatgtaagttacaggattattcttaaagtaactgtttacttttcaaattcaactacaactataggaactctttttaaaatataaaatgaaatactaagttcttactaatatagttttttttaaaaggttaacaatttttatttattctttttgagatagggtctca

SEQ ID NO: 163981 - DNA, 604 bp, Homo sapiens
atgaaaccagacccctgcctatcaccacatacaaaaatcaactcataatggattaaagatgtaaatgtaagacctcaaactataaggatcctcgaagaaaacctaggaaatacaatattcacaaagttgtgcaactatcaacacaattcatgtttagaatattctcatcagctcccaaaagaaaccctcatccatgcacagccactcctaatttcctcttgttcccaacccccagctctaggcagcccctaatctactttgatgtctgtaggccttttctggacatttcatgtaaatgcagtcagaccacttggggccttctgtgactggtttcttttcacttagcataatgttttgtttgtttgttttttggagatggaatctcgctctatcgcccaggctggagtacagtggggcgatcttggctcactgcaaccactgcctcgcaggttcaagggattctcctgcctcagcctcccgcgtagctggaattacaggcatgagccaccacgcctggctaatttttctatttttagtagagatggagtttcaccatgttggccaggctggtctcaaactcctgaccttgagtgatccacgccca

SEQ ID NO: 163982 - DNA, 695 bp, Homo sapiens
ttttgtatttttagtagagacggagtttcaccatgttggccaggctggttttgaactcctgacctcaaggaatccaccacccttggcctcccaaagtgtatgttaattattaatcctcattataataattacatgatcacatattataaatgtggatattgccacttttaggatgaggagatgggatgtgctcactcctttaacttacgtgctttgggggaagagtgatctgtgttgcacaaaaaccctttgagagcagacactcctgcttcttttgtcacgtgtggcttcagcttttatcaagaacactgggctcctgtccaggggagagggtaggccaggagcagagcctcagaggagaatgggagtgctgtcctcacaggcggcctggaaatgcaggaggcagcacgcccagtgcttggctgcaggatccccgagggagggacaggatggatggccacaggcatgccactccttccctccgtctggattttttccctgtgaaacgggagtgtaaacaccttcctggagtggcctctccatgaaaggttgctgtcaccctgggtggcttaaggtcaccaaggccggccctgtccgaggggtcagccttcaggaggattgactcaggtccctggggccctcccgagggtctggttcagtcgacaggtgtgtggggtggggcccacagcaggaca

SEQ ID NO: 163983 - DNA, 443 bp, Homo sapiens
atgagcatttctggtcctgctgcatgagtgaggaagaaggtactgtgaagaatgtgaaaaatagggctactattttgacactgtgacgcctgctgagtttggaatgtgaccttcccggctgtctggtgttgcacagtgaagagcacagactggagttagagctgtaaccttggacaagtttacttagcagtcactaagtatttattgattatgtattagtctctagagatataggagtaaactcatggcatttattttctattagatggtgtagaaaataaaaaaccaagcaaatacagttgacccttgcacaacacagggttaggggtgcctgtcccctgcacagtcaaaaatctggatataacctttgactttctaaaaacttaactactagtagcctactgttgactgggagtcttctgttaatacaaacagtttattaa

SEQ ID NO: 163984 - DNA, 191 bp, Homo sapiens
ggaaaggaggaattatgcaactgaaagggatggaggacttctaggtagaggaaacagcatcaagagagcagaaaatgtttactggatttctgatagcttggtatgatgacatagtgtagaatacacgggaaagaggaaggatggttaaggtgaggttatgaaggatctggcaggtttttctttctttgttt

SEQ ID NO: 163985 - DNA, 447 bp, Homo sapiens
atcaaatttacttctagtttgtcactgcttgagctgaaaacatattgcaggagattgccaagggacagtctaagagtacctatcacttgggggaagcacacaacagacagatgtattgctgttaattaagggtagaatagaatgtctgtcaagagccctctgaggaccccctatttaccaaaccatggcaaataatgttgcagatcatattttgtagtcatccgtgaggaagggaaaagctgagaggtactctgactgcaagcaagaaataaacaaaggaaaaaaacaaaacatggtgattatttagccatctttgtcatcaaagcacaatgcaatgagagagaaagggagatatgtgcaaataaagatagggcaggcgcagtggcttccacctgtaacttccagcactttgggaggccaagggaggcggatcacttgaggtcagga

SEQ ID NO: 163986 - DNA, 407 bp, Homo sapiens
cgttaacttacttgttaaattcgcagcttactacaggatgcttgtgtctaagtgatttcaacttctgaaggggaattacacattttttagtcttaacataggaaggatgcttctccctaaccacgactccatgctgagtctcaggctgggctctgtccagatagaatcatctttaatatttacaactctgtgatctggttggtaccctgctttaaagatgaatacattgagactcaggggaaggggctaagctacagacatcagccatggctccgtcccaggttagctccagacctcctgctcttctcatcagttctgtcctttgagttacttaagcgtatagatggtagttgatacagttctgcataacagactgataggttcctgaccaacagtctgctcctacc

SEQ ID NO: 163987 - DNA, 638 bp, Homo sapiens
agtttattcctgtgttcatgtttttaacgttgttactaatggcatgtgttgtattaatttttatctttctcatattgcattggcaagaatgttgatgcaatattgaatttcagtggttagactggatatctctactttgttctagaacttagaaggaaataattcgttttgttcatgtagggccagcttcatgcactgtaccttgtacagtcatacaagatttcatgctcagaagtgccctgtttttgatttaacactctcttattactgccttaaatttttaaataattttacctctgtgttttaaaagtgcagtatgatgggacacttgagtacaagtgtgagcagagatgtctgtgatatacatgttcagtttcttactgttctattcacatacagcgttggtgatgccacgtgaacgcagaattcttgtggacccacagtgcttgaaagttcagcaagactctgagtacaagataagcattttatgtctataaatgagtgagcaaggttgacaactccaagaggctacactttccattcaaaaccagaactcaattcaattgcaaacaagcagtgactttccaataaacacaaacaaccatggaaccctattacataataaattttctctgtta

SEQ ID NO: 163988 - DNA, 159 bp, Homo sapiens
ccctcctcccctcaagatgtagcacaatattgggctaacctgcttgtgttcatggctacactgttgatcatcctgctgctgatggtatgtgatgagtggggcatccatcgtattttgtatggcatctttttaaaatctaaattcaagtttctgcaagaa

SEQ ID NO: 163989 - DNA, 203 bp, Homo sapiens
gtcccacactcctatagatcagtctcaagcctgctctgactccaaaggggggggctgtcatcactgtgggagtgggtgcctgcaggaagccagtttatccttttgcaggcagtggacttctctaaggctgcgggcatgtgtgttggcatcttggagtcccaggtgttttggcgtgagtaatactgtatagatgtaagtgtgtg

SEQ ID NO: 163990 - DNA, 360 bp, Homo sapiens
ctaaatttgaatatttctccatgagtagaaacttacagaaaatctttatttatctaccccctcaaccaagactttagttattcctttggagatgagttaaaaaatgaatcctaagcacagacatatacttagaggcactgtcactttgtctctttttcctttttttgttttcaactactgagtgaagagtggaggttttctacagaatttctacactaaagaagtgacttcccccccttcttgctgtatgcaattaaaaatgataaatgagaactctactttttctgagactttcttgtcttctagctaactgtcttttaaaatatatatcctaattttcaatagttaatactagatagt

SEQ ID NO: 163991 - DNA, 501 bp, Homo sapiens
tttaaaaagcagggagaaaatattagaaagcagcctttctagtaaggttaagtgctgtcctgtgacctgttggtctcaagttgtgtatgtgtgcaaggaccgtgtgtttagaacatgtttatacagtgggtcagagtcagaaaagtatgaaaaccaatgatgtaaatgaatactgaaggatatggcatagggtttatccagttaacatttaccaagcagtttatggaacctaatgcatgttatgattccattttataaaaataactcacatacatggaaagatgctatggacagtgactgtctctagattccaggattttattatttatttattcgtttatttgagacagagtctcattctgttgctcaggccagagtgaagtggcatgatcttggctcactgcaacctccacctcccaggttaaagcgattctcatgcctcagcctccccagtagctgggattacaggtgtgtgccaccatgcctggctaactttttgta

SEQ ID NO: 163992 - DNA, 338 bp, Homo sapiens
agagttatgcttatataaatgcttcaaatcctccctaattttgtttccttggtgttttcattattcatagttttccaaacaatattattgaatatctatgttttatcctattgatttgaaatgctatctttattatacggtatatgaattgtgatgtagcagggagaacagacaatcttgacaatcttgacttgtaaagaacatgactctagtgtttgcgtttcaagtatgatgctaagtgctttgtcagatatatttttattacatgtataaactactcttctagccctattttacttataatttactttaatcatgaatagatagccatacgtttt

SEQ ID NO: 163993 - DNA, 346 bp, Homo sapiens
gatttcaatcaatatatatgttttactttcttttgaacttcacatgaatggaatcatagggagtgtactctattctgtctggcttcattcactcaaaataatatttttgcaattcaacaatcaaaagttcattaaggagaaaatctactcagcaataactaatggactattgatacaagttgtgataaacatttttgtacaattctttttgtgcaccatatgtattccttttttcccagataaatgtcaaaatgtgaaatttctggctcacagtctacatgtatgtttatcttgagaaacggataaagaattgtccagagtggttggtctattttatattaccacc

SEQ ID NO: 163994 - DNA, 342 bp, Homo sapiens
gaccaattaatagaagtaccttgactcaaaggtgtctcctccaagatactagatcatcgaaaccgcaaacatctcatacacaaacgcctgagcactatctattactctcatcgctacctccctgacaagcgcctatagcactcgaataattcttctcaccctaacatgtcaacactccagacctatgtctaatgctgctttggaaacacaaaaagggaacctaaaaatgtcatttaagaacataagcgactcaactactgtttgagatggaatgcataatctaaaatatcaccatgaccttataacctgtacaatgcaaactgggatgcaagtagggaaaag

SEQ ID NO: 163995 - DNA, 491 bp, Homo sapiens
gctctccatgcctcattctcaccccagctcggcctgtgtgtctgcccacctgggcctcccatccactctgtcaagttggtgactgtgtccctgccttgtggagtcctctcaaggtcttgtggggaccttgtccaagaggtttttaataaatatttgtggggagaccaaaccaagaagaaatgagtggattaatcacagggctctaggccgggcacggtggctcatgcctgtaatcccagcactttgggaggccgaggcgggcagatcacgaggtcaggagattgagaccgtcctggccaacatggtgaaaccttgtctctactaaaaatacaaaaattagctaggcgtggtggcatgcgcctgtagtcccagctacttgggaggctgaggcaggagacctgcttgaacctgggaggtggaagttgcggtgagccaagatcatgccactgcactccagcctggcgacagagcaaggctctgtctcaaaaaaa

SEQ ID NO: 163996 - DNA, 165 bp, Homo sapiens
cttcctgtctctttattccccaggtagctcgccatagattagtaaaggaaggaagggacagcgtagacagatgggtgaagagatttgaatatgcgctgcctgctctagcttcactctaccatcctagtcagtaagacaggggttgaggcccaaatgtagtcacat

SEQ ID NO: 163997 - DNA, 543 bp, Homo sapiens
cagtgctcttgtgaaagggtgggaggagagcaaaaactcgcatgtactctatcctctcccatgaggaggaatgcctacaaaaacgttctatcgtgggctggtggggatggtgcaggtcaggagcaggattccgggctgtgctgctggctggtgttgccagctgggactgtatttccaatgcctgcaggagaaagaaaggagctgctcattctgagcttgtaagaggctccattcttcaagaacttccaaaggtcaaaatttcctctgactttactaatggcctatgaatagtgaaccacttttttgaccatagatgctggggccctgaagaaagcaggaaagacagcaaaagagtttctttggatgtctgtaaagcctgaatttgacctcagctatctgctgcctccagttcctttgctttctcaaggacccattcagacccagcgattccgcacagctttgtgccagtgcatcccagccctctgggcacatgatctccaaacacctaatctttcaaaccatgcagactggcagtcacttgca

SEQ ID NO: 163998 - DNA, 573 bp, Homo sapiens
tcacggcttctcttcacctctctggcttctgcaatgtccctgtgtctttgagcttcctgtttttatgagattttcactcatgtttttaatttcaagctctcctagttcttgggggctcctttctgtggcgccggctctgcttctggttaggggctgcttcaggcccctccaggatgccaggacggttcccaacactctcgtctcttccaagaatccagctgcatcccctggggcagttttctgtgtatttatgttgtcctttctctgccctgggctgtgcagcctgggtggggagcaggaagtctgtctcatgccagggcccacgccggccccaccccaaccactgatctgcattttatatgaacctgtcaaggcagtttgggattactgcaattttagaaaaacatctgttttgccttagctttccaatttgttggcaaaactgtttgagtattgtttacgacaccaaaagttttctacgagcctcttttttattcttacgtgtgcatctttaatacaaatccagcttcccaatgagaaaaccgtacctaacaaagggcactgtccaaaccg

SEQ ID NO: 163999 - DNA, 697 bp, Homo sapiens
cttagcagattccacagggagagggaggtgtcgttagtcatctccacagcaatattccaggaccattaagtttttagaagaaataaagtgtgacccaacaatattatatacagccaagatacagttcaaaaattaaggcaaaaggaaatgttctccattatgaaagaaatcagagaacacaagtcctaagaacttattattgaaaaaagtgaataaaattcagccaatttaagaggaacaatgaacttactggaatagctgtggtaaaaagactaatagtgagcagctaacgaatttaaatacaaaacaaatgcctacacaactatgaggattatgtttacataagagaatgtcactacctgaaaaaatagaaatgtcttcaaaaacaaacaaccctgtcagggcgcggtggctcacacctgtaaccccagcactttggaattttctagctgttctcctcattcttaagaggtattcccttcctgcctttagatgctcaagtgttagaccatgatcctcagaacaactgcagtgtcctggcaaccatgactgcaaaagccaaaaaaatcacatgaaagtcaacaatgctctgccacagctgaattggctactgttaaattaaccaatcttagaaaagcctagcatctgatcttacatgaagtaataaatttccaattgcttcagccactctgatttg

SEQ ID NO: 164000 - DNA, 344 bp, Homo sapiens
gggagatttatcttcaaggtcacaaaagtatgctagctttgggggaagctgtgtcatagtgtcaagtggaacatgcttgtttatttggtactcacgcagtgttgtttatactgaaatacttgaatgtatgtgctcacctgctgtttttcttctgccttttaaaagtcttggagtacatcattataacaaagcaatttttttttgattttgcattgcaagtttttgtttctctctaataatgcagtttacttctaagtgtggctttgataggaagatgtcagaccttcgagtggatcactaaataataatcacttgtctatcagtgagcttgttataaggtgtgt

SEQ ID NO: 164001 - DNA, 485 bp, Homo sapiens
cacatcaccccaaacacaaatatgatctgtcccattccccactgaaaacacttcagtgacttcctgcatccttaggataaattgcaagctccttacaagaccccatcacccggctcccaccagttcatgttctgatcataatgaattttatgtcatgctctctcctgttaaactggatgctctgtttaggacacattttcctcctctctgtccagactcctctaagtcctcttcagttctcaacttagacatcatttcctcagggagctggtccctggccccattctgagttcagtccctctgttgaagacgacactgtaattccgctatcatagccccgacctgcttcatgttgggacatgaagtcagagactgcacatccatctggttggccactctgcacccagcaccttgcctgctgcctggcacacaccagggcacagtgaatacaaaagtgaacaagggacaagtccagggagactgag

SEQ ID NO: 164002 - DNA, 191 bp, Homo sapiens
gaactacgatggggatcgaggtaaaatcagtgctaactcaacaatattgcaatacatcttgttagagggtagagtgaactaaagaaggatgttgtaaatctcaatctgatccataatctcaaaactggagatgatttttaaatggccgataattaaataatcagtaatgattagagctgctaatacaattt

SEQ ID NO: 164003 - DNA, 531 bp, Homo sapiens
gagtcagacttctgttgataggagtctcagaactgtctactgtggtctcacaaagctgagccaaagttttaaaacagtgagagaggacacccattttaaatcagtctgagtgagttatggttttcagtgaatggatcacctctgtagatttgaacatcaaacctttatttctaatcagtggctgagctccttcacagaattcgatgggaggctgttttcgaaagtaaggaagtcattcaggggttttgtttctgtcctaaaacagggacccctctaggggaccagcagcagacgccttcagcccctgctgcttttggctcctttggcctccaacggggtaacactgggtgacaggcctgaggacatcccaggaaggactttgggagctgagatttcactctttgttgtactgggttttatctctgggatcctaaatttttgtagtaatgaatctttctcctgtttacagttcttcacctcccagccactacctcccacgccaagcaaaaaaaataaataaataataaatca

SEQ ID NO: 164004 - DNA, 320 bp, Homo sapiens
ttgagttttccaggccctctgtgggtgtcgccgttgccgtgatagttcacacacgcaggggtgtggatctcgttcgttttcatgtagaaaacgagagcgaaactgcagagaaaagaaacgtcgggtgcatcacggcctgaccacggattcctgtttcctgcaacaaggggagtctccactgtggccggtctggaaaccggaaaggagagcgaagtcacgatgctgcttttccacgcttcgctggaggtttctgtgtccccgcagagctcgggaaacagccaacgtggtcgcgctttcgggggcgggagacacgcgagcaa

SEQ ID NO: 164005 - DNA, 131 bp, Homo sapiens
atatcgagcagttctgaacgccttggaatgatggaaagataaacaagtgaagatatccaatagggatgtggaacaagaaaactgtcacaaaggttcttttaaggaccaaaacgtagtcttgcaagtctttg

SEQ ID NO: 164006 - DNA, 639 bp, Homo sapiens
tgtgtgtataccttattgagtggtcaggaccttgcatcaaaatctgcactatcattcctgcagcagtgtacttattcacttggacgtaacacttgctgatgcttccaattctttatccaaatgttaaaataaatatgccagtatttatacattcaaatcagtatttctccccttcaaaagcctgctcttggcaagctgtgtactaattctagtgatgctgtcactactgagaataattttggagctcctgctttggagttgccttccgagtttgcaacacatttcctgattgcctcagtggtggcaaaccttcctcagctgggaaacagccaggcactgtgcggggccaacttgggcttccgaggtggggaatcgaggttgtcaataagtatgctcattaaagtaatgaaaattctcttgaaagactggcagttctaaaaggggcatttagtaatggcatggagtatgtatttaggattggaaggaattacagttggtccctgaataacaccggggttaggggctcccatcatctccacagtggaaattttgagtacaacatttaactcctcaaaaacttaactactttgaagcacaaccttcattttggtgtttatgctctggtatgtatgtaaagta

SEQ ID NO: 164007 - DNA, 621 bp, Homo sapiens
agcgccgcgccgcgccgccgccgctgccggcgctcggcttggctcgcgctctgcgctctctttcccctttccttttcgcctctcctcgttctctccctcgcctttcctttcctttctcttcctctcttcctcgctcctcggtctcggcgctctcccagcttttcttctcctggctcctggttccccgctacgccaccagtccactcacctctctccttgccctactccctccgctactccctgacgccccctgcagcccccagcccccctgcaggccccagccccagtaagtttggagaggggaacaaatgctgagcctaggtagggaccaccttggggaggaagccaaaatcacactgctcacccgagagcccctgccccgcgctggcacgcccccgcctggagtgcactcgtggccccgggcgctgtcaggtacccgaattggggtaagcgagttggtaactggacctccaaagccttcccctggggttgactttggaattgttcctacagcccggggactggtggttggggtgggaagaggaccaccaccaccaagggtgactttgagggagactagagcgcggccccccgacagctgtgggggagcgggggtgtgga

SEQ ID NO: 164008 - DNA, 186 bp, Homo sapiens
ccatacttaatgattaactcattaagtgaggccatccctagccctttgccctcgcggtgctctgctaccaatcacctgaagagaatcgacgttaaaatctcaacaagcacaaagaaagcccatgcagtcaggcaagtgaagacacaggcgactggcctagttgggcaagaacgctaaactaaatgg

SEQ ID NO: 164009 - DNA, 514 bp, Homo sapiens
caggcataacagaagtcttgccacacccataacaacacgaggttgtgacggatggtaatactgtgaagtcaaattcagctcagcaggggtctccctatagacccatgcaggttttccggagttggtgagtccagctgatggatgttaaagagagggagcagtctagcagggaagcaggtcgcggcagttctgcaaatgcccagtcctgggctggtaactaactaaaggtaaatttcacttgtttttctagaagcagcaaaaatccaaatgaactgtaaagccagggctggttatataatttgccccacccagtgcaaaatgaaaatgcaggagcttttgttaaaaaattattcagaattgcaaaatggtgtcaatggagcattaaatcacgtgtggggtccttctaagtgcctggccctgtgtgacagcacaggtcatatgcccatgaaactggccctgtatggggttgcaatcctagtctctgataaaacagactttaaaccaacaaagatca

SEQ ID NO: 164010 - DNA, 400 bp, Homo sapiens
tccgtgtttagtccaatatacatagtccagtgtatagtaattattacaagtataccaaaatataaatggcttcaaggtatatataacctaaggttaaaacaaattataaatcagattatgataattaacatggcacagagttaaagtatttattgttaataactcacttagcataataggcatgtttagcctaagtaactggtgtcacaatatttttatgcctaggaggaattctttttatatagctctcaaaagagataagattctctccacgtggtttgggcttactcctttgactgagagcatgccactttttactagaggttgatgtatgactcaacttagagttgaggatgaaaagtggggatcatagcacctgcctataccctggtacagatca

SEQ ID NO: 164011 - DNA, 471 bp, Homo sapiens
acgtgacatcccaagaaccttcacatactttgccatactgttttctagaaagaccatcaatttgtacttgttctagcagtgtataagtgcctgtctcactgcttcctgcagttgttaaatgctcactggtattctgactgacaatgaaaagctggttttaaaagtcaaagattaaatccctaaatccctaaaagcttctttgggatttgtaaatactggagctttaataatgtatctttgttaatatgcctttccctaaatcctttccaattccaaagaaaattcatctctttaccccctgatcattttctgattttagaactgaggtagctaacttgttgattaattagcaatctggaggtgtgctacttctcaagaagaaagtcaggggtctaatctgggaagccaggtgatccagtctcatagccaaaatctgtactcagcttcatgtgagaaattgtgcagccacag

SEQ ID NO: 164012 - DNA, 511 bp, Homo sapiens
tgtgtctcattggttctgaatgagtcacgtactcacttctgaaccaatcactgtgactagggaaatatgacctgctgattggctgaggcctagaccacacactccactcctagagggagggatgacactctagccagattccagagtcagagtgtaggggagggtgagtccccaaagaaaaatggaatgtgggggaactatgctagggagacagcaacaaaatatccttgataatagtgttaaatgtccccacacttgtttcctcctagaaccctatttgctgagttacttgtgcagagcacatattgagagatgttggaccttagaaatacaagacatgcataatatctctgtaattacaccttctgcttattctttacaaataggccattcgagttaggaatgttagcaaagagaaaatctcctattaattaattaatttatttatttatctgagactgagtcttgctttgtcacccagcctggagtacagtggtgtgatcttggctca

SEQ ID NO: 164013 - DNA, 366 bp, Homo sapiens
attttcaagggtgaatgactgctgggtcacgtgtagattatggcattctggaattcagggcatggggtgacaccgagtgtctccaatttcaagaagggctcaataccctcaggctcttgaccatatgctccccaaacctatcagtgttcctcctggactcttttcaaattcagcaaatgcatcctttccattgaagtcattgggatggatgacgatcttcacaggtcacctaatccgtgcacctgccttcaggcagggctgctcctaaaaccagcccagacagatggttctttgctgttctcaaaattccccagggaaggaggttccacaggctgttacaataatccattcccatgtctcccaaag

SEQ ID NO: 164014 - DNA, 750 bp, Homo sapiens
  misc_feature (59)..(59): n is a, c, g, or t
ctggttgtctggtccctgctctggggacacaggggcttacacagagtccagtcagggcnagaatccccaacgcagggtggctgagtttgtctacctttctgttcataccctgctacttgcccccctgcacctcccccctcacttactgcctctataccctttccctgaagcctcttctgcctctgcctggcacacactgtccctcctcctctctgtgcccttctctctctgacccagggctctacattctgcagcatctctggtgctattttaggtgggattgtttgtgccatgattccttgtctcttgtcccctccttttctggcacccaacactagtacattctgatgccttcccttttatgtcttgcattggtgtttgtgaaaagcaagtctttatagtgtacctttagagcaatatccattaaaaaccaggatcacacaacaagcatgtagttgaacatctgtgtgccttgcactctcctagacattgggaatgccatggggactcctgccctacctctagttctagaagagggataggggaaacaaatggataggcaatcacagtgtcagcttcttactgcatctggagaggcaggatcttgcttccttcagctcccaagcctggaggtgagctctctttgcactgtgtgttgggtggggttgtttgtggggctctgttaaaagcgtttcagtggaagatccctgagtttgcagacatcgcctggacccccacgagagagcgttg

SEQ ID NO: 164015 - DNA, 362 bp, Homo sapiens
cccttaatgaatatatatttgctttggctcctctgctctattttacatcaattcttgtgattttccaagtcataaaatgccccagatgcctttcactaaggcattttcacctggataaaaagatgtaaacagattagaccatttctaggtgagttatccaggaaacaggggtgatacaagtggattatctattttccgatctggaaaagtaggagtgatatagaagagaatcaatagttctctacaatgaaatcttagccttggagaagtgtttggtgaggggggtgaagatgggggaagtggcattgcgagagatgcagttactcactgatgccttgcatggtatcacatgatgtcacatg

SEQ ID NO: 164016 - DNA, 124 bp, Homo sapiens
ttaaagtaattagattcatccatggctttgacttttttaatttaaaatcactgattaaaagtataataaactcaatcacatagttcttttgtttaaagaatggccttggaccagaaaaaaagaa

SEQ ID NO: 164017 - DNA, 723 bp, Homo sapiens
gtgctacggctccgaatcgtaatcatgaccatacctggatccatgggtcaaatagtaatagcgcaaggaagactgaggataggagaaagaatatctctacctgtgaaacattgttagactgcctggctaggagttcattgttgttttctgaaggacgtaaccaaccactccaaaacttacaggcttaaaacaacaaacatgtatcatttcttatgattctgtgggttggctgggtggttcttctggctgaggcaggatggtctaggatagctacatccacatgtctggggtcccagctgagatgactggggctgttgaggcctttctccctgtggtgtcatcctccagaaggctgcccagatttgtccatatggtagcaggagtttcctcgaagcaagagagggcaagatccaacacagaagcacttttcaagctctgtttccatcacatttgccaatgtctcactgatgaacacaagttccatggccaagtccagttttaagaaatggagaaatagggcttggctcagtggctcatgtctgtaatcccagcactttgggaggccaaggcatgcggatcatttgaggtcaggagttccagaccagcctggccaacatggtgaaaacccatctctactaaaaatacaaaaattagctgggtgtggtggcgggcatctgtaatcccagctatttgggaggctgaagcacaagaattgcttgaacc

SEQ ID NO: 164018 - DNA, 247 bp, Homo sapiens
aggaaagtgtgcagtgtcttgccagatcagactcatggatagatttacactgaaaataaagactaagagaaaaaaaaagcggaacaagtagaatgtaaaagccctctcatcttactgtaattttttggtgtgctcacacgattaaacccttaggaagccaatttgatatcattagctcagaccattacctattttttccaaattggtctcttttttcccacacgttcatgggttaccgagcctcgaa

SEQ ID NO: 164019 - DNA, 558 bp, Homo sapiens
atcgcggtatcataagttaaaggaatgcagaaatacaggaccaagaccctatttttggggaacactgaaaccaaataatatcaaatttgtgaaaatgttgggcacctctctctaagtctaaaatcttaggtgctgtatagtatataaaaataccagtgtcagaattcatgatgtagacaataatttcttttctaggctatagacagccaagatgaatgtgagcttctaaggttttttagagaagcaagcctaggtttcagatggagagacagtgtaactggagtaaggctttggggttaataatgatgcggcttcataacaataaaaacctccttgtgtggaatagggtctcatatcataggtgagataatattggatagttggagaaggggaaagttgtgactggataatcatgaatgtaagtttgctttggggtgaaagcataagtcttttggtagctcagtaaacctctacagagagtgtccagagcaaatttattttttatatattttgggtaataagaataggattactgaggaagaagccattagcagtagg

SEQ ID NO: 164020 - DNA, 136 bp, Homo sapiens
acctcccaacaggctgggattataggcccgaccttggcatgttcttaataaatgttgattgttactactgctgttgttctgattgagcccacagtttatttaataaatcctctgttgtgggcatgtattgtgtcta

SEQ ID NO: 164021 - DNA, 587 bp, Homo sapiens
gcagtcgcgttccaaaactatgaccaagcatctctaatattgggtcactggggatcagtgacaccacttcgtcgtgtacgtcctatttcattcactggcttggtcttgtacagcttcccatataacctaggcagcattccttggtactctgtccctctatagatctctctctctccctccctctctctctctctcctgacaacctcatactctctcaaaacttcagttacattcaacatgataattagcatcttttatgcttatatgctgctttaaaatttacaaagcattttttcatatattgtctcacttaattgtcataacaaccctgcaagtgagtagagcaggcattcactaatatgacccttgtcttacagatgaggaatcaagatcagagagttcagaagttcaaggtctcataactagaaagtgtcagaaccagaataagggccgggcatggtggctcatcctagcactttgggaggctgaggcaggaggattgcttgagctcaagagttcgagaccaatctgagcaacataggaagaccttgtctctacagaatattaaaaaattagccgggcatggt

SEQ ID NO: 164022 - DNA, 164 bp, Homo sapiens
accgcgcctggcctggaggggttttttatttccttattttggatgttaatctattgtcactgtgcactgctcccagtctaaggcttatctttttactttgtgtcttgtgtcttacaaaggatccctttgggatccctagggatactacaaagtatccaagtttt

SEQ ID NO: 164023 - DNA, 153 bp, Homo sapiens
agctgagatggcaccactacactccaggctgggtgacagagcaagactctgaaaacaaaaacaaaaacaactgaggatgacaagcaggtgccctagagattacagggcttatgggcagagggatgggaaaacaagctgcaggaagcctctctg

SEQ ID NO: 164024 - DNA, 396 bp, Homo sapiens
aaataagttctccctgggcatttaaactgaaggttccatagatgtcagacttctagggtcatgggcttgccgcttgtagaaaaaacaaaatgcaaacctgtttatttcaatctgtctgacaaaaaaagggaaatttctgaaaattcactatctgccctccaaggtagccaacaaagaagcaagtgagccaggtaccagcaaagacagaaattgagtgcaaggtagtgggcacacatgaacaggcaccaagagcagcaaggcacaaataggaaacgccaagtgctgggcctactctggcctctgatttcagccctgcagtagccattacctgttagcagtggcacggtaaagcactagatggaaatgctggtggatgaggaagagtccaggagggca

SEQ ID NO: 164025 - DNA, 239 bp, Homo sapiens
tccaccctagactgactcaatatcactatctccatttagaaatatcacaggcatcttaaaatgagtatattcaaaacaaaactcctgatgtgtgcctctattcccaaatctccatcatagtaaatgtcaaccatccagaaagccaaaaagctgagaatcattcttgatttccccccatttcacacccaacccatcagttaaatcccaccaattaggccaggcatggtggctcacacttg

SEQ ID NO: 164026 - DNA, 504 bp, Homo sapiens
tcagagtcagaagtctgggtggaaggtcagcgccccatctcagggggctgcccccaacaaggagtgatttatggtactgaggagccgcgcccgggagagcctggcccgcccctccacaccgcctggcctcagctccggcagtggccccgcgccgctggtctcgtccccagacagggcagtggacatggacttcgcaacggggcgaggtcgcggggtttgcccttgaattcccttgtacacacccacatgctctgccttcctcagggcgctgctccccgggggccggcggtcctccctgtggaggagtcatctcccagtccccgtggaaaagcaggctcggctggagggacgggattcctcggccctggtgcgctcatctgcaggcccagcctggcatagggtgagcccttcctccttggctgtcgatgccccgcaggcccagacacctcagccatctccttccacgcatatttcttgtgttttgttttttgaaattgtggtaaa

SEQ ID NO: 164027 - DNA, 251 bp, Homo sapiens
tcagctgtgccgacatcacacaaacctaggatgtgaagcatccctctcctcgctaatgtctatttgatacaaaagttttcatatccattcccctgcattccatgagtaaaaaacacatttattctgagatttgccatcccctgagagggctcctgggcatcgcgtcagcaaaaaggcagttgtatgtgctaactccaggccaaaatgtggaggagtgtcacttatacgcagggggtaggtatgatgaagga

SEQ ID NO: 164028 - DNA, 272 bp, Homo sapiens
ttaaaccttactgcatctaaagtttaataaatcaaatcggggtgttcaaaagacactgtcatctagaaaacaggctacattaatgggtatgtgtatataaacttcaagtcatttataagaatctttaagcaattcatcatgtttctgtctttttactcattacataaaatgagtatcttatctcctgtgcatctgaagtgataccggctacgtactatccttgggagaactgaagaggttcactcagttttctgtagaggttatctgtggaa

SEQ ID NO: 164029 - DNA, 412 bp, Homo sapiens
agagaatgacctattgcagctcaagagatgaattaatcagaatgagcaggtgaagtcagcatctgtgtgaaagaggtgtctggaaagggggtgggtttagagaggcccgttttagttctcaagcacaaggagcttttccctgagctaggatctgctcacatgctgagcctgaagtccacaggtatttctacccctcttctctcatggctggcaggcttctcattcttgaggccttggcttaaatgtgacctctgcagacctacactatctaagataggctccacctgccactctgtctcacagcactccgattgttttcttcatagcttttcgatgtttataaggattgactgtttattcttttttttttttttttttgaaacagagtcttgctctgttgccaggctggagt

SEQ ID NO: 164030 - DNA, 969 bp, Homo sapiens
cctctcaaataacattcaaaaccctttcttgaaaatggtctatcttgagagttgcagcagtagggaactcattaaatatgaacaggtaattttaatgcctaatggtttttaaaaaactgaagaaagttcatctcaacatagctgggaaagaaactctttaatgttcttttagaaatttactgacaaataaatggggagaagctttttcaaaaaaagataaaaaataatcagtacagaaagatgcactttagtgtagccatgaaagaaatttattcaatgaagaaaactattatacaactaagattgtggttgaaattcagtcacttgttggaaattgcgcaatggagacttaagatttagtgggacaaagtatatgcataacacacacgcacacacacacacagtgaatatatttggaataaaaaatttggattattgacaggtgtggtggctcacgcctgtaatccgagcactttgggaggccgaggcaggtggatcacttgaggtcaggagtttgagaccagcctggccaacatggtaaaactccatctctactaaaagacacaaaaattagccgagcatggtggcacacgcctgttaattctggctactcaggaggctgaggcaggagggagaatcgcctgaacccgggaggcgagggttgcattgaggcgagattgtcactgcactctagcctaagtgacagagcgagactctgtctaaaacaaaacaaaacaaaaatttggattatcaaggaaattgataagggaaatggaaaagattcttaaatcaccttcagaaagcttttatcaactgaccaaatagttttggttctgtgataagcaactccaaagaaaattacatactacgctttagctcatccaaatgtctgatatcaaagttatccttgctgaaagttctggagtaaatgtcaatggatataaaacatctaccatttccagcttccaa

SEQ ID NO: 164031 - DNA, 122 bp, Homo sapiens
accaatatcttacatatgtgactaattctataaatgcaacccattgtgtgttcactttggaaaggctgatgataggataccagtctcttcagcccttatcgcacaggcgcccacgtatgcac

SEQ ID NO: 164032 - DNA, 248 bp, Homo sapiens
gagatggagtctcactctgtcgcccaggctggagtgtagtggtgtgatctcggctcgctgcaagctctgcctcccgggttcacgccattctcctgcctcagccccccgagtagctgggactacagcttagctgacatatagtttcctgtgcaaaagtattattttaataaaaatattctcattctggaattctacaagaacgtgacaaacttgtgaacatatgtataaaatttagtaaaatgtggtca

SEQ ID NO: 164033 - DNA, 307 bp, Homo sapiens
cagatgttaccattttagaaaaatctcagaagaaaggccaaaatctctcttgaggggtatattctcaatccaggtcacataggtttctcacagacaaaaccgtaagacacatgaagctgtcaggtaagcaagaaccactggacacaactaatagcaggattagattttcaacaacttcagttaagatatgtgatagtctacaaaattaaaagttatttaagacatagaagaaggaataagaatataaaagcgtgagccactgcaaccggacatataacaagataccagattaggcgtaaaatgccaa

SEQ ID NO: 164034 - DNA, 511 bp, Homo sapiens
ctttcttttcggagactctcatctcacccaacgagaaacacccacaggtgtgaggggcaggccaccccttcatcagaaccatttttcttggttaataattttcaaaaatcaaattggtttctaccattttaaaaagggaatttgacataatatccccaaattctagtttatcctaaaaaaattcaaagatctggcagctccaggtccatatttattctggcagacagttaggtaaagcaattcactctccaggtgctcacaacctcacccagccccgccgctcgttacagtactcacctagcgcaggagaaggttgagtttgacaacttgtactgcagcaacaatatctaagctggaactgtgcttcccagaattctttctgctttatgtttccaggccaaggttggccacaaaagaaacctgtagtgaactggaaggcagaagtgaaggcacatccagtaggctcagaagggctgggcgatgttgaagcacctgctcggtgttgctgatt

SEQ ID NO: 164035 - DNA, 645 bp, Homo sapiens
tgtttggcagctgctcgttgagaaccttgaaagtcgaggctcccagtcagaattttaggtacctgcctgttgacctctggctctaggatgtgtgttttagaaacctgtatctagtgtgcgtgcgtgtgtgctcactggagcgagtactaggaggttgtagggaggaataccaggtattacagaagggatcacttagagcttggtgagtgggtggataagtaggtgcctgagagaggtcaggagtaggaggaaggaagcctggttaatgattgtgtattttaagataacctacatacttggccatacatagttcctagtctctctggccccagagagaggttctccacacctgagcctcatgacactaacccagccagctgagcttcagccaagggtttgtttggtgcttgactgagagagaatgtaaatgggacctgagaaatagacctttaccaaattccatttagtggtattttgctttctgaatatttaaatgaaactttaggttatagcataagtaaatttttttttttttcgagactgagtctctgtcactcaggctggagtgcagtggcatgatctccgctcgctgcaacctccacctcacgggtttaagcgattctcatgcctcagcctcctgagtag

SEQ ID NO: 164036 - DNA, 264 bp, Homo sapiens
ccggctttcctgacagtgcatgccatgaacgttgttgtgtctctggctgcgtgcacacacgtttctcaaggggaagtcaacaggcggctcctgggtcagcaggaacgcacatcttcgcctttgccagaaaacgccaggctgctctccagactgtgctgctgcctggtgccgcagcaggagatgaggacccccgcccgtcccatgcaaggatccgaatccgacctggccatctttaccacgctgtggggcacagaattggatctg

SEQ ID NO: 164037 - DNA, 476 bp, Homo sapiens
tgagagccagcaagatgctttgttgcaaggcatggtggaactggtgaagattgggaaggaaaagcttgctcatggccacttaaaacaaaccaaaagtaaagtggcgttacaggctcaaatagaaaatcacaaggtttttttccagaagcttgttgctgacatgttgttgatccaagcatactctgccaaaatacttccttctttattgcaaaacagagagacattttgggcagaacaagtaacagaagttaaaatactagaagaaaagtcacgccaatgtggtatgaagctgcagagtttgttgcagaaatgggaagaatttgatgaaaactatgcatctcttgaaaaggacctggaaattcttatatctacattgccctctgtgagtttggtggaagaaacagaggaaagattagtggaaaggatttcattttaccagcaaataaaaagaaacattggtggaaaacacgcccggc

SEQ ID NO: 164038 - DNA, 229 bp, Homo sapiens
ttcttcagggtgcctttctgcatgttgatccccttgtacctccatattatgtcctgccctgaatctaccatctctatccccaaggcactggctcccagatgcccccaaatgttctgtgcccatgctgctgaaccccctggtatccagtcccccaagtccctgtctgaggccaggccatgacgacagacaaacttatccctcattctctcatctatcccccccaaccccc

SEQ ID NO: 164039 - DNA, 397 bp, Homo sapiens
gggagagcttgtgtcatttatcaacactggaggtagagtgggctactgttagtgtggtacgttacgtggagaggttttctttcaagagtgcccccacccccaacaaaagggaacagtttattggcatatggactttgtaggaacagggggaatgggattctattccacaagtaactgcagtgacatgcactttgatgatatgaaagagcccattttctaggctcatgtttctgaaaaggagctaaaagaagaggagagggagtttaagaatgtgatcatttccttcctgtctgtgtgattttgtttgaggttagtgaggagaagtgagtcaggcaccaggttccctcaagaaatgcttgagattcaagtaatttggggacaatagattgtcaagggc

SEQ ID NO: 164040 - DNA, 461 bp, Homo sapiens
atataggagttaggcaaactcagatgagaccattaaaaaaagaatattcaaaataggtatcaaagtggggaggggaataagctcagagtatttttctctaacccttttctgaacagtttaactctgaaacacagccactgttcagcaaaactataagacaaacaaactgatatgaatttggtgcccttctacctctttttgtgcctccctcctttctcctcttccattgtaattcatactcccatggtgtgtagcactgcctttcattgcattctgtagatttgggcagcacccagggcatcaaaatgacacttcctacctcccctcacatcaaaatcctatttctgtagtactgcgctctgaggcattagctctggaataaagtaattcctcgctaacttgctaatgattagtgatgactctatatgggcctctacagagagcaactctgtaggaactgt

SEQ ID NO: 164041 - DNA, 530 bp, Homo sapiens
aagagaagtactgcctggaagaagacaaagacagctcacagtattgagaaggatgaagagcctggcctcagaagggacagaatgggacaggtagagaggtgtgttagcagaagggccaccactggggtgtatctggcccacactgtacatgttaagattccctgaagataggctgatgggcccagtgaggtcacaggcccactggaaagtggaataattccccaaaagaaatctaggtattgccgccaaagaggcagtgaaggtataggcagaaaagacgatgatgctcactgataggacagcacccagccctctctgacattctctggagcagctcaacccaccctccagattgggttaactgagactggggaaggaacactgttcagtgctgccatcccccacagaaggcagaggtggtccatgggggccctacctgcccatccagaacaatcttttgagagctgtgttcaaatggccatctaatcaatttcttttttttctttttctttttttcctttttttttttt

SEQ ID NO: 164042 - DNA, 269 bp, Homo sapiens
ctcttttcctcttccaaatgattaaactggtaaaatttttgtattagaggaattaaggtgagaggtgctgagcaaaatatgaatcttccaaggtttattcttgtaccttgttagggatatgcgtgggtgtttgtgtgattgtgagagaaacagaatgtgtgtatgtgtcactgattttttaaaagtatagatgttgctttattatttgccttaaatatatagcaaaatcaacctgtagacaatgcacctgaagagaaaatgtaactgtg

SEQ ID NO: 164043 - DNA, 678 bp, Homo sapiens
ccccaggtgaggtaacaagagtcagggtctggctgaaatctcctctccccgttcgcactcctgggctgagtgccactcggcaaggcgtgagccattttgcatgatgaagtccacattacagatttcttctgacacctgatgactaacaaggtctgaaaacaacaagacacctctaggcgctgcatcctcctcctcctcttcagtgtttatggaacacctcctaggtattgggtgggtgttttgtgccaaggatgcaagcaaaacattagagacaaaaggaggaatagaatatgccaaaggccaaggagggtatgaactagtggttcccagagtttgagcttttatgagcagctaaaagtgagagctttattaactaggatcagacattgataattaggtcaaaggataaaagaggttcagcctaacagtggcctaaacaagacagaaaataaaagtttatctctatcatgagagtccacagtccagagtctcactgagtaagggaaaggtgagggtgagcgctttgctgcccttcctgtgatattctcaaaggaaagacgggggagaaagaggagactcacacaatccattctccaccccgcagctgcagcctgcgtactctttgaaatatgtcattcagatcgttatcctgcttctcatcttcctgtggctttccat

SEQ ID NO: 164044 - DNA, 187 bp, Homo sapiens
gttaacacggaagcaaaaatgagccacgagccatggaaacacacagcaccaactcccccctcgaattccactcagaatcaaacacatgcttgacttaaattacatatgttgctgggttgagaagcaggagaaaataaattcatttatgactagcactaaaaaggaaaaccttctagtcactgcttca

SEQ ID NO: 164045 - DNA, 156 bp, Homo sapiens
ttcatagttgagaaagatgaggcagagacggtagtgaccggcttgagcctagactgcgccaagcttgccagagcagagccgggtggaaactgtcttcctgcaaagccaggttttccttcacggcccctcctaatgatgtttcttttcctatcattg

SEQ ID NO: 164046 - DNA, 631 bp, Homo sapiens
ctatgttacaggagtttgtaaacttataagaaggaaaagacaagtagatgactgactatcacagatgctgaatttgattcacttggaagaaaagaccaaagcaaaatgatactgaagtgaggagagaagcatcttcttaggaggagaaatggtttccttgggaggagtcttgaagagctcttcataaggactttgaaggatggacagaactttaattggtgacataaagggagaatattctaggaggtgggaagaccaggagcaaaagcccagaggaggtaaagcagaaataaattcaagcaaacctgcttagagagaggaagcaggaaacagaactggagctgtaagttggggcaatagaggagggcctctgtgtgccaagtcaaggcagtttacttaatttgtgagattctgtcactgtggttggttttgaaaagataaggtacagctgcattttaggaagttccacctgccaatggtgtttgggatgaatggaaaagtagaagactggctgggcacggtggctcatgcctgcaatcctagcacttcgggaggctgaggtgggcagatcacttgaggtcaggagtttgggaccagcctgatcaatatggtgaaaccttgtctctactaa

SEQ ID NO: 164047 - DNA, 163 bp, Homo sapiens
tgctgatctatgattttaggacccagataataatattgccaaccccaatccccggtcgaccaagtccaggttctgtggacatgcctggatctgtggaagttagggctctcacacaccacagcccgcacatccctgcgagattgctcgcctacatgtctcaggc

SEQ ID NO: 164048 - DNA, 252 bp, Homo sapiens
gctttgtccttgataaggtttgtctgtctctagaaaatgacaataaaatttcccttcatttaccagaggttagaatggggttatactctcacctcagcaaaggggcatgggattgcaataacttgtttaggttggttatggttcatccctttgagactggagaaagggcctgccttctctaagacaaaaggatacctgccttttaaacttctaagtaggggcagtgattgctttgaaggcaataaagtgtgc

SEQ ID NO: 164049 - DNA, 1048 bp, Homo sapiens
ttttaggggtgggaagaggagatcttgctgagaactgaggatgctggagtcagggaagcagagaaggttggcgggggtgacagataatgcctggcacaatgataccttgggatttgagatgatcaagctgagatccagctccctcttgtgtgtggactcctgcgagagcagagcaactgcccccacccctgcccccacctgtctgccttgctccttggacctgtgtctaagaccagaggcatctcacccagcccagtttcagaaggaggatgctaatacatctcatggtcatcttttccatcctttcttattatctaacttccctccttcagtttgtaacataaaaccttttttctctctacttttgaaaattttaaaggggaatccttttcatttggatggggtcgggggatggggataaggggggagaaaagcataattttattttcactcaccctaactgaaatttagtgttttctgtgattatgaatgttggcaacaattcatgatagtattagcaaaaagtttcctactacactacagttatttctggtaccttgaaaatctattggccgggcacggtggctcatgcctgtaattccagcactttgggaggccgagatgggaggatcaactgaggtcaggagttggagaccgttctggctaacatggtgaaatcccgtttctgttaaaaatacaaaaaattagccgggcatagtgatgcacgcttgtaagcatctcaaaaaaaaaggaaataattcatctgtattttggcattaagctaataattagatttaccactagatcttactatttaatgtattaataaagaatgacatattactaatattgcacacttggttttaaattttgataactttcaatataatttcttatgtatttattttatgaatttataagtattcttggccagactaatgcctgtaattccagcaatttgagaggctgaggcagatggatcactcgaggccaggagtttgagaccagcttgggcaatatggcaaaactctgtctctaccaaaaaaaa

SEQ ID NO: 164050 - DNA, 1238 bp, Homo sapiens
ttttaggggtgggaagaggagatcttgctgagaactgaggatgctggagtcagggaagcagagaaggttggcgggggtgacagataatgcctggcacaatgataccttgggatttgagatgatcaagctgagatccagctccctcttgtgtgtggactcctgcgagagcagagcaactgcccccacccctgcccccacctgtctgccttgctccttggacctgtgtctaagaccagaggcatctcacccagcccagtttcagaaggaggatgctaatacatctcatggtcatcttttccatcctttcttattatctaacttccctccttcagtttgtaacataaaaccttttttctctctacttttgaaaattttaaaggggaatccttttcatttggatggggtcgggggatggggataaggggggagaaaagcataattttattttcactcaccctaactgaaatttagtgttttctgtgattatgaatgttggcaacaattcatgatagtattagcaaaaagtttcctactacactacagttatttctggtaccttgaaaatctattggccgggcacggtggctcatgcctgtaattccagcactttgggaggccgagatgggaggatcaactgaggtcaggagttggagaccgttctggctaacatggtgaaatcccgtttctgttaaaaatacaaaaaattagccgggcatagtgatgcacgcttgtaagcatctcaaaaaaaaaggaaataattcatctgtattttggcattaagctaataattagatttaccactagatcttactatttaatgtattaataaagaatgacatattactaatattgcaaaaaaaaaaaaaaaaaaaaaaaaaaaaaaaaaaaaaaaaaaaaaaaaaaaaaaaaaaaaaaaaaaaaaaaaaaaagagagagagagagcgcgcgcgcgcgggagcaaaaaagaaaaaataaaaaaaaacaacgggggggggggggggacacgcacgtgaggagcaagaacgggaacagaagggggagcggcgggaagagcggggaacagaaagagggggagcacccaaaaaaaaaaggggggggaagaaacgagagtgaaaacacaacacaagagagagagagcaggagcaaagggggagcagaaaaagagggaggcaaggaggagagaaagaaaaataacgcccggaggagggagaagaaggaaaaaaagcaacggggggggc

SEQ ID NO: 164051 - DNA, 142 bp, Homo sapiens
tttcaggggagcttgcagggtaactttttattctttttttctgaaccattgcaggcttctgaaccattgcaggcatccctatgtgcacggcctgctgtttccactcccactgtgcacagaggcaaagatgtctcgtttgagg

SEQ ID NO: 164052 - DNA, 192 bp, Homo sapiens
gagacttatagaggatccccggcccgtgcacagtttgcaatctcttggtatctccaacagatagaataagaatccatggctatttaaatgccctcagtcctgcctctagttcccttacatattccaggaatatgcatcccagcaatacaaattgctggaagtcacctccagcaatttctagtccaaaccact

SEQ ID NO: 164053 - DNA, 117 bp, Homo sapiens
aaactgaagtttagcatcaacttctagacttatagttttctggtgagcataacaattccttttattatcttaaaagaaaacattagagcaccaagaggaaataccaaagcatcttag

SEQ ID NO: 164054 - DNA, 489 bp, Homo sapiens
tggacttctgatgagatctgttttcacagagtaccacagtaccagacctgtagcagtgaggtttctttactcttccagtaaagggtgcactcctgtgagtgacttctgtagctaattgcttcctgggtgctttaccactgggccaatttgctggtaatctgccttgtactagtcatgatctagaggcccccttacttatcccccttctcagcagacattagagatgagggcgccactgtggcaggcagtgcctgagaacacttaaaagcagtgctttcttactatcttacccaactcttacagctttgagtggaaatgcaggtacaattaatactcttccattataaccacaaatttaaataacaggaaagaattaagtagaagaacaggtcccttgaccagttggtcatacttttgtctaatagtgtttttagtcttgttattgggggttgttaattctagttatcaatgttttatttactcaaattg

SEQ ID NO: 164055 - DNA, 851 bp, Homo sapiens
cccccgcaacccgaggtcctagcccgcccggggactcggctgactcacggacacgccccgcgagacaaacaacaaacgcgcggaggccgagcgcggagtcccgcacggccgcgcccctgtgcacctggcccccgcccccgagacgtcccattggccggcgccctagcctggtcccgcccaagtggaccccgcccccgccccgaggcaccccattggccggcgtccccgccccagcgaacccggccccgcccccgaggcgccccattggccccgccgcgcgaaggcagagccgcggacgcccgggagcgacgagcgcgcagcgaaccgggtgccgggtcatgcgccgccgcctgtggctgggcctggcctggctgctgctggcgcgggcgccggacgccgcgggaaccccgagcgcgtcgcggggaccgcgcagctacccgcacctggagggcgacgtgcgctggcggcgcctcttctcctccactcacttcttcctgcgcgtggatcccggcggccgcgtgcagggcacccgctggcgccacggccaggacagcatcctggagatccgctctgtacacgtgggcgtcgtggtcatcaaagcagtgtcctcaggcttctacgtggccatgaaccgccggggccgcctctacgggtcgcgactctacaccgtggactgcaggttccgggagcgcatcgaagagaacggccacaacacctacgcctcacagcgctggcgccgccgcggccagcccatgttcctggcgctggacaggaggggggggccccggccaggcggccggacgcggcggtaccacctgtccgcccacttcctgcccgtcctggtctcctga

SEQ ID NO: 164056 - DNA, 1114 bp, Homo sapiens
cccccgcaacccgaggtcctagcccgcccggggactcggctgactcacggacacgccccgcgagacaaacaacaaacgcgcggaggccgagcgcggagtcccgcacggccgcgcccctgtgcacctggcccccgcccccgagacgtcccattggccggcgccctagcctggtcccgcccaagtggaccccgcccccgccccgaggcaccccattggccggcgtccccgccccagcgaacccggccccgcccccgaggcgccccattggccccgccgcgcgaaggcagagccgcggacgcccgggagcgacgagcgcgcagcgaaccgggtgccgggtcatgcgccgccgcctgtggctgggcctggcctggctgctgctggcgcgggcgccggacgccgcgggaaccccgagcgcgtcgcggggaccgcgcagctacccgcacctggagggcgacgtgcgctggcggcgcctcttctcctccactcacttcttcctgcgcgtggatcccggcggccgcgtgcagggcacccgctggcgccacggccaggacagtgagtgcggggcggcgggggcctggggtggggaggcggcgggtgacggcaacgcggccgccgtcttcacggtgacctgcgcccgcgggggagtcccggaggctcctctgtgcagcctcggcctcagtttccgtggtctgtgagatgggtgcagcctgcctggtgggagggttgcactgttaaagcgaaggctgcagcggcggacccggctcaggggcagagaagcgtccgtgtggtacaaccctgtgggtggggccacccatctgcaggtgggaaactgaggctccagaggggctggggcaggcccagctgcatggcggaagcggcggggggctgacctccggactcctgacatcacagaatccagtcagggctgcctgagtcggggccccctctgcttcttcccagacaccccatctggcaggtgaggacaaggaggcacacagaagggatgggacctgcccagggtcacactgacaggggtggcggagctgggtccccacagggcccaggacgtcacggagcgggcgtctctgtccccagggtctgccgagcacactga

SEQ ID NO: 164057 - DNA, 287 bp, Homo sapiens
gagacaaggaagagtaattaaaggacaagggagacaaaaatcagattcttgtggactaggatgaactggttgggaattttctttttttctgtttttgtttttcagatggaaagttgctctgtcgcccaggctggagtgcaatggcacgatctggctcactgcaacctcagcttcccgggttcaagtgattctcctgcctcagcctcgtgagtagctgggattacaggagcatgccaccatgactgtctaatttttgtatttttagttgagacgggggtttcaccatg

SEQ ID NO: 164058 - DNA, 333 bp, Homo sapiens
gcttagcggctgaagactgatgctgcccgatcgcctcggaagccccgtaggccatcacggacgccgagctttgggtaactctcagagtggaaggtaagtccgtccccttcttaatcaatatggaggctacccactccacattaccttcttttcaagggcctgtttcccttgcctccataactgttgtgggtattgacagccaggcttctaaacctcttaaaactccccaactctggtgccaacttagacaacactcttttaagcactcttttttagttatctccacctgcccacttcccttattaggccgagatattttaaccaaattatctg

SEQ ID NO: 164059 - DNA, 390 bp, Homo sapiens
cttgcctcctcctattctcaactatgtcctgaacattttctaaatgcaacataaatatctcaaactcaacatgctcaaaaaccaatctatccctctgtgtatcagttaatactatcagcatctacttagtcacttgagcttttaaaaactttagttgttttcatttcaaaaatgatgatgcagggcattaggccttgtattgagcacaaaaagagaataaaagacaagacaggtccgtggcctcaagaaccctccatctagaagaagaatctagcaagcaagaaaagcacaactgagtgtgctaaggaacaaggggctgactgtctaaaaacactagcaatgggattcacaacagaagggaaatgggggctggatctcggaaacaagtaa

SEQ ID NO: 164060 - DNA, 210 bp, Homo sapiens
ggagcccagtgctaatagctaagacaatgtttaaaaggccttgaagccatttcagagacctttgcagcagagcttgctgtcagagtccccgagttctaggacccaagaatgctttcctgggtcagtcccatgggcgcgctgctgtatccgtcctcaggacactgctgcctgcatccctgcagctccagctccagctccagctccagccat

SEQ ID NO: 164061 - DNA, 417 bp, Homo sapiens
gtaaagtagcatgtgtcatcatacaatagaaaagataaaaaagtgtagtgccaggaaggctgaaatacaagcatgaatattttcaagtgctttaagaccactgttcttaatccatctaacagacgtgaagtcaatttttagtccacttcttgatccttaggctaatgaatgacaagaatgttgcagagtggcgtcagctgctgagaagacagaaaactacttgttaaccagtgtaagaaattcccactcagacctggaataatactgtcttcttcctaggtttaaaattttttcccagtgaccttcaatcaggcaagaaatagtttcagattagaactacacagaattgatgaagtaaacccgtattacaagatagaaagttaccccgtgtacctgatgatgttcattgtctatttg

SEQ ID NO: 164062 - DNA, 492 bp, Homo sapiens
taaaagccacagggttgaaagcaaaccagccttaaaaaggcccaccgtttcgccacctacctggatcaggtgtatgcaatacacttgagctttgtcagctaacccaattatgcccaatcttttaggccaacccttaacaaatttaataccttctattaccagcccaagagcacggtcatgatacagaaacacttttctgcaaactgttagtaaatctctactacaccttacaacagtccacattttaactactaataaagcactgaagttgggtgaggatctgatggaacaagtggatcttctagtcggctcctattccactttaaggcctaaggttggcagttaatgcccagtcaaatcagattaggtaatacgtgaagaaattgttcacaatgcaaaaaagagaaatcctgaataaacattcagagaagtgtcccctaaaaagtaaggatcattcaactatgaaatgagttaacatgggaaaccaagatt

SEQ ID NO: 164063 - DNA, 257 bp, Homo sapiens
  misc_feature (50)..(50): n is a, c, g, or t
  misc_feature (54)..(54): n is a, c, g, or t
cctggcggagccataagataccaacttgaccagagaggaaacctgaacgnctcncagaagactcaaaaaatccaaacaagatgaaatgtttacgtttccctgcctccttcctctttgccagattgcacttcttactggtctcgtctgtctgctgctcctaacatggggagagggcaggcccagctcatggaccactcctaatctaccaagggttgagaaagggcacgaccaagctgtcagcactgtctacaaaagag

SEQ ID NO: 164064 - DNA, 552 bp, Homo sapiens
agaatataagttcatttacagatgtgtatggtagtaggtatctctggaacatccaagaaaagaggttgtgtaggaagttgagttgtagcaattgcacatacaggacttgctttagaagaaaggagtaagtttgaaataaaaatctataactggcatatagatggctctggaaacatgagcatgtttgagatttctcaaggaaagcatgcagagtgaggggaaaagaaaaagccaagagcaaccccggagaattgctaacatttatgattagaaaggaattcatcaaaaaagactgaagaaaattatcacagtggcaaaaaagggggaagagagtaagaggaatcccatcgtgtcaaatgttcccaagaggttatacaagataagaaaaaaaatatagcttctggatttacctacaaaattgtcattggtgagaaaagtttcagaaaaattaaggagaaagaatctagattgaattaagttgtgatgtaaatcaaaggtgaaaaattgaaaacagcaaatatagccaactttaaaaagattgatatctaaagg

SEQ ID NO: 164065 - DNA, 576 bp, Homo sapiens
ttggatacatatacctataaaaacgggccaagaatatgcattctgtgctgactgccttaaaatcggattctttgaagtgtagtttgtcgcttcacttattcagaaaattacacaattcttttaaggaactgcgtgccaccattaaaatcactagtgaaaggcagtgagtttgtgaatgattgactttcccagggcagtggtgcagtggaaggcactcgttacctgggcagagttagatggagcatatttcattagtcgttcaggctctgtgttctaatgtgtagattttgttttcactgtatgcgttgctggctttatttccagtttcttctctagttaaaatatggaggaagtcacaggacatccagtttgttcttgggtactatgggacaaaatatatgacagtaaactatcagctcatcttggcaagtacttttggtgtggaccactgaagcatatttgtaggaagggagttacattttggtgctcaggatgggagtgatgatagtttcaaagatttctattttggaagagggatctcaaatgccaagattactcatcggggaccgagtcgaa

SEQ ID NO: 164066 - DNA, 171 bp, Homo sapiens
cttgctgttttctttcccccttttcctgtgagctttcagctcatttctgcattcccttttattccttagatctttaaaactcattttacaacctaactggattgacttaaccacgtatgagaatttgttgtactttaattgtcctagtgaaaaacctattgtcttatataa

SEQ ID NO: 164067 - DNA, 187 bp, Homo sapiens
acactcaactacgtcagtaaaaagacagggtcaaggagcaataagtgatgcttggacaatcatgggagatacacaggagtcaggctgtctgctcagcgaaccactcattccaacatccagacagcggtcaaagatacacctgcagatgcccatcaggaaatgtgaatgagtgagctgaagaggcaat

SEQ ID NO: 164068 - DNA, 860 bp, Homo sapiens
taaccatttgccttttattttttagcttaatatgttcttgaatagctaaaaagttttccagtagtttttataagtgagtttaaagaagtgatagccatctgaagttttatcttgtgtagccagtatttaaaagttattaagattatctacacagaaaaaagatacaacttacttctggccatatatgtgaataaaagtttaacattgttaaaaattagcttgtcaagtaaacgtactgactgaggcataattttgttttcgttatccattccgttggctgaaaatgaaatagaaacgatctggttactaaagaccagtgctgcattggatcacttccttgagcttttgctatgatcgttaaaggcaaagttagacagctgctgtagattttgccagtggcctcacaaaataaattgtttaaccctattagtttcaaacactatcatttctactttgcagatatgctagctgtgttttatatgaatctatatgactatgatttgaatttctgatttacaggaaggtagtatagcagaaaatgagtaattttaacatgattatattttcatgtcttggaatataacaaatctcaacatttttgcttatattgggacagatttaaaaacttcagcttagactgtttaaagttagactttgttttttgtatctgaagacttttagaaaactgtgaaaattgagtttgacttataatccttgataattggatatttaaatgtcatttttaggcttgaagttcagaggaaatactaactcattgactttaaaatctcatcttggataagtgtagagttagaataataccatgtactcctggaattgatgtcataatgttaaaaatc

SEQ ID NO: 164069 - DNA, 302 bp, Homo sapiens
attttctccgtttttaaagaaaatgtcatcctggctcaggtgactctggggtcacgtgacttgggcccagactggccacctctcagccaagataccaccctgaaaagtactgccaagggttttgcctcagtcttttccctcccacctttttcgtccttcagcaaatctgcatcgagtactgccttcatgctgggcctgtgaagtgcagaagctgtaggggaatgaggccaatgggctcccctccggcggcagcactaagacccatgcatgagatcctccagccacagccttggctatgtgag

SEQ ID NO: 164070 - DNA, 687 bp, Homo sapiens
gacctctttggcttcaacctatttgggaacttttgggcttcgtgagtctggatgtccattttcctccctagatttggtaagttttcagccataatctaaatgtgctttctgccccctttctctctgtctttttgccttctggaacttttataatgtgtttattaagttacttagtggtgtaccataagtcccgtagtattacttcatttcactttttattctttttaatatttcttcctctaattgtataatttcatatgaccggtgttcaggtttgctgattctttcttttggttgattgagtctgttgttgaagccttctattgaattttttagttcagtcattgtatccttcagctctaggatttctgtttggttcttttttatgcttctcctttattgaactttttgttcatgtattgttttcctgatttttatttcattttctatctgggtttgtttatttgtttgtttgtttttgtagctcattgagcttaagatgattattttgaattctttgtcaagcagatcatggatcttcatcttgttatagtcagtttctgtaaccttatgggtttcctttggcatgttgtatttactaataatcccttgagtccttcattggtgtctgtccatttgaaggagcagttcccacttctgtactagacagagtgattcagtagatga

SEQ ID NO: 164071 - DNA, 343 bp, Homo sapiens
tggtcaaaacattcgggggtgatgagagcatggcttgaagggtgagctgggatgtgtacgaaaggtcttatatgacataactaggatttaaaattagtcatggaaggtttttaaacagggaggttgcccattcagatttattttagaaaaaagtatttctggtgacagcaaagacaatggattggataaaacaaaggaggataaagactagttaaaacactgctacaaaagacagacaaggggttgaacttcagctgtggcaatggggtaagagggaaggtatcatcagccttgagaaaactcaggagcaaaaccatcaggaatggtgattactggtgattaa

SEQ ID NO: 164072 - DNA, 448 bp, Homo sapiens
cttttttctacttcatatgtagtttttgtcttactgcctttgcatatcttttacaatgcctcattcagaaaagctgaagggtaggccaccattttttttcttggatgctcttaatagaataggacactggtaaagcttaaaaatgccttgttattaaacatcaaactacctcttttgactgaagattaaatatcattttggtatgtgctagctgctgaaaattatttgttttcaatgcaacatcaaaaataaattcatagtgaggtgaatagaatattgttctggaagagtggagaaactaccttaaaagctagttttgagcattggagttatattcagcacgctaaactgcattttgaaactacctagttaaggaaactttggatatttaaattcagattgttactgaattatttaattttctttacacatagttgtagatatatct

SEQ ID NO: 164073 - DNA, 508 bp, Homo sapiens
ggattacaggcgtgagccaccatgcccggccatatgtcacctgtttctaatcccaacaaaacctgtactcagaatgaattaaacaaacaaacaaacaaaaaaaaacccttacctttgaagaactaaaaaaggaattcaaattttattgaaactttttgtgtttatccttttagatcacactaaatcagatgagtacacaaatgccaaggaatggacttttacaagtagagatgatgtttcatgcaaacacttgagttaaaggtgttctagaaacttcccatgagcggattttgatcattcttggctctagtaccccaaaagcttagcataaaacttaattatatatcatactaccttctctctcactctctctctgtgtgaatgtatgattttccaccaaaatggctatttgtaacctgccatagtaaaaggtctgcttattcaagaccaggacaagactttccattgtcttgtttttctgcccataatcgccggtcacgagatgggg

SEQ ID NO: 164074 - DNA, 469 bp, Homo sapiens
caacaacaacaacaacaactcaatgtagaaagatctagatttttaaagacttaataaccaaatataatattggatcttgttggatcctgatttaaacaaaccaactttaaaagacattttcgaaacaagtagaaaaaactgaacatggattggttataagataaaaccaaggaaatattaattttgacaggtataacaccactgttgctatataaaaaaaaatttctctactttggtgaatctttcacataatctgacacagtaaagtaaaataaaaacgctctacaatccaagcaaaacacatctgaagtccacatctagcctacaggataccagtttgccacctctgcttagaacttgtcatcatattaaaaaactgctctacttctaagatctcaactctgaaatgtacatccctgattgtttataactctccaacttccttgctcctgctgcagtagcttgcttt

SEQ ID NO: 164075 - DNA, 544 bp, Homo sapiens
aaatgaactgatcattttcataacattaaaaaaaagattaatttaaatgggtgccggactcatttacaacaaatacatatgtaagatggcaggtttctgaacaaggcaattaagaagcacagagatggacacatgctgcgtggggctgtgagttgtgcgttcctaaaagcagcactgtatctaagtggaagcaaactttttccaagtgaatggtttcatgtagctcatgtcttttggggttctatcataacttgtggttcaaagattccctcacatagcaaatgaagtggaaaaagaaatattactactcttactaaagttgcacttcagagctttaaagagccggacttttctgtattagcaagagctgtaatcacatcaaattcaaaatgctgactttccttgcagaattcaacatgtagcaaagccagctggctaggaaggcgttctggtctgctgtctcctggaggacagttgttctgggtgccaggtaatccaatgggttcatgcactgtctgcagagcagcctggcaatcagggctgg

SEQ ID NO: 164076 - DNA, 618 bp, Homo sapiens
taatcaacggatatggatgtaagaactaaaggcaagcagaaagatttttttaagtatcccagaagcttgatttctggacatgacctttttatggttatgatgaagaacctggatgccaatatggtatatgaaaatgaagtctgcaaaacgagaggaaattgggaaggacaaaatccttgaataacaaaatcaggattaaaaagaatcttgacaagttggggagacagaagggatctaatatggtaaaattacacaggaagaaaaaggtaatacacttgtacaccaaaagaaaaagtatacaaacgtagattgagaagacataattaaaagttagcatttattttttaaaaattttaaatgattttagtaacctcattgagttgtgagaattacatggctgcccaaaaacgtaatgtcatcttacattacattaacttaagtataaattgttagcatgaagagaaagaagatacctctgacctcaaaactggccagatcatatttagagtacagatgaagtgctgagatttacacatttaagagaactacaaaaacataaaatgcactcaaaaaagaggaatcacgattgtagatttataatcatgccacatcaaggtt

SEQ ID NO: 164077 - DNA, 181 bp, Homo sapiens
gacttaaagctcaagggattataaggaattgaggggccagagtgggagaggaaaggtctggcaggagtggatggaaaggtggaggagatagagggttgaaagaggaagatccaaggattaaagggagctgaagggaacatggaagatggtagaaaagagagattgggggataggtgatgag

SEQ ID NO: 164078 - DNA, 247 bp, Homo sapiens
ccatttcagcctctcatagtgctgggattacagatgtgagccactgtgcctggctgaaattaagtttttattagcataattagcattagagaaacaagatactgaccaaagtgaccagtagaagttatttttttactgagttgactagtttaaaaaaatgacctttacaataatgtctggagtctgcattttgttaggtgccttataattagagaaaggtattgtcggggatagggaagttgggtgt

SEQ ID NO: 164079 - DNA, 352 bp, Homo sapiens
tggcggaactgggatattccatagacacggggatggcggaagtgggatatcccagacacaggggttggcagaagtgggatattccatagacacaggggatgacagaattgagatattccatagatacaggggatggcgaaagtgggatattccatagacacaggggatggcggaagtggaatattccatagacgcaggagatggcggaactgggatgccctatattacaaccctcttgctgggtgcacacgcgatctcagggtaacaatgctactgctaccactgccaggcacaactcctggactgtgctgcacgcaccgtcctccttcccctcagtgttttctcggctgca

SEQ ID NO: 164080 - DNA, 487 bp, Homo sapiens
agggtaagtgacttgtccaggcctgacaggctttaaaaacaaagacaacgatgacagagatgggggacgactgagttcttctctacccaacaatctgctttcacctgcagctggcctcattcattcattctccactcattcttatcaagagcccaccaccatgcaagttacatttttgtgctttgcagccctgaaagaagattctttcttcattagccagcctgggaagcttgtttgcttgcatcttcttaataagggctggcttgttaaaatgcagagggcactttctgcttctcttgccatctctgctatcagcctaatccaaaccacactgacaactggacagggctccatgacccaattaagagccaaggctacactctcaggggctgtcgccttcagggtgctgctcagagtcctgggatgtcctgctgcctgcccctggatgtagaatggccctgtacaggctgtgggtgcgcaccctggt

SEQ ID NO: 164081 - DNA, 252 bp, Homo sapiens
gagacactgctgtatatatttctttagagagtagatataaaccaggatacttcactgttgcccacaccattgcaatgaacttacattttgcaaggggaaatattttcttaaggaaaacacagtgtaaggataatttgtttttaaaaatatagttaagatcaaaaccaaccaaccttccctaaattatgttttaggaataacactagatctgcaagatatcactaaagtggaatgtcccccactttttctttt

SEQ ID NO: 164082 - DNA, 640 bp, Homo sapiens
gttattatcacagggtaatcagtcatactctgctgccattgaaggcagtaggggataggcttgcaggtcagtggtaagacacggaaggaagaaatccagacaggtaggtgctgctgtgggttttgtctcagagtaagcacaggagcaaggcatcctgagtagcacaggagcaaggcatcctgagtaaggctcaagtttcttagagaggagaaaacacgaaacaccaagaggatgaattttgccaacctccgcatttgtcccaaagccttccatttagttattagaaattgagaaagaactgctccctccataacttccactttagtagcttttacattctactttcaaacctttcattagtttgcattcatttgtttatacatttaactccccttctggacagtgagctctttgagggcagagatagagtcctgttggttcttgggactgtacagagtccagggaacaaagatgttagttaccatggaaacattaatcaagagaaaactggggggatatattaatatcagataagaatggcttcagaacaaggaatattaccaattcacaagaagatataacaatctgaaatgtatatgcacctaatgacagaacttcaaaatacatgaagcaaaaactg

SEQ ID NO: 164083 - DNA, 589 bp, Homo sapiens
gtcatcagtattcctcaacatattgttcaagcttcccatttcaattgtattgaccatctaaagacaaattcagtggtacaaatgttgcagatgttcagtaaatatatgatggcaatgaacagcacaaagcaagaatatgcaatgtcattttcagcagtactgtttacctgtcttccatttgaagaaatccttattttgtttaccacattttgtattgattttctgtcatgtggatttcagtattttaagaaaggtaaactgctactttccccacacttgccttagtgctttggtttctttcttttttttccttttttcttctaatctttcaaaaaaaggtaatgccttgatataagtttataatttctaacagaaaagcaaataattcttcagctgagagggttcttagtaatccaaacttctcatgtcgctaatgtggctcagagagataaaataactggttcccaatccagagttcttcctgcgacatgagtctatttctgctaagccaagatgactccctgttctacccataatccttcaaccatacaaagttatctgagcatacaaaaacaactacctccagcaa

SEQ ID NO: 164084 - DNA, 177 bp, Homo sapiens
tgggaaagacagcaagtgcctctgcatcgatcacaacctgagtctgttcacctgtaccagtgacaatattccctatggctcttagtgcaggagtcacaattggcaattcagaagctcctagaagcttcacaagttggggcacaactcctgtttccatgacaatgtcaattcattcat

SEQ ID NO: 164085 - DNA, 478 bp, Homo sapiens
tgaaattttaagcaggccaatctctgggtaatttttgggtactgtgaatgtagtgcctttcataaaactactaaaatctacactgaaagccaccatagtgataaaaataaaaaataagaatgaacaggggttggggatggtgactcacacctgtaatcctagcactttgggaggtcaatgtgggaggatcacttgagccctggagctcaagaccagcctgggtaacaagagcaaagctctatctggggaaagaaaaaaaaaaaaaccatctgtggaaactatgcttattggccccttatgtgaatgaactatggaaaaaatttccttttaattccagaaaattcacctcgtgcattgtaatttcacctcgtggcttgtaatttcacccttttatatgtttagacaaaccttctaaacattcgtgtatctggcaggtttcaggccctaggggtttaccttatttacattgcaatttccc

SEQ ID NO: 164086 - DNA, 140 bp, Homo sapiens
aatttcgtgtttatttggttcatacgttgaagcttagtttcacattttgatgttttactgctttgtacagcccacgatggtatttgcccatattgagtaagtgaataatagatacaccaattgaggttcatttagcaaaa

SEQ ID NO: 164087 - DNA, 116 bp, Homo sapiens
ccagactttagaatactgaactgaaatcatcaatgaaatctagcaatttcactggtatctgtatttgatataatttttcatttacagataccaaatttcagtgactcctggaagtt

SEQ ID NO: 164088 - DNA, 584 bp, Homo sapiens
ccagttaaatcactcacttaatcatttattcaacagataattattgaacacatactaagaaccaggcattgtgccagtactggggatacgaaggtaaacagaaacagacaagatcctgcccttgtggaacttatactctagtaagtactttaaagtcagaggtagactattgatcaagcagatatagtatcctttttggtgtcgagagagaaaaggaatgtgtccataccttaatgcaaccatataattcccagaagttagagcagggctccttcatgagcagaaggtacagtctgtaattagggctgagaggcaggtggctacgccctggactggggttagtctcttgggtttagtctcttagaaagcaatgtggtttgcagttctgttgcaatccagatgatggaatgcctaccacgaaggagcaagcccgacctcaagcgatagagaccttttgagctaagttccgtccttcacccagtgcctgtgtattggaatgggtggagtgggtgagagcgggctgagaggaagcaaagccgtggagattccacaatgttaagattaaagagaaggatcagcacaaa

SEQ ID NO: 164089 - DNA, 437 bp, Homo sapiens
tgagggaggaacagaggaggatggcaggtacaaatctcaacccacggcaggtaaaagacatgcacctttttagaagtcccctgatgtcagtttttagaagtcccctgatatttgtctctgcccaaatctcatgtcgaactgtaatcctttgcatgggaggtgcttggatcactgggctggatttcttgtgaatggtttaacgccatccccttggtgccgtccatgtgttagtaagttcttatgagatttggtcatttaaaagtgacacatagcatctctcacaaagtgtgggagcacactctcactctcttgttcctgcttttgctacctgcctgctcttcctttgccttccatcatgattggaaacttcctgaggcctccctggaagccaagcagatgccatcatcatgcttcctataaagcctgcagaactatga

SEQ ID NO: 164090 - DNA, 156 bp, Homo sapiens
ctggctcttaggagcaaaaggagaaaacaaatgtgcatccctgagctgttgtctagcatataaaaaagatgctattattaataacattttgtcttattaacatttgtcctactgtgatttattggcagccagaagcccaagctttaggattagtca

SEQ ID NO: 164091 - DNA, 506 bp, Homo sapiens
gtgtgctgcagtatttattgttaacatttgtgactcaaatgtatccactccctgctttggttgctctggcctgcaagtaggccgtactaattctgtagttggtcctagcttgcctttgtctttaccttgcatgcgtttatgtcttaatgcacctattaggattccttgcttttatcacaggtttcccatttttctgaaaaaattacagtaattattaacgcagaacccaggtaaattaaaaaggtttgtatgctttatgaatttttagtaagtactcattgattgataacagcaacagaggaaaacaaaacggtcagttccgatcttgatttccaggagcactttgtgtttccacttggcagcgtgatgcttcctcatgtcggtgattttctgttgagacatcttcaagcatcatcttacgtctgcttgttaacatttgttcagatttgatttcagctaatccttaaaagttttttgagacatcaaacttagaataaaaggaattt

SEQ ID NO: 164092 - DNA, 324 bp, Homo sapiens
atcaaggagaggcccaataaacactcgaagtgtaagcagttattggtatcacaattttcattgtcattgtaatcattatcttattagcatcctctcaggtagatgtaaacattgatgacagttgaaaatggttccacttagagaggccaaatagcagagtcaagatttgctcttaggtcaaacttgagtttgaatctagaatcagttgcttacccgtgatgaagcttcagagttggcaattaaaccactctgagtctcggtttctgcatctgtatgatagagattataatatcaacgtctcgtgttcattctttcattcacaag

SEQ ID NO: 164093 - DNA, 340 bp, Homo sapiens
ttacttctctgtacattataactgccagcttaaaatgatattatttttgctttaaatgatcacttgttttttaaggaaattaactaaaaagcaaggcttttatattcacatacatattcaccattctgatgctcttaattccttcttgtagatctgagtttccagctgtcacttcccttcagactgaagttttttgtttttctttagggtttggttttggttttggtttggttggttggcttgcagtgcaggtgcaagtctgctggagaagtatttttcagctatcatttaatagaaaatgtctttatttcactcttatttttgaaggacatttccactg

SEQ ID NO: 164094 - DNA, 239 bp, Homo sapiens
agaccttcgttccgccacgtcagggtcagctaatgctcagcaaattatccacttagtaaattcatttcaccgtcaacagatagtggtgcagactcgtgttctaacaaattaaatatcccattcggagttctgaggagtctttttaagttattcccaatcaataagaaaagcacacatgacactaaagctcctctagaaagatggctcatttctcttccaatgtcaaaaagccatgaagt

SEQ ID NO: 164095 - DNA, 459 bp, Homo sapiens
actgtactgtttaattatctatccatccatctagctagctaatctagctatctcatctctctatttctatttctttcactttactctgatatattaaaatgcacagtttctgggcaagctgacatctttgagcctcttgagggacagctcctcatttaagagatcttcttgttgcatgaaggatttactcttccctccccaagcttttctacagcttttcttttcaaataaattttattgtttatcccttttttaactgtctgataccatgcttcttatccttctttccacaccctgccctgacgctgtaaactgccctgacgctgtaaactgccctgacgctgtaaactgccctgacgctgtaaactgccctgacgctgtaaactgccctgacgctgtaaactgccctgacgctgtaaactgccctgacgctgtaaactgccctgacgctgtaaactg

SEQ ID NO: 164096 - DNA, 449 bp, Homo sapiens
gttccccgctgaccattattaatattttggtgtttggcctttcagtttattttatgtgtatacgtatgtgtgttttctaaatgtatatgtagttttttgaacaaaattcggatcgtgttgtgtataatgttttgtatcctactttttaacctaatgttacagtgtaagcattttccgcatcttatataggattcaaaagtatgattttcaatggctacataatagtccatcatatgctttaccatagctgaacaaacaaatcctcttgtgtgggactccactttgaataaagttcttagaaatgtagtttgttacaaccattctgaaagtcagtttggtaatatatcgtgaactgtacaaagctcttacctttatatcctcgcttctaggagcttattcaaaggaaataaacaaaattatggtcaaagatttatgaatgagggtgttta

SEQ ID NO: 164097 - DNA, 464 bp, Homo sapiens
agtgtttgatttcaaatgaggctccaaaggatgtaagatatgagatttatcaaggcaggaggagagaagccaataaattaccctatttgcaaatcattgctatggaagccaaagccccaactgttaaaacaaaggagataagcccttactatagcttagcctgctcacagaggaggcacagatgcccacggagctggcccagcccccaacaagcccctaggcacctccattgtatcccatcccagcgcccagcagaactctagttcccgtccatgcagggtgtgtggctttccatggcgagggctgcacactccttcctttctttatttctgactcctcctgaatcatcaccctctgctgggtgagcacaatgtgcagaggttttaggggctggggaaacatccctgctgcttccatgtcagggagacataaaaacacactaagaaaccttttggcaggaggct

SEQ ID NO: 164098 - DNA, 632 bp, Homo sapiens
agtgtttgatttcaaatgaggctccaaaggatgtaagatatgagatttatcaaggcaggaggagagaagccaataaattaccctatttgcaaatcattgctatggaagccaaagccccaactgttaaaacaaaggagataagcccttactatagcttagcctgctcacagaggaggcacagatgcccacggagctggcccagcccccaacaagcccctaggcacctccattgtatcccatcccagcgcccagcagaactctagttcccgtccatgcagggctgggcagcaagtcaggaagcctggcagctggttcccaggagttgccagcagatccaaggacacaaagagggactcctggtccctgcagaaccagcgcacccctcctccagaatctagaattcgcgagaacattgcccacccctcactgctacccagatgtgaacggctgtgtggctttccatggcgagggctgcacactccttcctttctttatttctgactcctcctgaatcatcaccctctgctgggtgagcacaatgtgcagaggttttaggggctggggaaacatccctgctgcttccatgtcagggagacataaaaacacactaagaaaccttttggcaggaggct

SEQ ID NO: 164099 - DNA, 480 bp, Homo sapiens
tgtggagttggctgcttactagcccctctttttcttagactgatgcctctactagcctcagccacccaggggaactgactaacccatttgtccaggtttaaaggtgacctcactgaagtcaaggctctgatgttgggtctttggcttccagcaaatgataccatcattagtggcattctgggtcctgatctagttccagagtgtttgctcttctcctgcccttaaaagtaaccaagagcatagctgggaaagaagggagaggagacagcagacagggagagatgaataagaggctagtaatgacacagactgtaggatctcaacacagcctttcctaagttgggtatataaacaatagtatatcactatactaaactgaactgaagatgtaaaagggctcacaatctagttagggtgacaaaaaatgtatgaaatgcctacaggattaaagaaacatgccaattttccctggcactatac

SEQ ID NO: 164100 - DNA, 429 bp, Homo sapiens
taagtggcatctacatgctgagggctgtacatctaagtccctggccagacctgtctctccagacttgacactccgcttgtctgcatgatacccagccgaaccaaacatcatcttcccaaaactgcatctgcagacagtttcctatctaacctgcaacaacccatccttccaggaacttccagtcgccatcctcatttcctctcacacaccccacattcagtccaccaggaaatcctactgacccagcttccaaataaactctatccgcgtttgactctttgtctcatctccactgccagccctctggtttgtgccaccggactgatctctaccagactgatgtcttggcagagtgatctgattaccagaatgtctctcctctgctcaaaaccctccaaggactcccatttcagagtgaaacattcagtc

SEQ ID NO: 164101 - DNA, 252 bp, Homo sapiens
ctgggcaacaaagtgagactccatctcgaaagaaaaaaaataagagtaaataactttaaagctaattaatgcgaagttctgaaggatttgataactatatgctgataaaacgaggcattgactatttcattaaaagaatttcaggccaggtgtgttggctcatgcctataatcccagcacgttgggaggctgaggtgagagggtttcttgaggccaggagtttgagaccagcctgggctatatagccagact

SEQ ID NO: 164102 - DNA, 391 bp, Homo sapiens
agagagacacgtgtgccatgttgtgtcattgagaaggaccgtgaaagagcagggctgaaaagacaatcctcctaagtttattattttccaaaaggccaggctggtgtcatagtgaaaaactctaagggcttctctgaaaaaggagaagaaaggtagctggggaaagactttatgagaaaaatcacatgttatagttttaaagtttccaaaatatttgaatcaatattgggccttccaactcattctgacgttctgactcaggggattataaaaaagtgaaattacaacaaggtttgagtattctgctattcgtttaccttgggccacagtgattatgaacgaacgatatttcagaaacaggcattgctttgggatctatttcctttgcatt

SEQ ID NO: 164103 - DNA, 296 bp, Homo sapiens
ggtggtgctcccctgccgttccagggaggagttcaagaccaacctggggaatatagcaagatcccatctcttaaaaaaaataaaataaaataaaaataaagaataaaaaaggggcaggcctctcctgtcctgaaataaacacatgaacaaaccctccaatgctgcccttcaagctccccctcactggcaaactttgtaagttatctgcttttagggcctccacttctttttcttcccagttacttctcaatccagcacagtctcatacttatttttcttatttatttttttgagac

SEQ ID NO: 164104 - DNA, 237 bp, Homo sapiens
catcacagccacatgcccagacgctccattggaggtgaagtgacccgcccaagactccctcttaggcaggctaatcattgttttttgtttgtttgcttagagatggggtcttgatctgtcgcccaggctggagtgcggtggcgcgatcatagctcactgcagcctccaactcctgggcaagtgatcctcctgcctcagccaacccaatagctgggattacgggcgcagtctgtgagg

SEQ ID NO: 164105 - DNA, 480 bp, Homo sapiens
ttctcttggtatcatgattccattgagggtctctgctctatcccactgatcaatttgttccataggaacaaaatccctgatgggattttgatggaaatgactgtaaatggaatttacaaataagtatggggagaattgattttttttttactgtatcgaatcttcttatctatatatatgggttaatttatttaagactttcaaaatgtcatttaagataaggtttcggccaggcacagtggcccatgcctgtaatcccagcactttgggaggccgagcggatcacgaggtcaggagttcgagaccagcctgaccaacatggtgaaaccccgtctctactaaaaatacaaaaaatgagccgggtatggcggcgggcacctgtagtcccagctacttgggaggctgaagcaggagaatggcgtgaacccgggaggtggagcttgcagtgagccgagatcgcgccactgcactccagcctgg

SEQ ID NO: 164106 - DNA, 410 bp, Homo sapiens
gggtgatctagaggatcccgcgacactcttgagttgaggtaaacagcttttacagactatattatgtaaagatatgccttactatggcagcaaaaatgcaatatgaagaaaataaacctagttttatccaattcagaggaaaacaagtacatttaaaaggataaaatctggccaggtgcagtggctcatgcctgtaatcccagcactttgggatcttgctcaaaatctagtccttcccttatatttgggctcaaaatatatttttttgaatgacaggtcagaataaaaaattgatggtggtttaagaatctattacctatttcctttgaatcatatattattaagaatattggtcatataggcgacacgtttactctagcagattttctttttgtctgagatggggtctc

SEQ ID NO: 164107 - DNA, 397 bp, Homo sapiens
ttctttatctgaataggaagattaattttttaacatgataatttttgcaatgtattaaataatgaagttacattaatttaatttaattaatcaatctcttattttcactggtgaaatatctgatacaatgctacagtggcagtataactactgagtcttttcctgatcatcattattgtgtcattattgataattacaaggttttgggttttggtatttagtatttagtctttattcactctgttcatttagtttcttattctacctttgccaaccattgcaaatcatcagctataacgtgatggcactgacagggaaccttgacttgttcccaagaaacatctttgaaaatattaagtataaaaattctcttagaatataatattttacccatatg

SEQ ID NO: 164108 - DNA, 393 bp, Homo sapiens
gtgcccagaggtgtggcctgggcactttcacgcaggtatgttggtttcagcagccatgtggcaggataccgccagcctagaggggagaaatctcagcagaactctgaaggaagatgggagctgctcaaatggctccctctttgttttggtcaagaatccccactctcctctcgttgaccctgagctcccaacatcaccagcctggggcataggcagctggcctgagtgtgagtcctgatctcagcccttgctaaaatggcccaggtcttctctgccactcgtagaatgggagaagtgagggaggaagtatttgaggcagctcatgacccagagctagtgctcaattccggctagctgtttttatcaggaaaagttttcactggcaaaactcaa

SEQ ID NO: 164109 - DNA, 324 bp, Homo sapiens
gaaaaagatgaaaaagtattgcaagccaactccttatatttccccatcaactgtctctcctatttcccacagtaactattttgaagttttctgctccccaaaagtattggactccccacgccctctcactacccactgaagatagctcctcctccctctcagagtacgcagaagccatcagtcaggggcgtcctggactttgtatatccatgcccaacttttcctccttttgttctcatacactgaaggaagtttcccaactcctgtttagagatactgtcccacttctctttcccatccattcccatccagctcacacagcct

SEQ ID NO: 164110 - DNA, 452 bp, Homo sapiens
acctcaggtgatccacctaccttggcctctcaaagtgctgggattacaggtgtgagctaccatgaccagcctaattttcttatttttagtagagatggggtttcaccatgttggccacactagtcttgaactcctgacctcaggtgatccacccatcttggcttctctaaatgctgggattataggcatgagtcactgcccccgctacgattgatatttgaacattgaattagccttgcacacctgggataaatcctgcctggtcgtggtgtataattattaatacattattggattcaatttgctgattttttgtttaaaagttttggccaggcatggtggctcatgcctgtaatcccagcactttgggaggccaaggcaggaggatcacttgagcctaggagtttgagactagcctaggcaatgtggcgaaaccctgtctgttaaaaaaa

SEQ ID NO: 164111 - DNA, 368 bp, Homo sapiens
tagacactttgcgggctataagagtgctttaaaaatgtgaattcagcccacattctcactgcagagaaaagactaaaatcctctcagcaaccacattcaggaactttgccaagaaaggcaggtgaggactccattgtgcctgtcatccttcagcatggaagaactagtaactgcaagggctatgattgtagctgttgttccaacagttctgtgacaacacgtacctcctcaaacacaatgcaacagtgaggcctaatgtcccaggatttattttcattaagtcgatgcttatggaagacctaatatgtgacaatcactgtgcctggtaaataatgttggaaagaacactttgctcagtccctgagggg

SEQ ID NO: 164112 - DNA, 455 bp, Homo sapiens
ttagctatcgttaacatgggtgtacaaatacctcagctcactgtttttaatttttttgggtgtatatccagaagtggaattgcttggtcttataggagtgatatttttaatttcttgaacaactgctgtattattttctgcaatggccgtacctcattttatgttcctgctagcagtgagtaaatttccagtttcttcacatccacatcaacacttgttactttctgtttttttttttttaaatttgtagtagccatcctaatggtatgagggggcatttcattgtagtcttaattgcattttcctatttataaatgatactaagcatctttttatgtatttattagagattcatatatcttctttggagaaacggctacacaagccctatgcttatttttaaattggcttttttggttttttattgttgagttttaggatattttttctttttt

SEQ ID NO: 164113 - DNA, 479 bp, Homo sapiens
  misc_feature (20)..(20): n is a, c, g, or t
  misc_feature (37)..(37): n is a, c, g, or t
  misc_feature (64)..(64): n is a, c, g, or t
acaagtatcagttaaagacnaaacaggctgggcgtgnggctcacacttgtaatcctagcacttngggagtccaaggtgggcagaacacctgaggccaggagttggagaccagcctggccaacatggtaaaacccctgtctcttaaagagaatctccaagtaagcatatggttctctccatttgagagtccagagatgttttatatggccttgcataatgtgaccttcttcagaccctcaccagagttagctcaaaaacaacagcagtcacgtttgatctgtagtctgaaaagctgtggtgctaaaccctgctaggatggactgaagaatagtgtcaaggtcttgcatatcttcattataccttctttggtattacatgggctgataggactttttagagtcctgcttgactgattatataggatgctatttcagtggcacagtccctccccatcacctcaacaagataagatgagagct

SEQ ID NO: 164114 - DNA, 375 bp, Homo sapiens
attttaatcaaagaaatgaaacattctagttaatgctgaaatctcctttgttccccatcagcagtcccagtcctcgccctctcctcagcgaacaatcactgtcaagaatttagcatctatccttccagaatatttcacactattttacagacctgtacgttttcctgagtcatgcatacagtttagtgtgtgtaatcccatattgtacatattgtcctctaacttgcttttgagcaaggcttctgttttagatctttttccatactgatcttttcatagagcacctgctgagcctcttttctttccagtttgccatatgtgtgaatgtaaagatgtgagagtaatagccaacagttaatttgctttcaccacatg

SEQ ID NO: 164115 - DNA, 382 bp, Homo sapiens
ctcagggaaagatactgtgctcccaggtcttcatccaatcaagaaactgccctttccagctatgcctgtgttcaggatgtcagttagatacaagaggtcacagattgcttccaacacacacagaccacctaatatgtgctaccaaccatagtctggttaaaaagacagtttctgctcttcagaaagtatctcattcgtgactgagcatcagctataggaaggtgaactttaacaaaggagctaagctatgccagaggtgtgccaaggtgatgtgagacagggaatgctagcatgcacttggaggcagtgatctgctaagcccactgggagctgaaaacacaggggactgcctaagcacagccatctgagtagcacacggtgg

SEQ ID NO: 164116 - DNA, 320 bp, Homo sapiens
atgctcccaaatgtctgctgtaaaccaacatctttcggaggaccagttgaaaataatatttctcaaattaatgtgaaaagtgtttgctgttgagttgcggcctttcagtcccgcctttgttctctactcaccactgttgagttgtggcctttcagtcccgcctgtgttctctactcacctctactgcttgttttgctcctgattcaaaccagttccacacatactaagcccactgtgctaggtggcctgaccgtggtgaatattattgtggaggaaggactttgctgtaagaaattgcattccccaaaactgaaaccatg

SEQ ID NO: 164117 - DNA, 94 bp, Homo sapiens
ctttatgcaataaaaggatgtttaactagagatgtgagcttgagtcagctgcccatctactctggggctcatttttcccacctgtaaaaaaaat

SEQ ID NO: 164118 - DNA, 419 bp, Homo sapiens
atatgaggaactgtggctattcttcctggagagaaactgtttagggagaacatggtagctgtcttctcatacctgagttgtcatttcacaaacagtgctaagaacccaaactagtggactaaatttgtaaggagacaggtttcagctcactacatggaaggaagacaatctcttatgtatgggtggtagagaacactcagaaaccaactgacattgaatagaggtggctggactaaaactcagtaactctaaagcctctttgaatgcttgagcctacgactttgtgatatatgtttaaacttatggccaaatctggatgtttttcaggagttcatgaagtcatacaaaagtttgaactaataggtttaagtctggggtccctgagtcactccttttacaagtctcttatgttcctagct

SEQ ID NO: 164119 - DNA, 535 bp, Homo sapiens
atttgctttaccatctgtgcagtatgactggcacagccacatcttttcttttcatgttaaaatgtctatggccgtttttggggggacaaaacagatacaaattgtcattagggaattgagaattaattcaatcagccatatggtttgcaaacaagctttatttttctgtgtttaaaaaatgcatttaagatgtatagcattattatggtttctctagaagtcatccttcataaaagtaattcggtaatgttagaatctctgtcagtttcttggcaaatagtattcgattataaatttatgctccacaggacacacaattttagaaatgttctggaatgtttccaaattttattttggaacttggcatttggtttctctttaataatctcaatcaataatggtttatactagtcataaatgtattagctttaaatagctgccatattccatttcagtagaaatgcttttccctttcccatagtgtgtatttgaatattcatttttgtgtgcaaagttttttccttgatacttggat

SEQ ID NO: 164120 - DNA, 279 bp, Homo sapiens
gagtcacgcagaatctgggggcagagaatcaaggcagagaaacagccactgaggaaatattgtttcctcagtacaaagccctgaggcagaaatctccccaacacccttaagggacagtggctgaaaaactgagcagggggagaagaggagacaaggtcgaagaggtcaggatcctggggagtccttaataggctatcatgatgactttggctttttcttcccctcaaatgaggaatcattgcaggattttgtcagaggagtgactcgtggaaatgtcca

SEQ ID NO: 164121 - DNA, 317 bp, Homo sapiens
cattataaggcgcccatcagcttttcatctaatagctgtagtatcccttgagatccattttttccttaggggttgcacattactatttttctaatattgtcattcttttgtatttattagctagaatttttctatagaagaaattttcctaatcagcaattttgttactttgaaatatagttcctagaagaaaggcagggcaaatccttcattccctccttcccttactttatttaacagctttagtgaggtataatttatatatcataaaattcacccattgtaagtaactatagttaaatgatttctagaaaatt

SEQ ID NO: 164122 - DNA, 319 bp, Homo sapiens
ctttggccagggccggcagagagccccagtcctgaagaaccctcgttcttcgcgtgctgtcgcgggggctccgtaggcacggttgcagcagggtcttggaggccgaaagaaggacggtctgagctgagagaggggagttggccaggcacaggggtttcagagctttacaggattcagaaggtgcccggggttctgcagcccagtgaggagttcacagagtggtgggcgacccagcagccaggggcatcagccgtgggagtgggacgctccgggagtctgagctgcatcctgtgggcgcagcagacgctcaagggctggg

SEQ ID NO: 164123 - DNA, 210 bp, Homo sapiens
atcctaacattgattacgttcctagggcttcctctaaatgaattctctcatgcataaagggaggaatcactgaaaatttttctgaaattaatacactcgtgagtattgcatccaaggaacatttacatatttttcctaatataagaggtatcactgaaaacattccctcatcctttatcttaagaagttctggctgagagtggtagctcg

SEQ ID NO: 164124 - DNA, 130 bp, Homo sapiens
agttgtaccatctacctgtttgccttcatggaacacaaaagaataatttctaactctgtccttgattgcctcatccatctagatacttgtaggctctctgtggagtccatctacttctttcagtcatcac

SEQ ID NO: 164125 - DNA, 307 bp, Homo sapiens
aagagtcctaagctccaggttcacatatgctccagccttcactatattctccacttagatgactaagaagtaaatcaaacttacaaatatcaaactaagctcttggtctccactccaatgatcagctcttcccttcatctttccacttcggtaaatggtacctctaaacttctacatgtttaggccacaaatcttgaggtcatacttaacacctctttctctcatcccccacatccaaatttaccagcaaatcttcttagcttttcctttaaaataaacctagcacgtgtctagtctccaaagtgca

SEQ ID NO: 164126 - DNA, 158 bp, Homo sapiens
attttacaacgctcccaactgcttgtgtttgccattttgcctgctttgttggacttgtaagcttcttgagtgagggggtcttacatattacacatctttatacttccaattttgcccaccagtgtgctgccaccccacggatgctctgcaaacataga

SEQ ID NO: 164127 - DNA, 556 bp, Homo sapiens
cctcctgcttcagcctcccacacagctaggactacgggtatgtgccactatgccagacacatttttaaaattttttgcagagacagcatctcgctatgttccccaggctgatctcaaactcctgagcccaagtgatccctattccttggcctcccaaagtgctgggatcataggcgtgagccaccgtgcccattcaggaagcagcgtttgtttttatctgaggaagcccccaccaacagttctcgctgtccagtgaaacagctgccttttgaaacggggggctccccatgctcagcacctcttcagctgtggctggacattagggactgtaatggaaagattttcacacctggagagatgatgtccacagttccttctgagtccaacaacaggtgatgccagtgtttcagagacaggaacacctgctctcaaagtcagagactcagtcactccagggtggagacaggactggcactgccacctgaaagggggctgggcagctgagaactgcacaggcatgcagggttgctttttggtgtttcgcttcaattttccc

SEQ ID NO: 164128 - DNA, 906 bp, Homo sapiens
tgatttgtttgtggatataattgagttacatcatgcttgttagtcttttcagctttaggtggtgacattttgttttttatttgttttgccaaaatgtttatttgcagaggtggatagcttttttttttttttttttttttaactttcatttaagaggaatgcacatgaactatttgaagcagtaccttcctaagaggttttgtttgctgataaagctttcctattctagctgcttgactcataccagaggagaagcattaaagaagaccagaaggtgaaaagagtcaccctaacctatccatgtgtgctcttgaattttcctaaggaggggcacgcgttgatttcctcattgtctttatcccacaatagattcttagaatatgtatgtctatataaaatttttaaaactgcttgagtttgtagccaaatgtaatgtggctttttctacttggaacttttactgagagtactttatttgatggttaagacttagtaagtcgtagccaggcgcggtggctcacacctgtaatcccagcactttgagaggcagaggtgggtggatcgcctgaggtcaggagtttgagaacagcctggacaacatggtaaaaccccgtctctactaaaaatacaaaaattagctgggcgtggtggtggctggagcctgtaatactagctactcgggaggctgaggcacaagaatcgcttgaacttgggaggcggaggttgcagtgagccgagatcgcaccactgcactccagcctgggcagcagagtgagactttgtctcaaaaaaaaaaaaaaaaaaagtaagtagttaacacccgccccaaccacccaaacatactgtaggcaaggcagaactacagtttgtaatctatgctttcaattttcaaaggtctttagcatt

SEQ ID NO: 164129 - DNA, 318 bp, Homo sapiens
ccctagattgcagagatgaacaggtaaacacaaggagtcttggcttaccagagcacagactcatgagcagaaacctctgtgagaaacagagctagggtaggaaaacctgaactataattgatgaattgttggaggttcagaaagcgttaagtctgaatgttaaaaactccagggaaggccgggcgcggtggctcacgtctataatcccagcactttgggaggccaaagcgggtggatcacctgatgtcagaggttcgagaccagcctgaccaatatggcgaaaccccgtctctactaaaaatacaaaaattagccggc

SEQ ID NO: 164130 - DNA, 909 bp, Homo sapiens
ttcgcggtatcataattcgcggatcataagagttgagaaaggtggctgggcatggtggctcacgcctgtaatcccggctactcgggagactgaggcagaagaatcacttgaaccggggaggctgaggttgcagtgagccaagatcacaccactgaactccagcctgggcgacagagcgagacttcgttctaaatacggttgaaattgtgacacttagtgtatacttccttatattatggtgtgcccactccctcccctttttacttcagactttatttcagtcatgattgctttcattgtactattgtaggtgaacgaaatttaggaggtttatttctgtgttgagcaggatattctctgaagttattgcatattttgaaagtagctatcagccctttcctcccttccattctctacttggtgcacctccatgtttttttctgctttgttgtaactgctgcttcctttttcttttgttcttttattcatttttttctattcttcctacattgggttttatcttctggcttccaaatctggaaaacttggatttgttattcttcggtcagtttgacaaagcaacatacttaattgcctcttttatgttaccattaaattaattctgtgaactctgacttcccttagaattgaaaaagaccacgtgtacaaaaatccggttagatagtagaaataagttctagtattcaatagtacagtagggaaattatagttaacatttatttattctaccaaagtagctagaagaattgcagtgctcctaacacaaatagaagatcaatgtttgaggccaggtgcagtggctttacgcctgtattcccagcactttgggaggctgaggcaggtggatcacctgaagtcagaagttcaagaccagcctggccaacatgg

SEQ ID NO: 164131 - DNA, 945 bp, Homo sapiens
gccatcctacactcaagctaaatcaaggcttaatgttaatctgttgaatcttcctgaaatataatctcatttagaaatccacagtatttcctcagtttacttcaaaatgtggatgtaagttttacttttttccctcccattaatttttttaatttttatttagagatgaggtcttgctctgtcacacaggctggaatgcagtggcgacagagcgagacttcgttctaaatacggttgaaattgtgacacttagtgtatacttccttatattatggtgtgcccactccctcccctttttacttcagactttatttcagtcatgattgctttcattgtactattgtaggtgaacgaaatttaggaggtttatttctgtgttgagcaggatattctctgaagttattgcatattttgaaagtagctatcagccctttcctcccttccattctctacttggtgcacctccatgtttttttctgctttgttgtaactgctgcttcctttttcttttgttcttttattcatttttttctattcttcctacattgggttttatcttctggcttccaaatctggaaaacttggatttgttattcttcggtcagtttgacaaagcaacatacttaattgcctcttttatgttaccattaaattaattctgtgaactctgacttcccttagaattgaaaaagaccacgtgtacaaaaatccggttagatagtagaaataagttctagtattcaatagtacagtagggaaattatagttaacatttatttattctaccaaagtagctagaagaattgcagtgctcctaacacaaatagaagatcaatgtttgaggccaggtgcagtggctttacgcctgtattcccagcactttgggaggctgaggcaggtggatcacctgaagtcagaagttcaagaccagcctggccaacatgg

SEQ ID NO: 164132 - DNA, 424 bp, Homo sapiens
aatcccagcactttgggaggctgaggcaggtggatcatgaggtcaggagttcaagactagcctggccaatgcagtgaaaccctgtctctactaaaaatacaaaaattagctgggtgtgatggcatgtgcctgcagtcccggctactcgggagactgaggcagaagaatcacttgaaccggggaggctgaggttgcagtgagccaagatcacaccactgaactccagcctgggcgacagagcgagacttcgttctaaatacggttgaaattgtgacacttagtgtatacttccttatattatggtgtgcccactccctcccctttttacttcagactttatttcagtcatgattgctttcattgtactattgtaggtgaacgaaatttaggaggtttatttctgtgttgagcaggatattctctg

SEQ ID NO: 164133 - DNA, 670 bp, Homo sapiens
taaggaacaaaaaattttgaatgttacacctgaaacaaagaaatgtggtcacctaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataaatttagggttgatgcatcaaccctaaatttattatgaagactttcagtaaattaggaagagagaggaactttcttacctgataaagaacatccaaaaaaccctacagctaatatcatagttgatgttaagaaactggaacctttcctgcaaagattaagcacaaggcaagaatgtcccctctaatcattgcttttcagcatcattctgttctagctgatgcagtaagacaaaaaatggaaataaaaggtatatagattgaaaaggaagaagtaaactgtcattgttcacagatgacaagattatgaagaaaattcaaaagaatcaagaaaattacttctggaagttgtaaaccactatcactttctcttattgccagcagtgaacaagtggaatttgaaattaaaaacacaataccatttacattagcaacccccataataatttagggtagatgataaatctaac

SEQ ID NO: 164134 - DNA, 301 bp, Homo sapiens
ataaaaatggtgttcccatgccataagaaaagacttcttttatgattccaagtggcaagtgtcagtgatatattcagtatcttagagaggctaagcttttaacttcagggctaaaatatcacagttgtaaatatcaaagataagttatcagaatttcataaggaggttgagctgtggtgcaaatgaatctatcactgagtagaattttttttctaacactttattttctccattcatcacagaaagaagtcaatatcatattattgggcatgtttaaaagtcacattcaaacaccgtacca

SEQ ID NO: 164135 - DNA, 399 bp, Homo sapiens
caggtgtgggatgagagaactgccccgacgccccctttccccaccccaggcaaggaagtccagctggttgggctggcttagcctctccctcccgtgaaatggaaaactctctctatgcggagttctggggactgacttgcctagagacccctcctggcccagactagtccccactcccctcctactgagcttctgagcgtccgacgaggcacagtccctcccgtcgtgcagcgggaaaacggactccccgagaggttgaggaatttgctcagagttacacagtggggaagaggccaagccaggattttaacgcaagttgtccagactccaagggccagattctcctctgacattaacgccgtgccccaggaccatggactgctttccctaacacccaga

SEQ ID NO: 164136 - DNA, 493 bp, Homo sapiens
ctcatgatagggagttatgagatctgaatggtttataagtggcaggttctcctgctctcgctctctctcctactgacatgtaagacatgccttgctcctcctttgccttccaccatgactgtaagtttcctgaggcctcttcagccatgcagaactgtgagtcaattaaatctcttttgtttataaattacccagtctcaggtagtatcttcaaagcagtgtgaaaacagacgaatacaaatggtttagtaccatccctttggtaacatcctcatgatagtgagtgaattctcctaagatctggttgtttaaaagtgtgtgcaccttcccctccgccttgatcctgctttaaccatgtgaagtacaagctcttccttctccttccactatgattgtaagtttcctgaggccttgagcagatgccagccagcatcatgcttcctttacagcctgcagaaccatgagcaattaaacctcttttccttacaaatta

SEQ ID NO: 164137 - DNA, 135 bp, Homo sapiens
gggtgtatgcggggctgattctccattctcacgtctgtctacatctgtgtaactccccaaggcagctgccctaggtacaaggagggaggctcccacaattgctctcaccattaactgcctgcctgtaggtaagta

SEQ ID NO: 164138 - DNA, 532 bp, Homo sapiens
acatgtgtatgaggctcagagatgcagggtgaaggctgtcatcacatttctgtagatttcccttaggaagagttgagcaacaggctttaggtagagaggaaagagttcttaaaaatggtaggagccagagagtaaacagaaagtaaaccaactgtgttataaagaaggcatctttccacaaagagggaaggtggctggtgctgtttttaaatgttatttgtctgtttctggctgctatactgtagtaacattttccttgaccaaaatccagaagcaatgtgtgattaagctagctttaaatggatagagaaaaaagggtatctgtgtgtttcttcccactcctacccatcaagtttgtttccagatagttgcgatatgtttcctaaatgaccaggtattttataaaaaccggtagagctaaatttgatttttaaaacacttctaggtttaaaaagtgtatgtaaaatcactctcccaaatctcatatatatgaaaaaaatcagtgtcagcctcaaactaatgattagaatca

SEQ ID NO: 164139 - DNA, 506 bp, Homo sapiens
gacagttaaagagagatacaaaaagttccagggagctaaaaaggacaactgattgaactcgttgaggttgagaaccagaggagaaggaaggaagtcagtacagagtgaggacccgaggagaaggaaggaagtcagtacagagtgagtatctgaggagaaggaaggaagtcagtacggagtgaggacccgaggagaaggaaggaagtcagtacagagcgagtatctgaggagaaggaaggaagtcagtacagagcgagtatctgaggagaaggaaggaagtcagtacagagtgagtatctgaggagaaggaaagaagtcagtacagagcaagtatctgaggagaagaaaggaagtcagtacagaccgaggacccaaggaggttctgatctgggccactagggcttcctcccactgggggcctcttgaagagctgggctgtttgtgcactgactcctgtctgtcgctggttgtggaaggttcctagagtcataactgcctgacccttc

SEQ ID NO: 164140 - DNA, 448 bp, Homo sapiens
gaatctgtaggtaacttagcaaagatgaagcacacaacaaaaaaaggaaagttggaggacagagagagaatgaggataggtgattttaggaaagcaggcagaggctaggtcataacagattttgtaagctatgctaagaagcttagattttactttctttgggagtcggtggtccctttgagaatctcatgaagactactgagaatctaataaaatctcctcaaaaattatgtacacatttcaacgagttcaaagatctattcaagttttgacatggaccttcactccctctctactgaatctttccctctaagacgtttctatgttcctgtctctcccaccttcaattctatgcccctctccagcaacttccctatcttttcccattccttcataaacaaacttgaaatcattccagagcaatttatctttccctatcatttatttc

SEQ ID NO: 164141 - DNA, 493 bp, Homo sapiens
aggaaaacaccattttgatgcttttctctgcagtctttttctttgtgagccccctccccagtagttacggtcttttctaaaaactagaggcctttttacactgcttccgtctgtttttaaagggtatagtaatacaacttagaagtttcttaaaaagtccaaatcacagggagactcagatggcttccgaccacacacaccagttctcagagctcctaagggtccgaaaccacaggcgccccagatccaactggggagatattaaagggcgtttgggagaggagactggctttcggaagttgcctttcagcttcgcttcctactaggcccatgaagcggtgccctgtacaccagcaaacttgctggctgcagcagaatttctgtctctaacagaaggttagccatggacttgaattgtagatgcaggcagccggtggagtttgataagaggttcctggcaggccgggccgagcactcctggtcagctgatgaa

SEQ ID NO: 164142 - DNA, 435 bp, Homo sapiens
cctccaaaagaggatcaaccttttatttgctcatttgacaaacatgtcagagaggtatataggagtcaggatgcctgattagcttctctgatcctgattctgctgccagttagctgtgtggatctaggcaacctgctctctaggcctcagtttgcacatctgtaaagaacgggcctggggctggatgtggtggcttatgtctgtaatccaagcactttgggaggccaaggcgggtggatcacctgaggtcaggagtttgaaagcagcctggccaacatggcgaaaccccgtctctactaaaaatacaaaaattggccaggtttggtggtgggcacctgtaatcccagctactcgggaggctgaggcaggagaattgcttgaactcggagggtggagtttgcagtgagccaagatcgcgccacttcactctgtctc

SEQ ID NO: 164143 - DNA, 319 bp, Homo sapiens
ttagagaaagattaccatatggagagtggtttgggaagggtaccattcagagaccaaaaagttacgtagggagttgtagaaactgaagtgagagatgacggtagcagggcttagaagaatggtgataaaggtggagaggagaggactgctctaagatgcataaggaaactgaatacacatgtacattagacctaatggctgactctgtgtttgcacacacgtgtgcatgctttgcaggggagaggaggcaaaatggataagagggagaaatcaagaaggactcctttttcctgaaatggaaaacacaagtgcatgagca

SEQ ID NO: 164144 - DNA, 793 bp, Homo sapiens
ctccaaaaagcaagcaaacaaacgcaggaagaacaagagtcagtgtctgtctgtctctctctctctctctcccccctcttctctgtctcttcccccccctttcaaatcctagcctcagcgtcactgctactgcaatagatttttaaaaaatgacaagttgtatttatgtaagttctaaatatgaactaataccattgaaattacaatgtctggaataaaataaaatgcaatcagcactttaagtaatctgcaaatgtaaaaacaacatttatgtttttgaaggcattattagtaaaccctgtaacaccagatagcttgctaaaacttatttttcttgggaaaaaatgttgccctagcctaccagattatttattttagaaggaatttgggaattaatcaggaaatctgtttgattagaaagtaattcttcattttgagagattttccaatgctcttaagaacatgcagcttcttagtcaagactagagagaaaaaaaccggtttaggattttgcagggttacctcatctaatccttctgaattcactctgggaataatgctattttatttacggggggcgggggaagaaaatacatttagaaaaatcaggggtttcctctctgtgagccaaatctgggttgccattcaaactttttctggctgcttttccatgcaggacagctgatcaataaagccaagtccagcctggcttgctacaggtttcaccagtcagtgcttgcaaaacctttgtcattttctaaaaataaaaaagctaaaagttattgtagaagaa

SEQ ID NO: 164145 - DNA, 473 bp, Homo sapiens
ggtgagtgaaactgcaatgctactttccagcagatgggcagaatcctcacctgtcccttggtcatatacaggtgtcaagactgccacaactgacaggagagtgagctcctcacatctagggatgagggagctggagagcttgtgccccatcccagctgacagggagtggggctcccacccatcctgctctgaggtctggccttggcccttaacaggaaggttcataaagctaaggggctggggacctggggtcacttgccatcagaccgcctcagggtggacagggggatgcccagggcagcactggagtacatggaagaccactgaaaaggttaagattgcacagtggcggctgggcgcggtggctcatgcctgtaatcctagcacttcgggaggccaaggcgggcagatcacgaggttggcagatcatgaggtcaggagatccagaccatcctggctaacacggtgaaacc

SEQ ID NO: 164146 - DNA, 224 bp, Homo sapiens
cttgtggtgtcatctaggggctggctgggaatggctctccttttggtctctccccaacgctagcatgacctgccttacagcatgtcagtctcctggtagtctgacttcctgcatggtggctggcttttccctagagctcaatagtagaaactgttagccttcttcatactggggtgcagaagtcccagaacattagttctgctacattcttttggtcagagcag

SEQ ID NO: 164147 - DNA, 683 bp, Homo sapiens
gtaaatttaaggatgtgtttgaccctcgtgcattaaaacagacaattggccgggtgcggtggctcacgcctgtaatcccagcactttgggaggctgaggcaggcagatcacaaagtcaggagatccagaccatcctggctaacacggtgaaaccccatctctactaaaaatacaaaaaattagccaggcgtggtggcgggcgcctgtagtcccagccactcgggaggctgggacaggagaatggcgtgaactcgggaagcggagtttgcaatgagccgagttggcgccactgcactccaatctgggcaacagagcgagactctgtctcaaagaaacaaacaaacaaacaaacaaaaccagacaattgaggcggccagctgcatttcataattcctcccataagcttcctcctatttgccacttgtttagcaatggaaatggagaacgaagatggcctcaaagtgactacatcaccagtgttacaaaaatgggccagaatttaaggcaagaattatatgtttcttaatagagggatgtttctctgtgtgtggctacttgtattcctgtggatttttaccagattataagagctgctaatttctgatcagaacagagaccaaaaattggagatatggatgtggggatgattcttttgggtaccgatagactgcaggaatcgcagg

SEQ ID NO: 164148 - DNA, 447 bp, Homo sapiens
  misc_feature (49)..(49): n is a, c, g, or t
cgtgagctcatggtcatagcatctctctaccttctgtgcaggacatatnatgctcaattcaatctgtgaagggacaacctaagttccaacctcccaattccaagccaaggttaaacattattaaaggggctgagtccagggtttaatttaaatttggccaggaaatcctattgaccctaccttcaaaatatatccagaatcctattaacgccatttctaccaccagggtccaggccacttcatctcttatcaggatttcttctatagccttctcttctcttctccttgttctacccttgccttcaatccactcttaacacattggccaaagtgattccttagaaatgtctcagttcatgtcaagtctctgtccaaaccttccaatgactgccaatctgaattaaggacagtctttccagtggcctctaatgctctccttccctcacc

SEQ ID NO: 164149 - DNA, 137 bp, Homo sapiens
atgcttaccctggggaagaaacatcctgagtgagacaggattgctgacctgtatcttaaaagagtatcctctagaagtagtagaacaagctattctgcatttttcttaacagttacaaccagtgggaaggaggtaca

SEQ ID NO: 164150 - DNA, 400 bp, Homo sapiens
gacatgtgtatgtgatcggagcctgatgctgccttgtggggctttcctgtcccactttttggtcactaatccagttctctggcccttcagccctcttctctttggggtgactgttacctctttgcctagctcctctgtgtcattgcggctcagtgtagctgagggctggggatttttctacatttttcatttggaggctagggaccctccctctccacacactgactccctgaggtttgggaagcagtggtgttttaagaggagctgacgtctggcactggctgtagtattctcagaggtcggcacaagcagaaggcgctcctggctgggataagccaggcctgcagcctcacacctggtcgtgagatttgggcctttctggggtggggccagcagagaa

SEQ ID NO: 164151 - DNA, 371 bp, Homo sapiens
agcctttaaatgtcacatggatttgaactttactattagatatctggagctaattaaaatattttcaaagcatgttttaaaagtgctctgaatagactgtgctctggatttacatgatgccatcctttcaaatatttcggagttgtgacataggctcttctacaatattcatcaatgaaaaactgagctacactcaagagcaaaagctggtgtttgggccacaaaacggtcacctccaagtgctccgcagctaggcctgccttatatatcagttcctaggctcattctggctattgccctacccatcctcagagtccaacctactcttttcctccttcatcttaacagacgtgtctacagtgaatttgtgt

SEQ ID NO: 164152 - DNA, 355 bp, Homo sapiens
attcaatttaagtgagtgggagcccaggtatgaaggattttttaaaagctcccagaggattctaaagctgagctaggactacagaccactgcaggcggtaaagtccccaaagcagccagccgggaaaacaacttttcttttccaccctgcaggctgtgggcagggcactccctgggcaaggtggctctcaaaggcagaaacctgcaggggagccctggggtcaaaagggggagggctatgggagatgagaagctggatctgtggactctctgaagtaagaatgcccttccccgccctcgctggcgttggccagtgtagacacctgctgctgcgtctttttccctttcactccaca

SEQ ID NO: 164153 - DNA, 406 bp, Homo sapiens
gctcattatgaatttaaaggtactcaaatgaggtaattttgtgtttgttgaatcactaacagtttaattatgctcagtattgtttgtacaaaatgatttttaaaaatggattctaacattttaaaaatggattctaacatcttaaaaatgtgtaacccattgtatgtatgatatagatagtaactctattattcagagtagttgattaactcaaatgccctacttcatatctagcagagaacaggctaaatttaaattaagcagcattttattagaatttttgaagacttgtattgagaaatgccaattaccagttgtttgtgagttgccaaaatattataatgttctgaatttacggaatggaatatgatcattcaaacaataaagcaacaaaaccaaaactata

SEQ ID NO: 164154 - DNA, 212 bp, Homo sapiens
ctccatgttggtcaggctggtctcgaattcccaacctcaggagatcctcctaccttggcctcccaaagtgctgcaattacaggcatgagccactgtgcccagccaaggtatttattttaaaatgagatgtaaattagaaatgtatcaagcatttatgagcagacaattagaatttttatttgcaaaacaaggaaataaaggcttacttcttt

SEQ ID NO: 164155 - DNA, 407 bp, Homo sapiens
ggatactgtgatacacctcccagaccacttttcaagactgaaagacctatccccttgcagcaggaatgctgcttttcggcagccctcaactgtgagcccctctttagtaattgcctggatgaagagaactgcctcaactaaggttacttttcctcccacaacagccgcaaatcattgcccatcttataagaaggttagaaccccagacattctgattgtcccaattcatggcaagtctgaagggccatcccagtttgagatctttgtggggctgttcaaggattccattgagaattggtcacagcccatcctcttcctgtgcccaattctgctttcttcctctcccttcccttccacgggtgttgatcaaacaagcactccctacctgcatgcttatctccatccca

SEQ ID NO: 164156 - DNA, 461 bp, Homo sapiens
ggcagtaccaggctgctgtgaaatccgggagaaggaccaggttaggcaaggccaccactgtggagctgaattcccacagggagaagaacagtgaggccatggatgcatggaaatggggtcgggcatgggagaagactagtgaaaagaacagtgaggccatggatgcatggaaatggggtcgggcatgggagaagactagtgaagtctgggctggggtgagcggtctttgcctggggaagtggatgtggagaagaagcaatgaagcatcagtaggattggaggtaggagcatgaggagggagacaggtgagaggctgggaagcaagatgggccaactgaaatgaaaagaatcaatattcaatccagctcacataaactatagattctttaaagacacatctccttgtggtcagattcaatgaaagaaataatattggcctgttgtagacacttcataaatat

SEQ ID NO: 164157 - DNA, 100 bp, Homo sapiens
gctactcactccagcggctactcctcactccagcggctactcactccagtggctactcctcactccagcggctactcctcactccagcggctactcactc

SEQ ID NO: 164158 - DNA, 125 bp, Homo sapiens
catctgcagggaaggtgagtcagggcaccttggagggtggctggaaagagaaggtgagaagatgtgttgaatccagcaccacttggcagacctacaactttacacatgacctgtgtgccacctag

SEQ ID NO: 164159 - DNA, 339 bp, Homo sapiens
gtgatcagattcagattcaagcagactaacggatagcagtattttccgttcaagatgatggacatcttatctttataaatgattataccggtccgtctgggagaacaagatgctaaatgttacatattccttccttctttcattggaagttcattggaaattttatacacgtaccatgcatacagagaagttcgtgcatcacaaagattcaactcgataatttttcacaaagtgaacacgtctataaccagcaccaagatcaagaaatcgaatgtcaccagaactccagaggctgcttgtgtctgttccagtcactgactcagaattttgtgatggcat

SEQ ID NO: 164160 - DNA, 328 bp, Homo sapiens
cacactgtcgcaggctgtcatgaattgtactgcacgtcacactttcctcagagtcaacaacgggtttatcaccgatacaagagaccagcaggagcctgaagcaagctgatacctctgacatgagcattctggtcaactactgctgatttcaaagtctttctatgactagccatgtaaaaggaaggcagagccacacaactggtctgcatgcaaagaaaagaatgatccaggaaacagatgcttgagcttgatcattagagtctgaactatcagtctttgctttttcactttctacagtgttgccccgggaagttactccagttctctg

SEQ ID NO: 164161 - DNA, 493 bp, Homo sapiens
tgtaagagcagaagaaaaagttattttctacacagtatgtaatggtcttattttgaatctattctaaacatactttttgcaatctttgctaacataaaaatttacattttctttacttatttaatttgctatatagccttattatcctttgtattccttggatactcagtggagatgaaatgtttattctctgaaaatagaaaagccatgtagactacagagatcatactgggtgactagagattgaatagtgcacaatatttcaatcctataaacatggatccttaacgtgtgacctggagaaaatattatccatgtaatgtcctctagtcttccaaaaagacttaacactcccttgagaaggagaacaacaataatcagttgagactggaactcaacaagcaggctcacattattaatatttttatttctaggctctagaaaaaaggctgcttctaattatactcaaggtccaatccattgtaattttttt

SEQ ID NO: 164162 - DNA, 423 bp, Homo sapiens
tgtagtgagttttaaaaaggggagagataatctggtgagatagtgagagctcagagaaggagctccctgcagaacgggaggggtggagtcctgccgcagtaggcaaaggggtgggagctggacaagttcattaggccagcaggtgacactggcctctcacttcatcaagggctgagcacacccggtgggagagacagtgacacggccctgagcgaaagtcacgtctcacactaacgggagagctggagggaagaagtgtgcagcgctctctctcgagcagcccagatcaatacccctagtgatgacttccctggcgcctgagaacagttacacaagcacatttagatactggttgccttagccacggtacccttctagaaagggtgggcagctgaggatggggagagatgaaggcatcaggga

SEQ ID NO: 164163 - DNA, 552 bp, Homo sapiens
ggcccaatcctcttatcataaacacctgcatgtcaattaaggcttgaactcaatgttaagtcaacacaaactcaagtcaatgctgaattgactccaatgtcaattaatgcttgatggtttgctatactcactgcattgggaacagttatctcaaaaatgaattttctgatgttctgcaaggagtgacctcggactgaagaccttgccacactgatgacatttgtaagatttctctccagtagggattctctgatgtctaatgaggtgtgaacatgaagtaaaggctttgcaacactcatcacacttgtgacatttctctcctgcatgaattctcctatgttttgcataggatgaagcttgactgaagaccttgccacagtcatgacatttgtaaggtttctctccagtatgagttcactgatgaactgcaaggtatgaacgatgtctgaaaaatttgccacatttattacactcggaagatctctcttcattatggattctccaatgatttgcaatcgttgtagcgttactgaagactttgtgacaatcatt

SEQ ID NO: 164164 - DNA, 509 bp, Homo sapiens
gcctggccaacagaactttatgtgtaggaatcctttgtgccgtggctgagggtagatctgttcagttttgtatttctgccagatgttgcaggtttattgccagcctgggactactttttgtgttaaatttttggcttggggatcctcagaccatgtagtagtacaattcaaatctgaaataatctgtgatcacacattattagaggagatactgttttcctcccacttcagagtttttattgtcactatgtgccagtgggctaatgttttttctaatctgttctccccctctgagggcgccagctttgtactggttctcagttccaattccctgtttcaggtgggcccaagatcaacaaactaccccactttctaggtcaactggaaaggcctgatctcatttactactgtggtttctagttcccgctgtcgtttttggtcccaggtgatcctccttgctttcttgcaagttcagctttgtaattaaaagtgattgttgtatagccagg

SEQ ID NO: 164165 - DNA, 517 bp, Homo sapiens
tgagaatgctacagtaataatccaggagggagatgatggtggggtagctttccaaggtcgggccaacaggattttctgatggattggatatggggttcgaataaaagagaagtttccaggatgattccaaaatggttggcttgagcaactgggaaaatggagttatttattaagatgggtaagaccaaaggagaggcaggcttggtcagttttggacatgttaagtaaggcatgctttttaggcttctaaatggagacattgagaggcagatggagctctgagtttgaatttcagggcagaaattcaggcgggagataagactatgagacctgcccatatacagatgatatttaaagccataggactcagagagataaccaaggagagtttggctgaagaaaggaagaggacttacagtgaatgctgcggctctccaacatttggaggccaggaagatgagaacaaagaataacgagtgaagtaggaggaaaatgaaggaattgggtattctggaaa

SEQ ID NO: 164166 - DNA, 468 bp, Homo sapiens
cgcatcaggaagcaaggcagagaggaatgcagtgatttaaaaactaaggccatatttgccttatcaggtattcctaatgcgaacacaaatgcacggtgattggcacaaaatatctttaaagacttctgtaggagttttattgttggaggatcttgggcaagttaatttatttttctgagctacaggtttctttgataggtattcaaataatagattactgttgaaaggatttattagtagacagagggtacagggagaagaattgcttatagactcatacgttccagatgagactgaattgcattgatgtaggtgattgggatgggaaaatactgtaaggtttttagaatcatttgagcgtaacaatactgttgtggaaaataggacaagaagaccgtgaggctattcagatatctcattggcccagatagtgataacagagcaagaaaatccagataaattagaaag

SEQ ID NO: 164167 - DNA, 437 bp, Homo sapiens
gaactggaggtcattatgttaagccaggcacagaaagagaaactgcatgttcccacttatttgtgggagctaaaaaaaattgaaacgattgaactcatagagatagagaacagaaggatggataccagagggtgggacggatattagtggaattaattagtggcaagggtattcttttgaaattggagtcagtcctcttaaaccctgcctctgctttatcaactaagtttatattttgtaaatcctttgttatttccacaatattcacaggatcttcaccaacagtagattccacctcacaaagctactttctttgctgatccaaaagaagcaactcctcatctgttcaagttcgatccacttttaattctcattgtcttgctgtttttaccacatcttcagttcttttctccactgaagtcttcaatcctcaaagt

SEQ ID NO: 164168 - DNA, 436 bp, Homo sapiens
gctgggactacaggcgcccgccaccacgccgggctatttgtttttagtagagacagggtttcaccgtgtgagccaggatggtcttgatctcctgacctcgtgatccgcccgtctaggcctcccaaagtgctgggattacaggtttgggccaccgcgcccggcctataccatgcttcttaaccatgcatcagctgatggtcattgggttgttacaatactttttggctattatgaatattgctgctgtgaacatttgtgcacatgtttttatgtggatccaattatttaggcttacagtatttaagagtgctgctttgctactacgctgactggggttaagaccaggctctgctatttagtagatgtgtgaccttgggcaagttacttaacttctctgtgcctcaagctcatctacaaacagtgactatgttaccca

SEQ ID NO: 164169 - DNA, 450 bp, Homo sapiens
aggaaagaagcgccagggcctaccgaaaaggagcagccttggtggaagcttgaaatgtctggctttgattctgtacctcgcctcttcccttggttcctgctggtggcttgtaggattatcatctcccactacgcattctctgaccgctgggaccatcatctcttataggcaagaccactcctaggcttgtctgcagtttgtcacagacttgggatccttgttatttgctgtcttgtgttacagttattaaggcatatctgccgtctccctttcaaattagtcaagagcaagaataagaccatatacatctttatccctggcagtgcgtactgattacaaatttggtatttagtaaatgtctgttgaatgaataagtgaatgattgaatctggaagactgaccttattttttttctcttgagtatggaattaaaagaaaattaacattttt

SEQ ID NO: 164170 - DNA, 128 bp, Homo sapiens
gtgtgtgtgcgcgcatgtgtgtgtgtgcgtatgtgtgtccagaggccactgatccagtccaagtgtatttagaaattagttcagtggctcacaaaggtcttagaggccactactgtgctggggaaatc

SEQ ID NO: 164171 - DNA, 326 bp, Homo sapiens
ctgaggtggctggaacagtaaacaggagggagagtgcagataagcaggggccacatcacacaggcagtaactaatgctattttcttttttaaaatgattactggacaggtagatgaaagaaataaaaacacactgttggagagaaaacatcatttctttttttaccctttttaggttcttagttgagacacttgaaaacaagcgtcagattaacaaaagaaaaacaagtttattaacatgctgtacccatcaagtgggagaggcctcagttcaaaagtatttctctctccaggcagtggcttagggaccttgtttaaatagtattt

SEQ ID NO: 164172 - DNA, 180 bp, Homo sapiens
gatcatgtcactgcactctagcctggtgacagagcaagactccgtctaaaagaaaaaaacagtaaaatacaaaatgtctttttctcctaaccttcttagccttctgctggtacttcaatttctgctggtactgtttggtcattgccctctaaagaatgatagcttcctaaaaaaaaacaa

SEQ ID NO: 164173 - DNA, 443 bp, Homo sapiens
aggaactttgctatgataaattataaagatcatgtcataaggataaagtaatgtgaatatttatagatacacattatttgtcctacttggttctttagtcagctaattgatacctatcaaaggttggcaaatttagatttatgcctgggtttgtcacttctactttaaaataacctagtgaggtttagctgctgatcattagtcacattagacattgttattaatacatcaaaaagttgtccttgtgctcagtattgttcaaaggatcatttttaatttgatttatgccaatgtgtttttgatagctaagatttcctaaagagagcaagagtcctcagttatgtattttggccaccacattgaaaggaagtgtcagcccaggtacaagcacgtgctttcactgattattgatggatttgtttgtaaagtacagttggagtcat

SEQ ID NO: 164174 - DNA, 322 bp, Homo sapiens
tgatcagcactgaaagtaattaaaatcacaggagtacatgagaccaccaagataagacacgagaccaccaagataagaggcggggcacacagcactggtggaagaagtctatgaagaactgagggggaatggtcttagaggaaaaagaaaacaaaaagaaggtggtcccctggaagccaaagataaagaaagtttccagaaataagaagagataaaacatgttaaagattcacaggcaggtcaagataaagaatacaaaatttccatcggatttagtttttcgaaagttactactttggagggtagtttcagggctggaggc

SEQ ID NO: 164175 - DNA, 282 bp, Homo sapiens
tgaaaactttggcccataactcaccagcttcctctccactacaagacactgccatggatcaggtcaatatccacatgtacagttgtccctcagtatccatggaggattgattccaggactcccgatgataccaaaatccacaatccataaatgctcaagtcccttatataaaatggcatagaatttgcatataacctatgcgcaccctcctgtgtgctttaaatcatctctagattacttataccaaatatgaaataaatgctatataaatagttcctatac

SEQ ID NO: 164176 - DNA, 185 bp, Homo sapiens
caaacatacatacatgcagtttctatcctctttcctagaaaacacgctctcatgtctcagaagcagatactagaaatttgagagagaaagagaagaagattatttaaattagatttttgttgtgttatgtgcttgatggtcaaaataattgagtcttgagtaatcaatatagtacctactgtaag

SEQ ID NO: 164177 - DNA, 487 bp, Homo sapiens
accggcccgatgcaagttaaagacagcaagctatctgctctgccctagtgcaaatgaagtctcaggagtttagaaatgtctgaggtgctttgacttctaatttaatacttttagggtttttgtatggtttttgtttttactctctgtgtattcatttgttgaaatagttaatatggtcatggttatgagagaataaaattcaacttagtgtacaacaaaatatggattccaggaagcttagagggtggctaccagtgagacaatgagcagtatccccccagtgtgggcagcatgtcgcacatctaaaatttgtggggtaataatgtctctttaagacggagtctcgctctgtcgcccaggctggagtgcagtggcgcgatctcggctcactgcaagctctgcctcccgggttcatgccattctcctgcctcagcctcccgagtagctgggactacaggtgtccaccaccatgcccagctaatttttt

SEQ ID NO: 164178 - DNA, 421 bp, Homo sapiens
tctttagtgaggtccatgtcgttaaatttaaacacaatgttaaagcaatgtcttcagtgcttttaagccatgggctaggattagtaatacattttaactctaaaattagagaaatagcccacactatacttctcattagttgcgggggctgtgtcttaatttttgttcaagaaaataggaacaggctaagaaatgtgaatgtttgctgtgatgttttgtgttgctgtgctgtggggttattttacatttttggagtcctgccttccatctggggcagggtttctcagtcctggcactactgacatttcgggtcggatgattctttgttgtggggagttgttcaatataggatgtttagcagcattcctggcctctacccattagatgccattagcaccaccacttccagtggtgataacca

SEQ ID NO: 164179 - DNA, 661 bp, Homo sapiens
ccatccagggtgcctgtttccctggaaggctctctccacccagccccataggaagtttaggctaagtctggctctcctacatcaaagaggctttccatctgtctcttgctctgcctcagaaccagggggcccagaaccccctcctcacccaaaagcccctccacagaaaaacagcttgactctgacttcttccatctggccttgctctattaggcgaggcaggagaacaaaatgcctctgccaccaggcttggcagcttttgtctatagagcacaggcagacccagccggtcctctgagggctcagcacaggccattagcacacaaagttgcatgtcagcccatttgaacctagggccacaggatcccaaagatcctgtggaggaggtaggactggagccaggcctgtaggctgttcctgaggccagaattccctctccacacatactcaaagactccccagttcacttgggcagcatgagagtggtgcattatggtgctaggctgcgttcagctgtctgggaagcgggtggagtatggctcagggagtggtccttgcccaaaggtacatggctgatggatgggggtcctaccccagagaagaagcctttgacctgtgacctcttctcccagaagccttccctgtgcacactggcccttcc

SEQ ID NO: 164180 - DNA, 442 bp, Homo sapiens
cagaaaattagcagttgtcttccagattcaggtctatccctcaagtataaccttttaattatgcttaaatcacatactggtccctcaggccattgtccaaattctaggcacagtagagtcaatgcagtctacacagctaaggaggtcacaccccagtcagcctcagctcttcggggaaaaaaatccagttctgttcacacctagttgatcagttaaaaaacatcaaaagagactgagtgcagtggctcatgcctgtaatcccagcactttgagaggccaaggcaggcagatcacctgaggccaggagtttgagaccagcctggccaacatggcgaaaccccgcctctactaaaaatacaaaaattagccaggcttgatggtgggcgcctgtaatcccagctactcaggaggctgaggcaggagaatcgcttgaacctgggag

SEQ ID NO: 164181 - DNA, 501 bp, Homo sapiens
cattcatgtcttgcttgtttctatgggctttcagcctttcactgtgaggcagaggagctgcttgatttcctgctgttggggactccgtcctgtcctgttggcggccctttatgtgacccgtcagcctgcatgcccacatgtaatgtcccggacattacatgtccctgcttgtgcacactgaaatcagcctggacccctccctcaaccgcccctagagcccagctctcatcagtagcattatcttcatgctctcctttgctcctgaacacacctcagcttctgctcccacctgactcagcggctctggctcgccggtgttgggggtgaacttaccctcctttctccctgctcctcccactgccccttctggtgggggcaacattctgagtacgcatcactccttctggcacactcacccccggcagctgccactgcccaacttgttgctggagcttcacctgattctgctggaggcctggagctcatctctcagcagctgac

SEQ ID NO: 164182 - DNA, 785 bp, Homo sapiens
  misc_feature (103)..(103): n is a, c, g, or t
  misc_feature (135)..(135): n is a, c, g, or t
actctagaggatcggttaggtctcgatcgttatgacctagccaaagttttagaaggtagctatttttaaagggccttcttaccacatgggctccatccacttngttcaaggccaaagcaatctgaaataaaaatnacagctcacctactacatggaattctatttcagagcatccagcaaatgttcacctcttgcttctcactggcgaaaatccacaaaagttcttataggaatagtatgtttaaaaaaattaaaaaagctatgcagaactggttctccatggtgctagcttctttcacatggaagtaattagaaataatccgacaatcattctatttcctcattttttgccatcaggcatgcaagtaaaactttcatatcaatctcttacaagcctaaaaaagttacagcctcaagaagtttagactactaataaagttaaatataaaactctaaaggagtgagcaaagacatagccactaagcagtggggttgtgatgtgatcttagttagttctgcctgacatcaaaagagcactaatcttcaatatgcacttaaagtgcacagtatacctctaccacacatgcaacaacctgcaatgctatagaaaactctagccatttccaaagaatgatgaaaggctaatacaagttacatagtcatttatcaatatgtattcaaaactctggcaaccactgtgggtaatgatggagaataagaaaaagaaaaagggaaaaaacgctggcaaccaaacacaaattattattaaatgtttattgggtgat

SEQ ID NO: 164183 - DNA, 158 bp, Homo sapiens
cttttgttccatttaaaatctaattcatacgctaactttttaaatataaaatttagaagtctttgtgatataatacaaaaaatctaaattcatactctatgacttctttacttcctaagggtaaaatgtattaatataaaatcagactactgtattct

SEQ ID NO: 164184 - DNA, 492 bp, Homo sapiens
gttttgcagagtgtcatatagttggaatcatatagtacgtagccttttcagattggcttctttcacttagcaatttttatttaagactccttcatgtctttttggcttgacagctcatttctttttattgctgaataatattctattttatggttttatccacttctttacccattcacctggtaaaggacattttgctttcttccaccttttggcacttatgaaaagaaactgttacaaacttttagatgtagattttgtgtggacataagttttcaactcataaataccaagtaacatgattactgtatcctatgttaagggtgtgtttgctaggccagtgtggtgactcacgcctgtaatatcaacactttaggaggctgaagtgggaggagtttgcgatcagccagggcaacatagttagaccttgtctttaaaaaaaaaaagaaagaaagaaaaaataagaaacaaagaaagaaagtaaaaagaaac

SEQ ID NO: 164185 - DNA, 352 bp, Homo sapiens
cagtgatcttcctgccttggcctcccaaagcactgggattacaggcatgagattctcttgacattcttgagagggcttctagggtgggtgaaaagggaaggaagttagaaattctaatgtaataatttttttttcttattttgtagtggccatatcctccattgaactgagaaattttcacacctaattgattcctaatagaaaatgaaatatgtattcccacaagcagctttaaaacatctaagatcgcaagcaaaatttttcattatagtttgcaaagaaaacactacattatttctcacttcttagttacaagtgatacattaatttcatcctgtctatatacattaag

SEQ ID NO: 164186 - DNA, 486 bp, Homo sapiens
atctgcagtggacagcctggattttaaaagaagagtggcatctttggaatctctactagaatctgctgaggttaaaatagacccagtgttttctaagtgacagaaaatagaatgtgcctagggatggcaaaagtgaaatgtagaaaacccacttggattggtctaaggaagtagatccaggcctgaaattccaagttccaggacttctagttttctttaaaacttttaaagcaaatcctgctttggaaaaaaactcaagtaatatgtgaattatgagattgtgaaagaagggtaaggcttggatccagtcagatttttggcctagaatatgtgacaattgagttaagagtaaacattgtggtgttaatgtacttccaaagaatatcatcgttgatatctgtgtacagtgaatgctttaaaagttctgggtgattgagacagtttaaattttttttaattatagatttacttattttaaaatgttac

SEQ ID NO: 164187 - DNA, 422 bp, Homo sapiens
aaaaaaaaaaaaaataacttttattttaagttcaggagtacctgtgcagatttgttacagaagcaaacttctgtcctgggggtttgttgtacagattattttgtcacccaggtattaagcctagtacccattagttctttttcctgagccactccctcctcccaacctaaaccctccaataggcccctaatctccttttcttataaagataccattcatattggattagggcccaccctagtgacctcattttaatttaattacctcattaaagaccctgtctctaaatacagtcacattctgaggtactgggggttaggacttcaattcaattgggatgtggctgagtggcacaattcagcccacaacagccatttctttaaattttttaaatttaattaaatttttaaatatttcaaata

SEQ ID NO: 164188 - DNA, 276 bp, Homo sapiens
tcagcctcctgagttgctgggattacaggcatgcgttgccatgcccagctaatttttgtgtttttagtagagacatggtttccccatgttgaccaggatggtcttgatctcctgacctggtgatcctcccactgtggcctcccaaagtgctgggattacaggcatgaaccaccacacctggcctctttgaggcatttcttaacaataactagttatatgtaagttagaatcaattcagttatgtaaactaatgaacacaggtatggaaaattttgc

SEQ ID NO: 164189 - DNA, 606 bp, Homo sapiens
ttaagtcgtatctgggtcatgaccttttcccctccaaaacaaggtgctaggaagacaaaaacaatagctactacgaacagtaggagtttataattatgtgctgatgtatttgaagatgttgatggtcgtgagtgtgtatcctcggaaaggccagctggactctgtctccatggttgctctcaccctagggacctaggaacagtccgtcaccacaaattacttttataaccctagagaagaaagtctccttgtcctcagaatacttcctgaagaacaaccagatgggaaggaccttgattgggactctttccagtgggcttggggcagagggaatttaatggctcacatagctgaaaaggcagggctagattgggctttgggctgcatcccagaactccaaacagggatctgtctcttcggctctcagctctgctttcctttgagttggctttattctcgggctccatggtgtggccccacagcaccagttattggtaaaaagagctcccatttgctgacagaactgctggatttagttctcattggtccacacgaggaaggtatccagcctcaagtcatcacatggccaaaagatggaatacactg

SEQ ID NO: 164190 - DNA, 425 bp, Homo sapiens
caatctagcttccaccacctgctatctgtctgcttcaaagcacagtatcttcatctgcaatataaacctgtcaattttaccctgtattatagttttaagtattactagcaataatacaggaggagtatctggaacatagtgccagctttaaaaaacagttactttgctgttgtcatgagtcacctatgggattccctatgggatcctgtgctgggtctggcctggagtggtcttcagaaaatgtagcttacattactcaactgaagctcagttgctctctgaaaacagtgtgggcaaggtggggattgggagaggaaaagggagagaaaataagaatgcgtccaacagtgctgcaatataaggatgttgttctgctcttttactcgtgaaagaaatgaaggctggcagatctacagcaactttaa

SEQ ID NO: 164191 - DNA, 281 bp, Homo sapiens
atggagaagatgcttcctacccaccaggaggcactggtttgtgcttccagaatcaaatcactatctcacttagccttgcttgtaaccaattacaggagctatttgggagctggccagggtcggaaacagagtctttgaaggaaggggatatcaagagagatcaggataactttagctgtaccatgaagcataacccactcctcagccaaaccaccagttttagcctggggcccgacgggcgcctcctccgcgggtatgaccagtccgcctacgacggcaag

SEQ ID NO: 164192 - DNA, 547 bp, Homo sapiens
gtatattttgcaaagactaatcaaaagaaagttgaagtaactatattaacatgagaaacaaggaattttgtagcgataagggaggacattacatattgatcaaagggtcagttcacaaaaaggtataacaattctaaatgtatataaacgcagcagaacttgcacaaagcaaaaactgatagaacagaaaggttaaatagacaaacctaccattgaatctgagatttcaacaatcctttatcaatgtctacatgttttatcaataactggtgtaacaagtagactgagaatcagtagggatatagaaggcatgaacaacatcggtcagctagacctaatagacatttacagaacgttccatctgacaacagaagaatatatgctttcaagtgcagatgaagtatttatcaagatagaccatattcttccatataaaaagaacattaacaaatttaaaagaatttaatgtcttctctgacaataatggaattaagctagaaatcagtaacagaaaaacatatttgtaatattcccaaatattaagaat

SEQ ID NO: 164193 - DNA, 416 bp, Homo sapiens
ctgtgtgcctattgtgtcccaggtactgtgcaaaacatagtatatagtgaataaagcaggcatggtctctgtcctcatggagcttggagtccatttcctctaaacgtggtcacttagcaaaccaaaagaaaaagataacacaatgccacacgaattagctcttacaacaaatggtgcaaatggtaatgaattagataaaaagattaacaggtttccataagacagaggatacatttaaaagagaatctttctagaattcattaagaacagcacaaaatatcctagataaccaatgagtaaagcaactacatggcaagttaaaaatataaagacactactgagacacaccaaaaaaaaactttgcagtctataaggtgaagaggattgggtttcactaaaaaaacagtaatactctt

SEQ ID NO: 164194 - DNA, 407 bp, Homo sapiens
aacctggttgtctgtaccaacacagataaagctcctgccttcagagtctccagtccttccccgtactgccattagaatgagcttggtaatgcgccactttgaccatggcatcgctgcttaaacagcttacatgagtcctaacacctccaggcgaagtccaaactcctgaacactgcctgatctcagaccacctttccagcctcatctcccaccagcactaattttcccaggctgctgtgtttagccacatgtgacagcagccttctccagtgggccctgcccctccactccttattcttcttattttatcttaatccacttcttcccctgctttcaagcacaggcacagctcacgtgcctctgtgaagccttccatgttcattgctccggcaccaccacgacacagt

SEQ ID NO: 164195 - DNA, 557 bp, Homo sapiens
aagaaaaatctatgaacttcattaaaactgggttccatgcttttaatggaaaacagagatggaagatgagacaaaaatgccatttcagtttgagcaatgcactttatgagactcctttgggtagaaagagggaggaggccactgaggtttccactgagtgtatattatagatttgttctctcctcctcacctcccttggcttttcttccatcattggggactgctgtaatcttgaaacagaatattttctcttagttattattgcattattaatattttctgtttttggccatttcttttgagtttaatttgcatatgtgtacatgggcaatgcttcaacgagacaatttttttaagtttgttctctaacatcttagatactagaagatatggattttggtcctgggagattatttaggtttttttcttattgtgttgttgcacatatacagttagcagtttttttttttttctgttggaattttagaaacaaggatccttcttgcggacggggtaagagtatgactgtaatcagagactctgggtgcagtttaggg

SEQ ID NO: 164196 - DNA, 2247 bp, Homo sapiens
  misc_feature (3)..(3): n is a, c, g, or t
  misc_feature (38)..(38): n is a, c, g, or t
  misc_feature (135)..(135): n is a, c, g, or t
  misc_feature (288)..(288): n is a, c, g, or t
atnacacgtgtgagccactgcgcccacccataactgtnttctgtgtatggttagggaaatcaatccctgtccttcaatttgaataggtttagactcctatttgtcatgtctttatcccagctaagtttatttttntatctaatgcaagtaaagtctattttttcatgaagaaagccattcgtcctatcaccagttcttgcatactctttccttttttcaggttcttactctgtcacccaggctggagtgcagtggcacaatcacagctcactgcagccttccacctcncaggttcaaaccatacgcccacctcaatctcccaaagtgttgggattacaggcatgagccaccacacctggcccaattagtttttgagtgccctgaatttgtttacttactatgaccaatgagttgtataccttaagatgttttctttttacatattagcatccttttctttcagattaaaaaacttcctttagcattttagtaggtctagtgttgatgaatcccctcagctttggtttatctgcagactttatcttttctttatgtttgaagaatacctttgcttggtacaatattcttggttggcaggtttttattctccttcactactttgaatatatcatatcattttctcctttcctgcagggtttttgctgagaatctgatgaaagctgtattagggccctgattaatgtgatatgtctcttttctcttctttttttcagtattctttctttgtctttgattttttttatcataatttgaagggtgttggggaattccttttgagttaatttgattagtaacttctatgtttcttgtaagtggatgttgttttctacatgtagatttaggaggtttttagctatgatttccttaaatatgtgttctaggtctattctcccttttctcattcggaaactcctattatgtgaaggttagtttactttaaatagtgtcccacaattcctgaaggtcttcttcaccatattttttcttttttctttttgctcctctgattaatttcatacgtcttcaagctgtttcctctgattatgtctactgtaaaagctttctattgagttttttcagttcagttattatattctttatttctaggatttatttgggctttaaaaatgtttctttatttgtcaaatatctcattgtatttatggattgttttccaaattttagttaattttctatttatattttattgtgattccctgaaaattttaaagtagattattctgaatttggaattcagacattttatagatcagttcttctgtgtccattatagagctttgtttatttcttttgttggtgtcatattttcctgatttttattaatccttttatctttatattgatgcctgtgaatttgaggagatggtcacctctttctgtttttgcaggtgttttttgtggtcttagatcattacaacttaatatcagaacttaattgctgtccagcttttgactcctgagtggggaggacttagtgtgtatcagaatttaaatgctgcactggagtgaaatcactgctctgccattgtttgttatttggaaaagacttatgcgagcaccagaacttactaaatatttcagctgcttctgggtcaggggaaggtgccacataaacacaaaaaaggactcaggcatttccagggctcataacctctgcagtgctatgagacttgacagtctcctcagcatggcattcctgctgagcagaatgcagagcagctaccaagatccacaggacagttgctgcaatcagctctcctgattttatcttcagttcactcaggtcattcagccctcctggaactctcagtgttttccatgggatgagacccatgtagacttcccatgaagcctcctcaactgatagggaaattgaatgtttattttcaacttcgaatttcttccaactcagacatcctaaatgtatagaaattttctgtgagctgttatgtggcttggggtagtgggtggcagattctaaaatcgtcatttatcagtcacagcttctctcatttctgcaggcccctcgttcctctgcttctctctcaagttctagtaacttcagggtagttttattgtctttgaatagttactgcttatacctttgtgggggaagcaatgttaagtgtcttctaatctgttatcttgctggacagattttgtaagttgtgaatataatgtacagctatccattagagaactaga

SEQ ID NO: 164197 - DNA, 2193 bp, Homo sapiens
  misc_feature (3)..(3): n is a, c, g, or t
  misc_feature (38)..(38): n is a, c, g, or t
  misc_feature (135)..(135): n is a, c, g, or t
  misc_feature (288)..(288): n is a, c, g, or t
atnacacgtgtgagccactgcgcccacccataactgtnttctgtgtatggttagggaaatcaatccctgtccttcaatttgaataggtttagactcctatttgtcatgtctttatcccagctaagtttatttttntatctaatgcaagtaaagtctattttttcatgaagaaagccattcgtcctatcaccagttcttgcatactctttccttttttcaggttcttactctgtcacccaggctggagtgcagtggcacaatcacagctcactgcagccttccacctcncaggttcaaaccatacgcccacctcaatctcccaaagtgttgggattacaggcatgagccaccacacctggcccaattagtttttgagtgccctgaatttgtttacttactatgaccaatgagttgtataccttaagatgttttctttttacatattagcatccttttctttcagattaaaaaacttcctttagcattttagtaggtctagtgttgatgaatcccctcagctttggtttatctgcagactttatcttttctttatgtttgaagaatacctttgcttggtacaatattcttggttggcaggtttttattctccttcactactttgaatatatcatatcattttctcctttcctgcagggtttttgctgagaatctgatgaaagctgtattagggccctgattaatgtgatatgtctcttttctcttctttttttcagtattctttctttgtctttgattttttttatcataatttgaagggtgttggggaattccttttgagttaatttgattagtaacttctatgtttcttgtaagtggatgttgttttctacatgtagatttaggaggtttttagctatgatttccttaaatatgtgttctaggtctattctcccttttctcattcggaaactcctattatgtgaaggttagtttactttaaatagtgtcccacaattcctgaaggtcttcttcaccatattttttcttttttctttttgctcctctgattaatttcatacgtcttcaagctgtttcctctgattatgtctactgtaaaagctttctattgagttttttcagttcagttattatattctttatttctaggatttatttgggctttaaaaatgtttctttatttgtcaaatatctcattgtatttatggattgttttccaaattttagttaattttctatttatattttattgtgattccctgaaaattttaaagtagattattctgaatttggaattcagacattttatagatcagttcttctgtgtccattatagagctttgtttatttcttttgttggtgtcatattttcctgatttttattaatccttttatctttatattgatgcctgtgaatttgaggagatggtcacctctttctgtttttgcaggtgttttttgtggtcttagatcattacaacttaatatcagaacttaattgctgtccagcttttgactcctgagtggggaggacttagtgtgtatcagaatttaaatgctgcactggagtgaaatcactgctctgccattgtttgttatttggaaaagacttatgcgagcaccagaacttactaaatatttcagctgcttctgggtcaggggaaggtgccacataaacacaaaaaaggactcaggcatttccagggctcataacctctgcagtgctatgagacttgacagtctcctcagcatggcattcctgctgagcagaatgcatcttcagttcactcaggtcattcagccctcctggaactctcagtgttttccatgggatgagacccatgtagacttcccatgaagcctcctcaactgatagggaaattgaatgtttattttcaacttcgaatttcttccaactcagacatcctaaatgtatagaaattttctgtgagctgttatgtggcttggggtagtgggtggcagattctaaaatcgtcatttatcagtcacagcttctctcatttctgcaggcccctcgttcctctgcttctctctcaagttctagtaacttcagggtagttttattgtctttgaatagttactgcttatacctttgtgggggaagcaatgttaagtgtcttctaatctgttatcttgctggacagattttgtaagttgtgaatataatgtacagctatccattagagaactaga

SEQ ID NO: 164198 - DNA, 1798 bp, Homo sapiens
atgcgggacacgctgtagaacagctcacactggctggcactgctaagcaggtgcggaggggagtcagagacccccggatggaggggtgtggtggacctcagttttgaggccgagagtcctctggcgccccccacagagctcctggagagactgcccagctatgactggcttcttcaagggggcagaggacagatattcttcccacctttggaggccccagggaggccccaggagcaaaggtcctggccctcgttcctggaacacaggagatgccctccccagttggactgctgagggctttaccactaccgtggcctcagtttctcgcctgcacgttgaggaggctggctggcccgcgtgagtccacaggcccttcccagaagcccccgcctctctgttcggtcccctgcagagtccctgcgatgacggaggaggtggcccgggaagccctcctcagctttgtggactctaagtgctgctacagcagcacggtggctggagacctcgtcatccaggagctgaagcggcagaccctctgcaggtaccgtctggagacctttagtgaatccaggataagcgagtggacatttcaaccctttactaaccactctgtggatgggccgcaaagaggcgcctcccccaggctctgggacatcaaggttcaaggtcctccgatgtttcaggaagacaccaggaagttccaggtccctcactcgtcactggtcaaggaatgccacaaatgccatgggcgtgggcggtacaagtgcagcggctgccacggggcgggcacggtgcggtgcccatcctgctgcggagccaagcgcaaagccaagcagtcccggagatgtcagctgtgcgcggggtccggcaggcgaagatgcagcacttgctcagggagagggaacaagacctgcgccacctgcaagggggagaagaagctgttgcacttcatccagcttgtcatcatgtggaagaacagcttgtttgagtttgtgtctgagcaccggctcaactgccccagggagctccttgctaaagccaaaggagaaaacctctttaaggatgaaaactcggtggtgtaccccatcgtggacttccctctgcgagacatctctcttgcctcccagaggggcattgcagagcacagcgctgccttggcctcccgtgcccgcgtcctgcagcagcgccagaccattgagctgatccccctcacagaagttcactattggtaccaaggaaagacttatgtctactacatctatggcactgaccaccaggtgtatgcggtggactatcctgagcggtattgctgtggctgtaccatcgtgtgacatagcatggctgtccccagagcctgccattcacgtttgccaaggaagatggccgacactctctgagtgtgttcactgttggctgcattggacaatcacatacaaaccctggcatgtccttccagaaaaaccagcttatcatctatcaagctccaaccccttatacagctcctctggtggaatccatgactcatatgtttaacctacaataattcagctatacacattcctgtagaacaaatgagagaaataatttaaatggcaaggactttgcctctggtctccaagttaatgccccgatgatgcgtgtgatttgattttgctttttccctttgtcggtcttggttctggtgtgcttcttctagtgggagcctcttgacgatctgagtattactgaaatgttcaaggatacacacaaatatctggccctaatgcacaataaatactgcacttaggcataaagtgca

SEQ ID NO: 164199 - DNA, 1898 bp, Homo sapiens
atgcgggacacgctgtagaacagctcacactggctggcactgctaagcaggtgcggaggggagtcagagacccccggatggaggggtgtggtggacctcagttttgaggccgagagtcctctggcgccccccacagagctcctggagagactgcccagctatgactggcttcttcaagggggcagaggacagatattcttcccacctttggaggccccagggaggccccaggagcaaaggtcctggccctcgttcctggaacacaggagatgccctccccagttggactgctgagggctttaccactaccgtggcctcagtttctcgcctgcacgttgaggaggctggctggcccgcgtgagtccacaggcccttcccagaagcccccgcctctctgttcggtcccctgcagagtccctgcgatgacggaggaggtggcccgggaagccctcctcagctttgtggactctaagtgctgctacagcagcacggtggctggagacctcgtcatccaggagctgaagcggcagaccctctgcaggtaccgtctggagacctttagtgaatccaggataagcgagtggacatttcaaccctttactaaccactctgtggatgggccgcaaagaggcgcctcccccaggctctgggacatcaaggttcaaggtcctccgatgtttcaggaagacaccaggaagttccaggtccctcactcgtcactggtcaaggaatgccacaaatgccatgggcgtgggcggtacaagtgcagcggctgccacggggcgggcacggtgcggtgcccatcctgctgcggagccaagcgcaaagccaagcagtcccggagatgtcagctgtgcgcggggtccggcaggcgaagatgcagcacttgctcagggagagggaacaagacctgcgccacctgcaagggggagaagaagctgttgcacttcatccagcttgtcatcatgtggaagaacagcttgtttgagtttgtgtctgagcaccggctcaactgccccagggagctccttgctaaagccaaaggagaaaacctctttaaggatgaaaactcggtggtgtaccccatcgtggacttccctctgcgagacatctctcttgcctcccagaggggcattgcagagcacagcgctgccttggcctcccgtgcccgcgtcctgcagcaggtgagccagggcggaggggccatctggctctgacgtctcttcctgggctgctgagccctctttcctgagaacgtcggagcggaaggatgaggacgtagagcgccagaccattgagctgatccccctcacagaagttcactattggtaccaaggaaagacttatgtctactacatctatggcactgaccaccaggtgtatgcggtggactatcctgagcggtattgctgtggctgtaccatcgtgtgacatagcatggctgtccccagagcctgccattcacgtttgccaaggaagatggccgacactctctgagtgtgttcactgttggctgcattggacaatcacatacaaaccctggcatgtccttccagaaaaaccagcttatcatctatcaagctccaaccccttatacagctcctctggtggaatccatgactcatatgtttaacctacaataattcagctatacacattcctgtagaacaaatgagagaaataatttaaatggcaaggactttgcctctggtctccaagttaatgccccgatgatgcgtgtgatttgattttgctttttccctttgtcggtcttggttctggtgtgcttcttctagtgggagcctcttgacgatctgagtattactgaaatgttcaaggatacacacaaatatctggccctaatgcacaataaatactgcacttaggcataaagtgca

SEQ ID NO: 164200 - DNA, 876 bp, Homo sapiens
ttggcaccatctcaagtataattcaaatcacgaggcatttgtgcatatcgacaatacacccatcgtggtgtggtggacctcagttttgaggccgagagtcctctggcgccccccacagagctcctggagagactgcccagctatgactggcttcttcaagggggcagaggacagatattcttcccacctttggaggccccagggaggccccaggagcaaaggtcctggccctcgttcctggaacacaggaagaaccctgcttcctccggggagtcatctctggcctctccagcccacagtgtctcttgtgctgccatccatggatctgaagacagacgggcccctctgtgtgccagggctggaggatgctggagatacaagtgtgcagaattgtggattaatggctctcagggctgccatggagaaatgcatgaagatgcaaggggaggaaggaggattctttcctcttggaggtgttggggccagaaagacttcagtaagggggtggcatggcctcagggaagggacttccaggaggagggggaggcatgcagaaagagggccgaggttagggtccctgtctgtcgtcccacccacggtcctcagggtgagtctccatgggcgctgccatcagccctgggccagtgcctggctggggtcttcccatcatgttgctagcagctcctctggctaaggtcaaggtacccgagggcaggagccttatttagcctgtctctgcctccttttaactgtgcgacatcctctctggacctctgtttttcttatctataaaatggtacaattcctctctaaggttgtgtttcttcagttgcaggattctatcagcttttctcctaagctccacatttcaactaa

SEQ ID NO: 164201 - DNA, 297 bp, Homo sapiens
aaaggaggttcactaagcagccaagcagaactgcctcagacaataaatgatataacaagggcacagagggatactaacctgcccaacctcagggtgaatacatgtggatggggtataatatgcctatcaaagcccattcttctctttgccctctaatctaaagtggaaaagtacgaagctatagtccataagcaccaaagcagtgggctaagattccaggtttgtttgagtctacggtaagtaaggctagaggtgctgagtaagcagacagagaaaacacattttccccttatacct

SEQ ID NO: 164202 - DNA, 254 bp, Homo sapiens
actccaaaaactgaactctgcatctttccggcagtgatggacatgcctcttcgcagccacttacttctgtcctgaggcgtgttgtcctggctaatgtccccctgtggttctaggcacacgtcaccaagtagtgctgaatcactgtaacttccatgccacttccaggagccttttggaaacacattcagaatggctacacttctcggtttctctattaataggatttttctctttcttcttttttttttaatggc

SEQ ID NO: 164203 - DNA, 158 bp, Homo sapiens
acccaggcctaagtgttgagagttttactgggacttcattacataggcatgattgactaattgtccatgtggttgatctcaaactccaggtcaactgatactacatcaaccagagcccccacccttccgatgagaacatggcctagagaaaaaataaa

SEQ ID NO: 164204 - DNA, 436 bp, Homo sapiens
ttgaactatgcattagaggcagggggaatagaatgagaaggtacataggttaagagcttttggttgaatatggtggcccaattcataagtgtgctgaaagcttaaaggaagggtttgaactttatcctagggatagtaatgatttatcatctgggaaatggcatcatgaagagtatttcagaaagatgaatctgatagcttaattaggatacagtagaaggagatcatagagcaaacctgaaactaattttatgtcatgtcttaatttgatatgtgagacgagttgccaggataaagtaaaaactacatttcgtattgaggttgatagtgtttctacaataagtaaaacactccaaatcttccataaagaagatttgtaatgttagagtggtaatttaaagatacttaaatacaaaacaggaatcctgaactcttc

SEQ ID NO: 164205 - DNA, 204 bp, Homo sapiens
tttttacatttctattttaaaatgggagtattacttatgtagagtaaagtgcacacagcctgaggaaatgtttcctgtgtgtacacctgtgtaaccaccatccagagcaaagcatggaacactcgtgaccccctagagcacacccttcactgagcaatactccccctctggggtcccccgctttctgactgacttctatcacca

SEQ ID NO: 164206 - DNA, 413 bp, Homo sapiens
atcttgaactcctgggctcaagtgactctcccacgtccacctcccaagtagctgcgactatgggctggagccaccgtgcctggctatttttttttggtagcagtgggatcttgctgtgttgaccaggctggtcttgaacttctggcctcaagtgatcctaccaccttagctttccaaagtgttggaattataggtatgagccccagtgcccggcaaaggtgtaactttataactagatctggaagaaatataatgttataaatcctgttctaggtttctctagagaaacagagccaataggagaaacatatatcgaaatgtattacaaggaattgtgttacttgatggtggaggctgacaagtccaagatgtgcagttggcaagctggaggcctgggagacccaatggtatag

SEQ ID NO: 164207 - DNA, 254 bp, Homo sapiens
aattttgaactctgggaaaaggagaccatcctaaaaatttgcagagagcaggaaaaataaaaagtccacccaaagaggagaaagagacaaaattccgtcagttttaataagcaacgctgaaagcaagagacaataaaaccatcagggtcattaaaataataaagaatgtactttcaatctagaattctataaccagccaaagcaggtctcaaaaactttaccttctatacacttgttctcagcataaagaggaa

SEQ ID NO: 164208 - DNA, 631 bp, Homo sapiens
acgccctctttcgttccctacctcagtcccattcttcggaggggaacagagttttccttctagaaaggtttactttttaagcgcagatacgtgtaccttttttctttttttctttttggcttgtttgttttttgagacggagtcttgctctgtctgcctcctgggttcaagcaattctcctgtctcagcctccctagtagctgggactacaggcgcatgccaccacgccgggctaattttttgtatttttagtagcgatggggtttcactgtgttagccaggctggtccccatctcctgacctcgtgatccacccggctcggccttccaaagtgctcggattacaggcgtgagccaccgcgcccggccaacgtgtatcttttcttgtatgtaatatgtgagcatactatgtgtatatactctgcactagtgtggtttcactttgtgtctgggatatatttcacatgaaaacggacaaatccatttcattctgtttttgtagtatgtattttctgaatctagtatgatttatttaaccagttcacacttgtaatcccagcactttgtgaggtcaaggcgggcggatcacttgaccttagcagttctagaccagcctgggctacttggtgaaa

SEQ ID NO: 164209 - DNA, 629 bp, Homo sapiens
agaagagagccctgctaaaataacattactgacatcctagggtgcctgtgcatatgcccaatgttgcaccttctgaggaacaacatcagaggctttacagtgtgaaggaaatagacttcactaaaataatccacccagacaatatacaaacaggcatacaacaataacaagccttggcatcagagggaggggagtgatatccagaacttctacaatatatcatctgaagcatttgttttcaacagaaattatgctaacgtcaaggaaacaggaaagtgtgacctatacacaggataaaaatcagtcaacagaaactacttgtgagagggacagatgtcagacttaacaaagacttcaaagtagccattatgaaagtaaggaaaccatgcttaaggaagcaaaagaagataggatgacaatattttattatgtagagaatatcagtaaagtggtagaaactataaaaaagaatcaagtagactttgtgaagttaaaaagttcagtaactgaaataaaatcactagagaggctcaacagtagatttgaactggcagaagagagaattgaacttgaagatagatcagcagagattatgaaatccaaagacagaagaatgaagaaaaatgaac

SEQ ID NO: 164210 - DNA, 364 bp, Homo sapiens
aggtagctgggattactgccatgtgccaccacacccagttaattttgtatttttagtagagacagggtttctccatgttggtcaggccggtctcgaactcccaacctcaggtgatccgcccgcctcggcctcgcaaaatgctgggattacaggcgtgagccaccgcgcccggccatctttcccaatttcttattatgctttgtctctaccggaagggatttcagtgtgggggtacagtcagggatcttttgacaagtacagcttaagctgtatttcattggaatgggggcatttccttcagggcctccaagtcaaaaaataatgataatattgttactagtagagggtcttgactgcaagttgt

SEQ ID NO: 164211 - DNA, 142 bp, Homo sapiens
aggaggataattctaagataatatccctctcccaaggagtatatgtgaactcagtaacaggagagtgctttgaatctttaaagtactgagtagctagcaaagagctgccatatgcagatctcaaccagacctgaccatttgg

SEQ ID NO: 164212 - DNA, 446 bp, Homo sapiens
agttgtaatcagcggtggagaaacacggatgggttttaaaacatagagcttcgaaaaaaaaaagtggtccgggcacagtggctcatgcctgtaatcccagcacagcactttggaaggccgaggcaggaggatcactttgaggccaggagtttaagatcagcctgggcaacatagtaaggccctgtctctacaaaaataattacacaaataaattccatctgatttgtttttgcccatttgttcagattcattttgaaacatgattatgtcaactatctacaaccattcaattgtgatgataattctctcgtcttcacccaaatcaataaattttttgacaggacagagctcaatgggagatttctacataccatttcctcaagtgacattgattaattaattaactattgtccggggcgttcagccacccgagattgagcaatctc

SEQ ID NO: 164213 - DNA, 221 bp, Homo sapiens
ctctagtttgtttcatcaggaatcacagctttttaaaaattaacagtagatgggaatgacatgatgatttcctcagaaaacataacctacttggctgcgagaccatgccaatgatgtggggtcagaaagacctggggccctgttctccaagccaccatttaattggggagggctactgacatggcaccattgaacttgagacctgccattcctccggtggc

SEQ ID NO: 164214 - DNA, 280 bp, Homo sapiens
gttcaaagagatgttattaatgcacgttagtagctctataaatgatttaaggttaaattatgtaaaaggatcaaatatttttcttttgttggaatatcctgatttttataaaccaatatctatggtaaaagttcccatctctagtatttttcaaagagatgtgaaaaataactgttgatacagaaagataatttagagcaaaccccagcaaacacaaatgaacgtacatacccacaaagattcagcctgccctcaaacactatcattagttgctgtaatt

SEQ ID NO: 164215 - DNA, 270 bp, Homo sapiens
acatttaagaaaaagcaggataataacctgtatatggaatatatggggtaaataatgaaaggctctatgtcacacttgcctccacgcttatgtatacatgtatctgtatgtgatacacgctgaaatgacactgtaccacatcatttgcattcagtaatttactttttgccatatatctgggaacttgtttgatttatgtactacagatttactcattcattttaatgactgcttagtaatcctttcttttctttctgattgacatttctt

SEQ ID NO: 164216 - DNA, 266 bp, Homo sapiens
tgctttcatagcatacatctctataaaaggacttatcttcgttggtaacttatttgtttacctgattctttcaatagattgagaattatttgaaggttcttacttagctttgaagcatcttaattagcttggtatccttgttgcctcattcattaccaggcatacattagaacttgctgtacactagttacagggaacaaaactaaaaccagaaacagggtaaagatcaagaatcgagcaaataccaaaaccatcgtggaagcaga

SEQ ID NO: 164217 - DNA, 329 bp, Homo sapiens
cactttcccaggttcagtaacttgcccatctgagccagtttctacaatggagctaaggatccccgctcatgggggacaaaatgagattgtgccaatcaagttctcccagcacctcgcccacacagagactcattctatttgggggaaaccgaacatcaggaatcaaatcataaacatgactgatcgtggctaggagtggggcacaggactgcagagaatctggctcctgtctgcaaggatccacaatttaattaggatatgtgacctaaataataataataataataataataataataataataatacagcaacagtaacaacagcca

SEQ ID NO: 164218 - DNA, 518 bp, Homo sapiens
tcttaaagctaataaagtgtctggtatacagtatatgtacaatcaatatgtgatgactgtataaattaatgaaatccacaagtgaaaggaaaaattgtacattttactctacgtagtgataaatagggatcaataagggatgcctagtaaataatcagtctttattacctcctcattaaagatataatgataatccctaatgagtgttatcacagttaatttgcttttttcttcctagttgcatgtggcagaattcctcttcttgattcaaaatcttattattcctcttactctgccggggattcaaatatcaatctatcaatttgtttattctccaaacttctactcaacagactccagaagtttttgatatgccattctagggttctaatctcatgccctgtatccgggttttctctgaaagaatatatattctggttttgtgactgtggtaaggagcccttaacctcttttggtggaataagtcccttctggtttagagtgtagactgataatgg

SEQ ID NO: 164219 - DNA, 429 bp, Homo sapiens
gaccatcagtagaatcattgcttccccgcttctccttgcttccccgcttacagtaattgcctcctcttggagaactgctaggtctcagaccacctaggaagtggaattgagaccctgtgagaccgatgcacaggctcccacccatgtggaaagctgcagccctgattaggtgtttggctggctgaccccaccacccttgggaccgcggtttccctgagtagcttgagctctggccctggtcacgattcagggttgttctgaccctctcagaagagaattttccaaaaccccaaacaacgacagctttatgggccagctgcactatgttccctttgagaggcaaccagagctcttaaatcacatgaaaaacacatccaagttgtgctgtggggactcacatcaggcaactggctgctctactcaattctt

SEQ ID NO: 164220 - DNA, 1005 bp, Homo sapiens
  misc_feature (792)..(792): n is a, c, g, or t
catcaaatagttaatgtactccagtgtaagctttttgaggtcagggaccttatttagtgtacttcatgtgcacatgataggctttcagatattgaaattactgaattagtgaccattattggtaaatagccattaatattaccaaaacctgtcctcttgatttttggagggtttttttcctgcttcaattagtgagttgcctgagtgtaaaggaggttcttgtaggtgtcagaaatagaacactgagaattgtagtcccatgataggctgtgttatattttttcttctgttttcaataatgtattgttagagatgtgaaaacaatattttaatgttggtatttattagtagtaaaactatatgaggataccatttatttggtaagaagacccgtggagttaaaaaataaatggctatggagcaaatcagcctttcctagggttgaggtaaaagttgatttgttccagccacccataccataaaactcctgattttcctgtttacttcttcccagctttatgtctttactcttctttgttcagcaccgaatcgttctctctcttttcttctcactcatccatccctgctttgtctctcttaactaaccatcttacacaattgcaattatttgtcatgttcatatacgttttaaaagcacatagattgaaagtgttgtctttcaagctttagggtgtgtatcgggggatgattttaagtccgcttttttatatgtgatggttctttactcattatagaaaagtgttaacactcatcaataaaatactagaaacntttctctaaagacattcagggtgggcctatgatagggatatttgggttcaaatccaatttatttgcttttattaattgtgccattacttcattgatgagattgtgtttgggctacatatttgaggggaggaaataaatataaaaaggttaaattgcttttgggcactttaaattgttcccctgaatatttactaagatgggtaacgtagatgg

SEQ ID NO: 164221 - DNA, 386 bp, Homo sapiens
agaggatccccggtcattcctgaccttctgcacactgacagcgcggcatccggggagattcgaacacagtcattgccccgtgtctcccttctctcccttggagcctggtggaccatgcatgccccgctcacctttccctcccttggggccagagtgagcgagtgtgacctgaggggactgaggagtgggcatcacacttccggtatagagagaaaaccacgggccctagtagaagtcacagcaagtttagactgggtcacacagcatgtgtagcatgacaagcagccatgttatcccagcaactgggaggcggagctaaccaaagccaggcagtttagaggaggtaggttagaccctctgcaaatgttacaggctgaggaaatgga

SEQ ID NO: 164222 - DNA, 352 bp, Homo sapiens
cacccaactgtgcctcttccataggcagcatgagtcaccatttttctggggcctaacattctgagttgacctgccacattggtccaccaagggcacaaccccagctcccctcagctctaagccccctgactttgggggacatcaggagtacctcctaggctccctgctccctctttcaatccagtcccccaccaaatctgttaagactgatggtccccagatgtgcagaggttaccatggaaaccaagcagccatgttatcccagcaactgggaggcggagctaaccaaagccaggcagtttagaggaggtaggttagaccctctgcaaatgttacaggctgaggaaatgga

SEQ ID NO: 164223 - DNA, 362 bp, Homo sapiens
ttgaaatttaccatcttaagttagccaagattgagtatcagggatggctttcctaataaactctcagacttattagaaagtttagcgtttagagaaatattttaatattttatctaagcttgcaactctcagactctcacctgagttatatgctaaaatgtgctggggattaaaaaaaagatcagattttctttttttccctgatatgtgccttgtggagagggaaccatgctgactttgtatcaagtgtagggagagcctgtgtcttttctgatgcagaaaggctgaacatgtccctaaagagtgaggttagtttttttgtttagtttagtttagtttttttttttttttttttttttttt

SEQ ID NO: 164224 - DNA, 598 bp, Homo sapiens
tgagaactgtcgcaggcaggaacttgtgtgctgtactctgaaggaggtgagtaccagtcgctgggtaattagggctgtgctgcaggtacagcctctcttgcttgatgacaatgatacagaaagaaaatcttgggaagggaaaaggctgccctgagaaacagccttacagagagtccaccagtattcttcctttagtacccagagcttctgttcacagtctggtttgtgagctccagccttgctgtgaaggaaaatgggaaaacatgtagagtgctcagggctaaccatctcccagaaacccgaatcagcagctctcccatttaccctcttggggcccaagctcagcttaaggatgaaacctgacacgcaataaggaatacagtttatttgggaagtttgggtgtttttcttaggcccagaccccagtctgtgggataacttttaaagcctgagggaattgagtaaatgaaagaggaaaacaatgttcttaggggttgtgggctctgctccagcctgcttctgatctggccctgagccacaattgccctggcaacaggagctaattggatacctaacagggactgccttccgccaccct

SEQ ID NO: 164225 - DNA, 418 bp, Homo sapiens
gcctacattgactgatgacatttcttaggacaattttggattaattatgaaaacaactactctctgagcaattgttgaaaaaaaaattaaaaagcaaactttgcccagaagattaggctttagttagtttgaaggcactgagtcagagtgtggtgtcaggtaaagggatgaggaagcattcaggtagaagaaactgcatgtactaaggttcctaagctgaaaggaacagaattggaaaaaacagaaagcaaaactcaacagaaatagaatgtctgggctgtacaagttagtagagaagaggcaagagttttggtgttaggatgaggttgaatcttagctctgtttcttactattcatgtacatttagacaagttatttaacgttaatgaattttggttttgtcatctttaaaagggaa

SEQ ID NO: 164226 - DNA, 140 bp, Homo sapiens
tagatctacaaaatataatagcacagtccagaggtttctattttttttcaagcagcaatcaggaaagactgctcttatcctcctacctcccaaatctgccaacatattcacatctgcatccttatactctgccttctctc

SEQ ID NO: 164227 - DNA, 142 bp, Homo sapiens
agatgtccacacaaaaacctatatatgaatgttcatggcagtagtgtttataatatgcataagacagaaatttcaacatagctaaaagagtgttttttgaatgtccagccactgttgaataaaaaaaatgtggtttttccat

SEQ ID NO: 164228 - DNA, 362 bp, Homo sapiens
tggacctggactcagatataggttttgctaattgatacctgtgtggccatgggcaaatatgctcatttactcatttgtgtttaacaaacacttatattgcacttactgtgtgccaggcagtaagtgcttaacacatgttaaatggatttaatccttacaacaaccctgtggctaggtactgtcatcatccccatgtttaaagaagaggggagtgggctgggcatggtggctcacgcctgtaatcccagcactttgggaggctggggtgggtggatcacctgaggtcaggagtttgagaccagcttggccaacacggtgaaaccccatctttactaaaaatataaaaattagctggtcgtggt

SEQ ID NO: 164229 - DNA, 370 bp, Homo sapiens
gacttaacatgctagccctctagtggtgctacggttgtttcagaaggaaacagcttgtgctgtctctgaacgccatccaactggatcacagcaccaaagaatgcactgctccatgctggagagctctggtcagagtagcacggtctctgagtcctcctgctggagtccctctggtccgatttgaattaaggccccatgattcttctttggttctttctaaaataactgatgagttaactgaaagtgagcatccatattttcttgtgtattgtgttatgtccttcccagtgcatgcagatacacacagcccctcatactgacatatacacacagtctcacgcatagacactcttggaatctcatgtgattt

SEQ ID NO: 164230 - DNA, 374 bp, Homo sapiens
aagtagtgaaagatgaagagacctgtttgccataagaagatggagggagaggcatttcagagccagggaacagcttgagagagaataacagagaatttgcaagagcagaatttaggctgtctcagttaattgcagtgtatggtatatagagaaattaaaggagagattctataaagagttaggaaagaagaaagaggctgaatcaggtaatggaaagacttgaaaggcttatttaaaagtttggacttcattgtatagctgatgacagattcttgaacctcttcttggagattcacatcaaaggtttcaaagtcatagaaataagacctcatgtgtgtttcaggtcggaattcttgcaagggtatgaaaaaaag

SEQ ID NO: 164231 - DNA, 247 bp, Homo sapiens
tgagggacaggcacctgtcccacacccagctaagttttgtatttttagtagagacggagtttcgccatgttggccagactggtctcgaactcctgacctcaggtgatccacccgctccagcctcccaaagtgctaggattacaggtgtgaggcactgcacccagccttacatctgtttttaagtaggttactgggttctggcagtgagggttggatatagctctatagtagctattatgtctcgtta

SEQ ID NO: 164232 - DNA, 288 bp, Homo sapiens
ttttatttaaagaatgaccaatctgagggcaatgacgggaaggaatcagtggagagcaagactggaagtagggagaacaactgagtggctgcttgcaagtgagaaatgatgaaggttgaaacgaggagcaaataagaatgaatggatacgagagaggttggggatacagaacagacagacctccacagttttgtcaggcatcttccctagtcatcttacagctggtccttagtctgaagattgtattgcccagaggtctagtcttctactgttgactctctccttttc

SEQ ID NO: 164233 - DNA, 241 bp, Homo sapiens
cgctggagcctcagggacaggacatggatcctgggctctgcccaggatgcctccagaggcccaaggatcttgcgtcatgacactctggagcatcttaaatgattctcaaggaaaaggcagcagaatgagtctcatgatctcagaatgagtctttatagtcttaggttctaaatataaccatgacgagaggttattagatttttaaatgcctgaattcaggctgggcatggtggctcatgaa

SEQ ID NO: 164234 - DNA, 374 bp, Homo sapiens
gtcatcgtcatagctgactctagaggatacaactccataaagtgagcccatcaattattaactattctagagcacagggagaccttagtaggacatagaaatatgggcattatacaatgttaagaaagaattaaataaaacagatgcatcacaaacctagtgcctaaagtgaagagaacacagttaaggatgaatagaatctggatttaaggaaaaagcagagaaagaaaatccacaaaggaaagctgagaaaaaaaaaacaaccataaagataggcaggtagaaaaaaaaaaaaaagttggtaatggaaatcaagtaacaagaggagcaattggccaagagagatttagacttattgactttaataaacaaga

SEQ ID NO: 164235 - DNA, 333 bp, Homo sapiens
gctgaggtaaggcaggaaggtcacttgaaccaagagttcaaagttacagagagctacgagagctatgatcatgctactgtactctggcctgggcaacagggttgagaccctgtctctttaaaaaaaaaaaaaagtttcataattaaaagtaaaaaatttaaagtaaaagtaaaattctggctgggcacagtggctcacacctgtaatcccagcactttgggaggctgaggctggcagatggatagcttgacctcaggagtcaagaccaggctaggcaacaaggtgagaccccctctccataaaaaacacacaaaaaattagctgggtgtggtg

SEQ ID NO: 164236 - DNA, 516 bp, Homo sapiens
aaaattatattttgaagttaaatctggtagtgttttttccaatatgaataggcctcaggaaagagataatacatttccttctttgttcagagggtgctcaacttgctggagtcatctctgctatggctttatttgccaacaacagagaacttgctctgcagcagccccaggctctctggggaccccacaggctatgcagatcccccaccccagaaccacagaaggagacagagcagaagcacaccccgtcttccaggcccaggacagctgctgagctccaggacacggactcttgaaggttgattttgactacttactaagctccagctgaaccagttccacttctttaaccttcccatgatccctgtgaggggtctgtggtattgctatttgcaagtaaagaaagtgagattgagggaggctgaaagacttggccccaagtcacaatgccctgctgttgatgttgaagcacccaggatatccaggaggcagcaccacattcagcagggcattgcg

SEQ ID NO: 164237 - DNA, 212 bp, Homo sapiens
gagcgtctgcgggggccgcttccaccctcagcggatgataatctcaagacaccttccgagcgtcagctcactccctttccaccctcagctccaccctcagcagatgataatatcaagacacctgccgagcgtctgcggggagcgtctgcgggggccgcttccaccctcagcggatgataatctcaagacactttccgagcgtcagctcactc

SEQ ID NO: 164238 - DNA, 249 bp, Homo sapiens
ttgaggcacgttggaggggggccagagggttacgcagctgcaggcgtgggccagatgggaaatccagatgctggcctagggagcaaggtcccttctgctgctcatgcaggctgtcaaagcagcagcctccttaggaccctcactgcaagctttaaaatgttactccttagggagaatttcagatgggagggaaggcttaatcaatacatgcaacgtttaactggcattagaatgatgttttgttttgtt

SEQ ID NO: 164239 - DNA, 309 bp, Homo sapiens
tcatcatggaataagagggtagactagaagacctctaaggcaccttcaaactcttactcataaagttggagaactgtacttttgaaagatctgcacaaacaagactacttggaatttctctggatattaaataaacccctaccagttctcagcactaggcagcaaggacaaaaagtcagagtcaaataaattcaatataacatgatagatatgtgccataatgggaatagataaaaagtgctataagagtccaaaagtagctgtagttgagctagtgataatgtggggtttgaaagcaaaggggaggaa

SEQ ID NO: 164240 - DNA, 349 bp, Homo sapiens
tcctttgcaggctgactctcctgtactccacatgaaatactggagtttctcaagcctccttctttgatctcctgcattctcactctgatactctttggcctagacaaccttatccccacacatggcttgaattatcaactatatccatatagcacacaatttatatatccaatatataggccccttctgagctctagatccatccatccaactacctatattctcttgggtgttctcaaaggcacgtcaaacacagtatgtctaagactaaactcacagtcctcatacctgaacttagtattcaatgtgatcttaaaggtcctgcttcttaatgctgttactccaaaca

SEQ ID NO: 164241 - DNA, 593 bp, Homo sapiens
cccgagtaaaacaccctctgttaaagatttatcacttccgctgtatttcagctgcctgtgggcatccctcaatggtgagctccgtgacagcaaggactgtgtctttgtcctccagatcacgattcatgctaaacactgctctgtccagaatttattgttttgtattttgacgtctctgtccagatgtctctctgggatcacagacggagagctctttgagcacatggactttgtcttgtttatctttatagccccagtgctgaacagactgtcacaccgaaggtgctcacgggcctgccggacgattgaagttgtacaacctgcagacagaggagctaagtgtccacacggccctccctgctctttccattctatgtagctatcttgctggcaccatttactcctttctttctttctttttttttcttttcttgagacagagtctctagctgtcgccaggctggagtgcaataatggcatgatctcggctcactgcaacctctgcctcccgggttcaagtgattctcctgcctcagcctcccgagtagctgggattacaggcatgcgctaccacgcccagctagtttttctat

SEQ ID NO: 164242 - DNA, 230 bp, Homo sapiens
attacattgtcattttccaggaagccaaatttctgtttgactagctatattattctgcaaattagtgtgtggcttgcattaagcaggaagcaaacaaaggatctttcacaatcagaattctaaggaattaaccagaaaacccttcccatctgttcaggatgtatttgagtaatctccaagtgagggaaacaaatcaaaagtgtgctgtacctgtgggaggtagaagaaag

SEQ ID NO: 164243 - DNA, 439 bp, Homo sapiens
acagatcatatttacttattggtttgtgtatttctaacgagtagctgtggggaatgccactgcagaaccctttctaattgccttttatttatttattttggccatagcgtgggtggcttttgaaattgcacgtaatttacggaggcgaggatcctgtgcctgggataccagatgatgtggctgaatggctgttggctgtttattggctagtctgtcgttaccaacacagtattcttgagttcagaggcacaacagtgttggatccccctcctctctcctatctaaatatatccaactagtcaatcagacttggcagccgtcagggctgtggctgtcagattgagttggccttggctcctctgaactatgggctggttttccaagctcgaaagtgtattcaaatagtgatatctaaattagacttgcaaacacacaccca

SEQ ID NO: 164244 - DNA, 388 bp, Homo sapiens
gttctgggattgctggactctcttggtgaagacataaaccagatactaccctattagcacattatgtttctatcctagaaggatagaataattacctcctgtggcctaatgagttctatgaatttgactgattaatggaacctaagaccactgacaggggcattgcaagacttatgcaaataatcaccaagtattgtggtacaagttaatcaaggtttacgtacaaggtgttataagaatttctgctccagttgttctggtttgggattggtgcttgtgaaaatgtgtagtatgcaatctaagcaacttcctcctccttacacctgaactgattttcctataatttcacatcatcataattaaaagaaaattttataattagaactca

SEQ ID NO: 164245 - DNA, 399 bp, Homo sapiens
gctgtcgttattctaatgtgagctcatccactgctgctgcagagtggtgatcaggagtcacagacaagatcggggatggtgtgtgtgtgcgtgtgtgcatacctctgtgcccagcacactaggtgtgtgtttagaatacggttgattatgctgtaatgtctagagcatttgcattagaatcgtcttgagtgtttgttaaaatggagacctctgggtctctagaagctactgactcagaatctctggggaatggtgacctgccttttataataaacatgctctcacgtgggattctgctgtccagtttgagaaccactcttctaaagaacttgaacatgtgttgggagactgtgcagggtgatagcatcaaactagaaacaacacaaacatccacagggg

SEQ ID NO: 164246 - DNA, 325 bp, Homo sapiens
tggatcatagagggcctgagtaaagtcattaaaaaatatcaaagaagcaagattatctattaataatataggttgggcattctctacctgaaatgcctggggattagaggtgttttggattttaatttttttttgttttcttttaggcagagtcttgctctgtgcaggctggagtgcagtggtatgatctcagctcactgcaacctctggctcctgggttcaagcgattctcctgcctcagcctcctggatacctgggactacaggcgtgcaccattacgcccagctaatttttgtattttcagtagagatggagtctcaccatg

SEQ ID NO: 164247 - DNA, 605 bp, Homo sapiens
gagtgcttcacttccaaatatgtggtcaattttggaataagtgtggtgtggtgctgagaagaatatatattctgttggtttggggtggagagttctgtagatgtctattaggtcctcttggtgaagagctgagttcaatccctggatatccttgttaactttctgtctcgttaatctgtctaatgttgacagtggggtgttaaaatctcccattattatcatgtgggagtctaagtctctttgtaggtctctaaggacttgctttatgaatctgggtgctcctgtattgggtgtagatatatttaggatagttagcacttcttgttgaattgatccctttaccattatgtaatggccttctttgtctcttttgatctttgctggtttaaagtctgttttatcagagactaggattgcaacccctgcctttttttgttttccatttgcttggtagatcttcctccatccctttattttgagcctatgtgtgtctctgcacatgagatgggtttcctgaatacaggacagtgatgggtcttgactctttatccaatttgccagtctgtgtcttttaatcagagaattcagcccattgacacttaagg

SEQ ID NO: 164248 - DNA, 549 bp, Homo sapiens
ctcccattttgccttccaatgatcctgcttatttccttcattgtgttcatcaccagctgtaattttacatttgctcttacttatttgcttattaaaaagtatttattgcactcttgctacatttcagtcactttcagatgcaatgataacaggaaagatgggatgcatgctctcaggatgttacatcctggtacagttgagacaagaaacaggaaacaccacagacactatgatgaacaattgcagacggtgccgggtgacagatgaggcagtaaatccaggcgaggggtgagggcagcttggccaaggtccataccactacttagtgcctggaaagcatgctccataaggacggggactctgtacctgggctgctagggcacccgagggccacaggcaggcaatgcacattcactgaagatgtcagtgggtattcctttctcatccgcccagcaccagaccctgagcccctcaagggaagagattacttataatttatctctgtatgtcctatacctgacccatagcaatatgagtgtgtcccccaaa

SEQ ID NO: 164249 - DNA, 293 bp, Homo sapiens
taagatagatggaaggatattctgagctacagaattattcactgatataaatcaaaaaggaatctagttaaaaataaaccgacctttaactgtgtataaggtaatttctgagcaaactcctaatgttattggaaagaaaataaaaaggtgactgtaaaaataatctaaattattaacacttattctaacccctatttctaacattgttctggggatatgtgcatgtgtatgtgtatacatgtacctggtgagagggtgaggagtgaagaatgagggagtagtactaataagct

SEQ ID NO: 164250 - DNA, 196 bp, Homo sapiens
atatttctacgtccatgttatttaatttatttctggacacacagtttgattcaactgccagacatattagaattattttgtcttctgaaatgacagttgatgacattctgattcacaactcctacagatatatctctgtcctggtggaaggagtccagtgtttgaagttaggagaccttatctccaacacttattt

SEQ ID NO: 164251 - DNA, 549 bp, Homo sapiens
aattaactcctaatcctcatctgaagactcaatatcctgttccaagatcacttgagacatgtgtcagctccttttggtcccaaatgcttgttctttttcatcaggcatctcaatatcccaaggagaaatcaaacaggcaaatgagaaaaatctgtggcagatctaaagtcagttaagatttactaatttcttgctcagcatttccttttgggacgctgttgcgcattagaatgagatatactgaaagtagcataaagacgcctggttccttttaacagaacaaagtgctaccagaggaagaaacaagtctggttatcccagctttcagtcttcatactctgttttagtaaatacactaacataaaaactacctatgtatcaataaaaatatatcagaataactatactattataaagtatccataacatttttctaattacctatagtttctagaggaagactgacatttatcaattcccattttaagtcattaaatctgaagttggaaagtcaaaaagatcacactccttctcacttgattgtgtata

SEQ ID NO: 164252 - DNA, 397 bp, Homo sapiens
gagtcggggcggggagggccgggcaggcttatgttcctgtgtaaacggagcgcacgtacctggagcgcggcgggcgcccgattagcgccctgaatggaggtgatgtaacggtgatgcaggctccagcccaccctcgccgaaagcaaggagccctgcctggggacaggcccgcgcgagagcgagcaacccagcgcgcctggctcagcctcggtcccagggagaggcaggccctgcgtcccggcccgggccccgccatcccagccaggaccgggcctggcccagcgccccgcgccgcgtccctcccacccccgcccgccccccgcctggggctggagttggccccaaacgctgcgctggagcggggccggcggcgagtcccaggtaagggctgctgcct

SEQ ID NO: 164253 - DNA, 477 bp, Homo sapiens
tatcttttctatcgaccgggtagtccctgttgcctagctttttggtaatttgacaaactcattctcaccttctcaaggccatgctttccttaatgtcccctaagcagaaatgattattctctttgtatgcttccatctaagtctgagtattcttcaagtaaatgcatgtaaaatagcatattactgaccctaagacctggaggcaagtaggatgaatatcaagaccttaaaggctcttgggttctcagctctgtaccccaggagactcttgggacccagcagagccaactgtcattcatactgaattaggggatttcttaaatggtttgctagttttcttgcataggctgttgtaatggcaaactgcatgtgtaccacctgtctgccaggccccctcatgggcatagcattgcactggtcattaggaagccccatctctgcctgccatgtttagagacaatgagaaacacctgttat

SEQ ID NO: 164254 - DNA, 268 bp, Homo sapiens
gggtctacgtgcagacgtggagttgcggggtcatgtggtcatccgtctacactgaacatttcgaggaacccccagacagtctccacgtggccacatcattctgatgcatggcagacgagcccgaaagaggagcttagtcccagagggttcttggctttgcccaggaaagaattcaaggtcgagccagaggtggaaggaaacagctttacttcagaggtggggttacagctgtggctgctcccgcagggcagggcttccacagacagca

SEQ ID NO: 164255 - DNA, 486 bp, Homo sapiens
gaaggtaccattgtcttgttccctttgagcaccatgtccaattttaatgagtcaaagaatacaacctgaattccattaaagtcaataactctgtatcaagtgcatgcagtactgaggaatacagaaaaaagaaagaatagttttcttcccctcagatagttcatagctgatcttgtaagggagtcaaacatacaacaaaataggttacagtcataacttcagagtagaaatgtggacaaggcacaaaaggcagtagtggtgagtagtttgagtgtgcaatgggagcttcccaaaagaagtgacatcttcaattgggttttgaggggagaaaaataagggttcaccagggtgacatttcaagaggaagaaaccagtttataaagtagtttgctttttctaacactatcacattgagttgaagtctaaactgttaggaggtagcattcatacctgtagacatgatgacccgtttatgtaaattcaatc

SEQ ID NO: 164256 - DNA, 450 bp, Homo sapiens
atgatccacccgcctcggcctcccaaagtgttgggattacagacatgagccaccacgcccagccacattttccatttctataaaatgagtgtaacagtttcttgcagttggttgtggagtttaagtgaggtaatttttacaaaaaagagtgctctccaaatgtttataaattaaaagaaaaatatcttctagctcagggcttcccaagcttctctcaagaaagtaccacctcctagttttttgtcaattccatgtgtatccttagtattactttttattgattgattttcctcaaacatattaacttgtttacttagatggtcactgtagctttatcctaagcaatacctaaatacaataaaattgcagatttttgtcctactgatattttactgcacattaaaatatgtaattatattagtttcaacaccagagggaaaaaaaagaaaa

SEQ ID NO: 164257 - DNA, 380 bp, Homo sapiens
acacgatgaagcctcagggctcggatgctcaggacagaggggtgagccagctcacagccccagggcagctggggctgccacgactatgaccctgacgttcatggacagaggtggggtggggtcacctcactggtgtccagaagctgtaacacagctcagaaatacgacagaaagcctccaaagagccttcacaggacatcgctgggagaggagagaaccacatctccaataaacgtgcatcagactggcaagctccagagttccaggctggaaacgacccaggactggctctgccacttaccagctgggaacccgggtggcaggcttaacgtctccaggctgcagctgctgtgtctgtagtgtagtggacagtgatacca

SEQ ID NO: 164258 - DNA, 497 bp, Homo sapiens
ggctggtggagctgtgacagtagaacccgcctcacggtgttggtgagaggcccctttgggggctggcatagtcaaatgcattgctgggcacctgccccacagtgtgtgctcgcccaggaagaacccaaacgcctagagtcctgggcactcggatgttgccctacattgagaaatgggcccttctgccacagagcatcctggctgcagcatcccagaggcctttgggagccttgacgaatcagagaagtgcagtccctgcccaaggctgcacaagcttctaagtgctggggagccaggattggagcccgggtctgcctcaccccaaggcgcctgctaacctggtgtctcttccatgaatcctgtgaccttcaaggtctgcagctgacatcctagcacctcagggccaagagactacttcttttcttcgctgcttcaggcattcttgggaggtacagagaggtatcagggaggaggacagtctaggtgtgacttctcag

SEQ ID NO: 164259 - DNA, 238 bp, Homo sapiens
agcattgcccagtttccctgttaggttagaaagcccagttccagagagacagtgtgaatcacagaccctaaacttggacccacactcccacagcatcagggcacacatgctgactcccataagagccgtgaaaatgctaggagctaactgggtcaaccgcgggagggggcagctccacccatacatttggccttatccagagccagtgacatgaggcccaacagttttctttgcatta

SEQ ID NO: 164260 - DNA, 529 bp, Homo sapiens
ctttgtggaactcttttcagaagaaaaaaagagagaaagtgggggccatacttggcactagtaacgatgcatatgcacttctgaaaagaggtgtcaatggaatgtggctcagctagatgtttactggatgggctctctcctccttccttccttagcccttctggtgggatcttgacatgttacagaggaaatgctaattgaagccccagccacaaccacttctgtgctctgcttctgcctgaaggaatgaataaatagaaaaacgggaacgttactttccagtaattttttaaatggatctcagtggcgaaaagtacgttaagttagcaaacgtgcctcacatactgtggatgcctgtaagactcttacattcgtctgcctagatgtatttcagaagccaataaaagataatctgtgtttgttgaatgaatgaagaaacccagtctaccgtgggtttaccatgtgccaaatgcagagctacaaaaggaaaaatgacaaagaagacctacgagatctcacgtccagtggc

SEQ ID NO: 164261 - DNA, 281 bp, Homo sapiens
agccaggcatggtggttcatgcctataatcccagcactttgggaggccaaggcaggaaggctgtttgagcccaggagtccaataccaacctgggcaacatggcaaaaccccatctctacaaaaagatataaaaactagctgggtgtggtggcatgtacctgtattcccagctacttagggggctgaggtgggaggactgcttgggcccaggaggaagaggctgcagtgagccactgcagtccagcttgggtgacatagcaggaccctcccctctcccatcc

SEQ ID NO: 164262 - DNA, 262 bp, Homo sapiens
aaactcacactgatagaaaagggaagatactgtattaatagcacatcaggtcaaaaaattagaacataagaatgataaaaaccatggcaattaattcaacgccctatatatagtctatcctgtaaatataatttgatttgcacagagctgctcagctggctattagtacagcgatcagctcaggtcttctaggccagtccttgctttgcagcacgatgccttgtaagaacaattcagtggctacaaaaccttggaaatagta

SEQ ID NO: 164263 - DNA, 421 bp, Homo sapiens
gcaagaacgagatgaagccgttaaacaactggaagaatttcagaaaatttctcacatggtcatagaggaagttaatttcatgcagaaccatcttgaaatagagaagacttgtcgagaaagtgctgaagctttggcaacaaagctaaataaagaaaataaaacgttgaaaagaatcagcatgttgtacatggccaagctgggaccagatgtaataactgaagagataaacattgatgatgaagattcgactacagacacagacggtgccgccgagacttgtgtctcagtacagtgtcagaagcaaattaaagaacttcgagatcaaattgtatctgttcaggaggaaaagaagattttagccattgagctggaaaatctcaagagcaaactcgtagaagtaattgaagaagtatgtatctca

SEQ ID NO: 164264 - DNA, 274 bp, Homo sapiens
gggtgtggtaatgaacatcaggtgtatttggctcaagacttctaaacttggggaagtggaattttgcttttatccacttactggaatgtgtttttacatttctggtatttttaaaaaaaataacttaagaactacgttatttttttattccttatttggaagctatactggtcagcataagaaaatacttaacttaagatcttcaaaggcatactgtagaggtttggaaagcatttggtttggcttgaagcgagtttggcgagtgaagtgacag

SEQ ID NO: 164265 - DNA, 139 bp, Homo sapiens
aggtaattctgtcaacaacattttgagataaattctgtaataaccactcttttacagatgaggaaactgaggccaggagagattcagtatcttaataaaaggcagctagaaacagcaaagtcaggattcaaacctatgc

SEQ ID NO: 164266 - DNA, 339 bp, Homo sapiens
gggttaacagcctgtaaacacttaagttcacaaacgctaaggaccatttcctcaattctcaatccaaagaagtaaccacagagccatagtctttccttcccttctaccataccttgggcttcatttactattcctcctagcttataatggaatggagagtagtataaaagcataagaaggaacttattccatgaagccaaccatacctcctaggtttctcaaaagatcctgatttcaaatatttgatcataatgtcattatcataaatcactgacaatattaactactgagtaaatagtttaaaaatttccagtgctcatggaacactttccaatgaaa

SEQ ID NO: 164267 - DNA, 518 bp, Homo sapiens
tgcccccagcatctatacaaagataacagcctctgggggctagcacctcaatggcaggtgggctgggggcacaggtgacccctatttcctacctggggaacccctgacaagtcccttcagacctgcttctaaaggttgcttgccagcccctcctcacaccccacctcctgcatacccaccctcacaattgctaagctgaggcccatggagattccaggataaaacagagaaaacagctgggcatggtggctcatgcctgggaggccaaggcaagcgaatcccttgagcccaggagttcaggaccagcctgggcaacacgatgaaaccctgtcatggtggctcacgcctgtaatctcagcaatttgggaggctgaggcgggcagatcacctgaggtcgggagttcgagaccagcctgaccgacatggagaaaccccatctctactaaaaatacaaaattagccaggcatggtagcacatgcctgtaatgtccagcctgggcaacaagagcgaaactcca

SEQ ID NO: 164268 - DNA, 532 bp, Homo sapiens
cattgtgtgatataggctgtatgtgtgtgtgcatgtgtgtgttgggggaggctgaaatgacttctttccctaaatgtctctcccatgccaaaagtttttccattgattatttatttttatctctttataagacaattttttaaaatatcagaaacagcaggagcaatcatatgggtctaatcagtcattgacgctttcgagtctataaatctttccttgtagcaggttctgaggaaggtagggggagattgaaggaaaacaaccccttcatattttagtccaaagctgttgttcataggttattcatctggtggcccaggtgctgacacagtgacgtgctttcatgccagttccacagccaaattgcaaccatgtggaagctggaagcgtcttgtcatctcagaattgggcacatccagtggggtaaaatctgaagccagaggggcagaactaagctcacagcatctgtttactgagtttgggattagaagaattttgatttaaatgtgcactatcagtagttgcttgatga

SEQ ID NO: 164269 - DNA, 385 bp, Homo sapiens
atgtttatgacagtacctgatatgtactaataactaaatatttcctgttatcattttcattacacgtacatcattagtgcagctttataaaggaaatgaagtgtgacccaagaaaactgtgttttcttcttactattaaggctgtacatagatatgctgaaacatgaaaattactatggattctactttaaagaaaaaagagtggggatactgctgattgttgaaaccaaggaaagggtgattcaaagtaatagaatcagtagctataaaaattgtgatcatgtgattgagtataaatgataaaaataagaaaccaaaactagaaggtggggaaagatgacaggatgcatggtaattattttttcgatgtaggtaggaaaacact

SEQ ID NO: 164270 - DNA, 448 bp, Homo sapiens
ttcacagggtggggcaagatactcctcatcacctgctagggtctcctgctgctgcttctggccataggattttcactcaggaatgggaggggtttaggctatcactggtggttctccaagctccctcatcagcactgttttccgccgacatgctttcagatttgtactcaatttctcccagtgtggtccctgcctcatctgaatttaaaattctagctccctgcatgtggtctccttgtgttcttctttccagacttggcatctcagcagagccatttctgtttttgggtactcctccttttgaggatgaacccaccatggtggacatttctcctttctgccttcgcaggactgactgttctttccccagcagctgatattgagtagatttccaatacaagttgaaatgttcttaaggtttaagaagtaataagatggtgcagagtca

SEQ ID NO: 164271 - DNA, 338 bp, Homo sapiens
gcaggatgacggcatgaaaacgttttgcaaataataaaaattcagggtggcctactgggtaacaacgtgttaattttccacagagtaatgcagtttcctcttggcacaacaagactgaaatatttgggagggtcgcacatttcttggatgcagaaatgatagttctatccatgagatggcgcagttgaaatgtcattatcacttctaaaccaaaatgctcacaccgttcttcttcatttaaatttttatctcgatgaaaattttgcattttatactgtcatagaccacattagaaatgtgtatttcactgttttcatacttgattttatgaacaattt

SEQ ID NO: 164272 - DNA, 350 bp, Homo sapiens
agctttccagctgcgtggccttgggccgtcttactctctgggcctcagtttcctcattggtagcatggagcactgaaagctacgaacaggagctgtgagggtgaatggaggattcatgccagagcctggtgggatgcccctgcagagcagatgctcaggaaaccctcctgccagctcctggggagcacgggaggcgctggctccttagttctctatggaaggacggttctgcaccagatattattattagagtctcttatttggaattctggacttgtgtgctcgacaggggcctcaagtccccagtgtcgctcaatagtgacaaacccaaataaaagatcctggcaaat

SEQ ID NO: 164273 - DNA, 268 bp, Homo sapiens
gccaagacgagatgagtgttgggcctttgtttttattttttaatgggtaatttcaaatatatatgaaagtagagaggatggttcagtcattcctcagtatctgtgagggattggtctgaggaccccctgtgaataccaaagcctgccgacacttaagtccctgctataaaatggcacagtatttgcatataacccatgcacatcctcccacatactttaaatcatctctagattacttgtagtacctaatacaatgtaaatgctatgt

SEQ ID NO: 164274 - DNA, 380 bp, Homo sapiens
aggtgtgtctgttatctaatccttagggagagactgttcttctccccgttttacagatggagaaactgagacgcaggaagattaagcacttcccgaggtcacaacagtgaatgttggagctgggatgtgaacctgagcagtctggctgaagagtctgctgtattcaccacacagacgctctacttttctgacatccctcttagagccacaaagatgccattccttgccctcaggaatgctcaaggttccccccatttcctccagaattccttccttcttctcttcctcttctgtccagaggctctaaggactctcactcactcatcctctttcccaggggtacccctggccctgccccagtctccagacccacactcaca

SEQ ID NO: 164275 - DNA, 960 bp, Homo sapiens
gggggctgagggccaaggctgcaatctcgggggaaggggaagttggcttttcctggtggattggaaacatcctcttggaggcaaagacttttcctggatcttacagacttcccgggatttttagattagaatattgggggcaaaggaggctgtcttgttttaaggcaatgctacatagacacagtggggaagacctggttcgacggcagataagcagtgggtgatgggcttgaggaggagagtcagggcaaagtctaagactgagcagaaagaaataccaccatctcccatggataagtacgttctagaacattctctttgggtctaatactctgaaatgacatcttgtcttcatgctcgagagagaattacttcactggctccacttggagtgccagtgttcagacaccaagcctgactgggagggttccgttttcttaacaccttcccaccgccgacttccaagtccccacgcgtttcacatgagggcggaggagagtctcgttgcagggtttcagcattccaggcactacggtaggatttttgtggtaaatacaacttttcatcctgagtgctggactaacgtcctcctgaaacgagaagctcggtcccttcaggattatcatagaaaacttccgacttaacctccccaggtcaggaggtgccacttcgaggtggggcaagagctggagcagccccttccagctctagtcaccatctctgcaggctgctaggcctggggcgtccgtgggtggcaggtgccaaggcttccaggcgaatgggagctctggcctggtctttttagtctgtgccctttttccttctttctttaatgaagggatgtttgcagtcactgccatctctaagcaccaagggggctcaccaccccgcaggacagggagagcgggttttattttgcaaaccgactaacgagcacctgggagacattcgccagcctgc

SEQ ID NO: 164276 - DNA, 230 bp, Homo sapiens
ctggcatctatggtgtttatgaagtatctcctgtcattgtattgtttcctttctctggtagcttttcacattttcttttgattcttgatgttctatcttacaaaagatgtgtcaaggtatgaatttactactttttgttttgttttgttttttgagatggagtctcactctgtggcccaggctggagtgcagtgctgcaatttcagctcactgcaacctccgcctcctag

SEQ ID NO: 164277 - DNA, 259 bp, Homo sapiens
tgatctatctgaatcaccactgttcagttggcaaagtgaaaattactgaccgtgttttatgtatcttcaaaaattcagacaaatttctgtgataattgtagtaggaattcaaaagtggtaataagtatagctgaataagaatctttttcattgaataaaatttcaaattttttgatttttgattattttttaagagacagtgtatcacccatgctggggtgcagtggcccaattatagctcactgcagcctcaagctcc

SEQ ID NO: 164278 - DNA, 384 bp, Homo sapiens
gtcttgcatggcagcaggcaagggagaatgagagccaagtgaaaggggaaacctcgtataaaaacatcagatctcacggacttaactcattacaaggagaacagtatggggaaaccaaccccacgtttcaattatctcccactgggtcctttctgtgacacatgggaattatgggagttacaattcaggatgagatttaggtggcgacacaggcaaaccaaaacttttggggtctttgctatagaattggaagcttatggaacctgggtataaatgagcatttcatagattaccaggactgactagctccaaatcctctctctcctggtttagtcagttccccatggagctcctaaatccaaggtactggcagagtacactaca

SEQ ID NO: 164279 - DNA, 344 bp, Homo sapiens
caggcaaaagcttggtgtttccatcatgacccacttctgagtctcctaagctcagctgcctgccgcatgcatgggtactcagctccaagcagctcctctgcttccttctcatcttcctgggtgtgagcatggaaaccacgttggacttggaatggtcagattggactctggtctgcctttcagtttacaaactgggtcaccttggacaaatcctttaaccccttgatcttttgtttcctagtcagtgagactgagatggtgttgttatgaggattagctgagatgacacattgctagcatatagcactgtgcctggcacatggctagtactagttaagttatga

SEQ ID NO: 164280 - DNA, 284 bp, Homo sapiens
ataaatgaaatggaattatggtcacctgaacttaattacttttaacaaagacaaatttattggttttcacatctaaagggaattcaccaagatgctgccaaagaaagagcatatttattcccacttcctgcatagtcttaaaacacttgaaatgttgtttttccaagagtaattttcaaatacagtcatttctctgtattcatgggggattggctccaggaccctccagaataccaagatcctcagatgctcaagttccttatataatacagcatagtatttat

SEQ ID NO: 164281 - DNA, 262 bp, Homo sapiens
tggctctgctcctctttctggagaggagattttatggcctcagagagtgtcacccatgcaaaagaggacacacctgagagcctgaatgaaaagctggtgccacctcctgggcgcccctgctgccttctccaaggaggctgtgacccaggaaaatgtgtgcggatggaatgaaggagaatttgttcccaaatccaccctctgttgtttcacacctgtcttaagccccgacacatattgagaccttctcttactcatgtgggtg

SEQ ID NO: 164282 - DNA, 327 bp, Homo sapiens
gccagctagcttaatgttaggtttaattaataaagggtattgaaagaccactgcaaagcaacagagggcttcccttcctggtttcaacatgattttattccacctgatacccagtgggtctgtgtgttggaagcctgatagtgctcacctcagggaccatcaaggttgactccagcccacactcactctctgccaaatttcttaaccttccagtaattcacgactataaaccagctccaggtcagtactctggcaaatggtattgccatgataggttgcatgttcctgtggcagccaaaccctcaccaaaaggtctgaatctcaggc

SEQ ID NO: 164283 - DNA, 154 bp, Homo sapiens
tttaaacagagagggccttgaatcaggaatgaacatagatttggagatcagtaagagtttaggtcagggatacagaattagaggtcataatcttagaggagatgaatgaaactacgggacttgtaccaagaagatagcatacccaaacatggat

SEQ ID NO: 164284 - DNA, 244 bp, Homo sapiens
aaaagggaaggcctgttgcatggagcagcttgagtagaagtggaaaggtgccagcggttgtggattattatctgatggcctagttctatctgatcagccagtccgtgggacacaggatcaccttgaccagggaggatgatatatttggggagagaaggacatagcacagcacagttgagcatccctaatctgaaaattcaaaatccaaatgcccctaaatccaaaattttttgagtgccaatag

SEQ ID NO: 164285 - DNA, 343 bp, Homo sapiens
gtgtggtgatctagaggatcccattaggcgcgtctgcgtgcctggcctaaatttaaaaatttttttgtacaggtggggtctcactatgttgcccaggctcgtcttgaactcctggcctcaagagattctcccttcttggcctcctgaagtgctgggattacagatgtgagccaccatgcctggcctaattgttttctttcatagcacttaccaccagacagtagagaatatgcttatatttttagttgttttcccgactaagtttcacaagagtaggggctcttgttttatcaactgttgtatttctaatgcctacagtagtaccttgtacgcagaaggtatt

SEQ ID NO: 164286 - DNA, 525 bp, Homo sapiens
ttaataatagctttgttttggtttgagtacacaaaagaaaaattcagtcactgacatggaattaggacactaaagcagtaagtcattcaattgtcttctgcatcaaatgctagctttattcttctgttagttgctctccctccccttttaaagctctctgtagttcccatttcagcagaagcttttttccctcctctggcaggcagacctgtccttgaccctgacctcccaccttgcagagggccagtccgtgaggatgtgtatggcccttcctggcactggagagtaaatttctgtccctaaagagccaaggaggagaagctttggctttttaagttgctgatgataatgtcccaggcagagggcagggaagttaaaaacaggtagtttgggaattaaggggttaaagcattagtgctcacagctccactgtttacgcatcactacattttacagaaaataggttgctttaatcctagggaaactggtcattgtatattttgtggtttgaaagttgttggagac

SEQ ID NO: 164287 - DNA, 400 bp, Homo sapiens
aggcgtcgtgcctgtcttgctagtggggaaactgaggctcagagaggcagaagacttgcccaagatcacaccaccgggacccaggattcaagcgcaggcctgcccaggctctctgtggcctcctggctgcgaggaggcagccagggaccaggtgccacccttctgaggtgaggcaaggaatgcctgtcccttgggcacgtctaacttggtgaaggtcccacgggtgggttgtggcatggttccagcttgccgggtccgatgtgggcagcagctctctgccttgccccaagttcctggtgggcggccccagcagagcccgccgcagcttcactcccctgcgtgccacctgccagtcgggggtccactgcatcctaggtcctgggcaagtcccctcccctct

SEQ ID NO: 164288 - DNA, 472 bp, Homo sapiens
tgtttcaatccactcggagccatccaaggctacatacccagtgggtactccctcttccatggctgaaacctctatttccacatcaatgcctgctaattttgagaccacaggatttgaggctgagccattttctcatttgacttctggatttaggaagacaaacatgtccctggacaccagctcagtcacaccaacaaatacaccttcttctcctgggtccactcaccttttacagagttccaagactgatttcacctcttctgcaaaaacatcatccccagactggcctccagcctcacagtatactgaaattccagtggacataatcaccccctttaatgcttctccatctattacggagtccactgggataacctccttcccagaatccaggtttactatgtctgtaacagaaagtactcatcatctgagtacagatttgctgccttcagctgagactatttccactggc

SEQ ID NO: 164289 - DNA, 531 bp, Homo sapiens
cctcccgcgagggaatgtctagaccagccgcaccttcttgctttgacccttcagaactttggcctgtccagttaaagaggcacagagccctcctacccacagggaatgtttctaacttaccaagcacctattatgtgcttagaacttggactttcctgatctcatttaagcctcaccattctagtgaggaagcatcacagaacccattttcctgatgaggaaactgagactgggaggggttaagatcctgtacacagttgtaactggcatgtctgaatccagtttcaaaccaaggtgcctttcagtgaacacccaagcatcttcctctcggattaactgctaggccaataccaaaatctctttctcgggctactcttttgctgctgagttaaaaagagatcctgagacttagcctgggaccccgactcgcggcgattctgtggcaggcgcagaccttttctcctgtcctccactgcctctttgcctcggagggcgccccggggcgcgagcggggcacgggcgaccctggct

SEQ ID NO: 164290 - DNA, 349 bp, Homo sapiens
ttttactgtacaaaaagcggatctatttacatattgaaataaacagcactggcttgtaaatcatgtccacaggcaatattgttaggactggaaccataaatactatcctcagggtaaaacaatagtacaagattaataggtattggtcattttaattgtaaaaccaacgtatccttcacattagattccttttcctagtgtaataagataaggtttccatattgcttaataccaaatgcccacataaagcagccagcaaaccaatgctatagaaaacattctttttcacgtctcccccaagaatatattttattcaaataaaaacaatccaagaggcttttatacagca

SEQ ID NO: 164291 - DNA, 945 bp, Homo sapiens
atttttataggcttactctgggtctacattgtatggagatatgttgcatagtttattgcatagttgcacaagttggaagtgatggttgcttggagctagttactagctactagcaagctagtagcagtaaaagtggggaaaagtgtggattttagatatattttaaagtcagagccaagagtagtgccaatacgttggatgtagggtgtcaaagaaagaactgaaccaaggatcactcaaaatgtgtgactcgtgcagctagaactgccatttattgagctggagggatattgttggagtgtcatttttggttactgaggaaagaagaggcgagagaactgaagtttcattttggacattttagtttgacatgcctattagacatccaagcggagaggccaagtagtcaggggaataagtaagctggaattcatgcgcaagggctggcttaaaagtgtacatttatgtatttaaggctagaaggctgaaagaaaacacctggagcagaagtatagctaaagaaaagaagaggcgtttgaacagagtgctaacactccaatatctagaggtcggaaagatgaagtggaagcagaaaggagacagaggagaagtgagggagagaacataagagaaaatagtgccccaaaaggctagtgaagaaagaacttaagaaggaggaagagtttatttgtcagataaagagtttgttgtcaaatactgccaataaattagttaagctgaagactgtaattgatcactgagtcaggtgaaagtcattggtgactttcaatcagtggtgtcctggtaaactggctctctgaaaagcagtgacaacagcaaaatcctgatttgtagtgtttactaaatttccctgtggaaatattcccatcatagtcaatttccagctacaaacagtttaacaaccagcttgcaaagttcttgaat

SEQ ID NO: 164292 - DNA, 548 bp, Homo sapiens
tgcctcagcctcccgagtagctaggattacaggcgccaccaccacgtccagctaattttgtatttttagtagagatgggtttctccatgttggtcaggctggtctcgaactcccaacctcaggtgatccgcccgcctcgacctcccaaagtgctgagattacaggcataagccaccgtgcctggcctgtgtctacattcttaggaagttcccaggtgaaaccaaatgccactggatccacactttgtgtggtaaagtgctagactgtgctccctggaaacacgagcctggaagcacataggcctccaactccccacatcagcctggcttaagcaccgtaggctggagttcctgagtacagccaatccattcctctgtcagacagataagccctccttccaccccatggcagcagagctaagcaagggtctctctaaagacaacctgtctaagcaggaagactgtactctcactgcgttgctaccagcatgcacccttccttctgctttcagcatagcaacagccaggacattggcaaagaaccattgg

SEQ ID NO: 164293 - DNA, 320 bp, Homo sapiens
aaaataaataacaagaaaatatgagtcatggttgtttaaagtttgttatacataggcctcatataaagttagcattataaggtaagttcaaggataaggaccatggacttgcttacatcatttggaaactaattttgaatagagattgaatacatattaaagaaatgtagagatgtaggctctttccagaagggaaagggggaatcctaatagaatagagccacatatccagtaaacacctaaattaggggagtgaaagtagacagtactagaaacacaagacatagtaaatgttttttatttagaatgtgttctttgtt

SEQ ID NO: 164294 - DNA, 524 bp, Homo sapiens
gtggatgatgcaggaacacggtttttcccttttatccctctctccttcgaggaagagaaaaatgtggtgtccactaaaaaaatatgatatcctggtttctacagtagttcatgcttatatttacataccttatatgcaaaatgtgtgcccactgtgtatgaatggtactgtctgggctctgtcgttaaagtgagtcgagatttctttattgtaacccttaagttatccttactgcttcttttccatcctccctcacccagagaataactcaagagcgagcacacactgaggaggtaagtggaaggttgttagggcgaggtaataggagagaaacgcatgttaagcttgagtcttctcccttcttgctcaggttctatattctgaccagggtctgttagtctgccctggttttggcattgcctagttcactttttctgctactttcagataggctcttttttttttttttttttttcgctaatcccctgatagttgtttgggagaagggctcattagttggggtc

SEQ ID NO: 164295 - DNA, 364 bp, Homo sapiens
atccatcagttactttgcactctgaataggtctttttatctgcgcaattttataacagcatgtattggtcatttggaaattaatagttcattaacacagttcttccaaatgttggcgtatttcattatacaatatgaaaaaaataatattatcaccatggacctcatcaagagagtatgtacagaaaagctgtcacactcacagcagcagacacaagttttccaaatatattttatttatttatttttttaagagactgagtcttgctctgtcacccaggctgtagtgcagtagtgtaatcacagctcacttcaggctcaaactcccaggctcaaacaatcctcccgcttcagcctcttgggta

SEQ ID NO: 164296 - DNA, 609 bp, Homo sapiens
  misc_feature (108)..(108): n is a, c, g, or t
  misc_feature (112)..(112): n is a, c, g, or t
  misc_feature (162)..(162): n is a, c, g, or t
  misc_feature (167)..(167): n is a, c, g, or t
  misc_feature (180)..(180): n is a, c, g, or t
  misc_feature (185)..(185): n is a, c, g, or t
  misc_feature (194)..(194): n is a, c, g, or t
  misc_feature (206)..(206): n is a, c, g, or t
  misc_feature (208)..(208): n is a, c, g, or t
  misc_feature (215)..(215): n is a, c, g, or t
  misc_feature (219)..(219): n is a, c, g, or t
  misc_feature (233)..(233): n is a, c, g, or t
cggaccttatgtgaggagtatttaatatagggacaatcagtcttatgtcttattaactcaacagaataatcaatgcagcaatgcaaatagatggcctagaaccataangtanggttcagttatcattcgaatgcactgttaggaaggcagggaatcattaantcctnaatatagggaaanacttngattcttanaagtagtaagtntnggttatntggntgattcactgtatngagcacacacacacacacacacacacacacatttttagagggcttgtggtttctgaagatgatgaaagaaaaaaaaactgtgaaaagcaaaaatgcccaaaagttcatcttctgccctgacccatcacccttcttcagaggtacccagtacctccaattcccaagtctttctggggttctgctgaaccaacacgtagccgtttatcccttcatgtaagcttagggttctacattttccaatatgctaactaagccccatccattagccttacagctcctaaaatgttatctttcatttgctgtagtctcctctattgttattcttgttatctgagtgatttgaagactttttatgtctttgctggcattttggtgg

SEQ ID NO: 164297 - DNA, 422 bp, Homo sapiens
tactaatataaattagcgaccgcgtcgacaactgaagcagtccctgcccccactaccagctttcaggaaaagaggtggtcgaaaagttggactgcattttttctaacaacactaatatgctttatgactcatactgtagtcaggaattggggggttcacccttttcttgggcctttgggcagtcacgtatggggtctgggaggagtaagacaagaaggggaaactgagaggagtgccaggaagcataggggctgctagattttgtgtctctgctttcctcattcaaatacttccccagcaagctgggtgcaatgaggcatgcctgtagtctcagctacttgggaggctgagcaggaggattacttgagcccaggggttcaaaactagcctaggcagcatagcaagaccctatctcaaaaaaa

SEQ ID NO: 164298 - DNA, 164 bp, Homo sapiens
aagcaaagcatgtgtattaataaactcagtattcattaaagcagcttgggttgcctgtagaaacggcagagcatccccaaggctgagggaggcggggctcctctgtgggtagcagacttcatctgcaggacaatgtgcagcacaggctgcgggtattaaaggag

SEQ ID NO: 164299 - DNA, 435 bp, Homo sapiens
  misc_feature (18)..(18): n is a, c, g, or t
  misc_feature (43)..(44): n is a, c, g, or t
caccaccacctcctccgnctccgcacacgcgaacacggccctnnaggcaaccccagcgccacgagggaaatacttacgtttaatagactcacatttatccatcttttgatgattgagtttttgtgtcattttcacccatattttccactaaatgtttttaagttttgcttttgatagttaagcccttaattcacctggggggtggtgaggggagccatcttcctctgtgatatatcagaattcaatatatgggaaggggctgggtgcagtggctcatccctgtagttccagctacgtaggaggctgaggcaggaggatctcttgagcccaggagtttgactctgcagtgagctatgattgcactgctgcacttcagcctgggcaacagagcctgtctcttaataaaaataaataaataaaataaataaaataacg

SEQ ID NO: 164300 - DNA, 519 bp, Homo sapiens
  misc_feature (405)..(405): n is a, c, g, or t
gctcggtacccgacggcttcaacggaactttggatcaagttatggcaaacaagaagaatgatttaaaagttataaaacttgaaagaggtggtcatattttagaatcaatgatgaccaaattgggaaatgttggatatagtgagtatagggaaatagatgaatattccattaataactattaaaatctgctaaagcttaggctaagctgaatatatttagttgtaataaaattgggtgaacacattccaacttcagcctgattaagggaaagggtgtaggggtgagacacttaggcggagcttgaaaaggaatggtgagagtttggccaatgggaaggaaggctgtgccagacaggaatagtgtgggctgacgacaactgagggcaaagtgcttgtcccctcatanttgcgcaatgaatgcagaggggctgaggttcatctgtcgtcttcagctctgcaggctacatctcgggtgtttcctgtgaaagttccgttgaagccgtcgggatcctctagatca

SEQ ID NO: 164301 - DNA, 423 bp, Homo sapiens
ggattacaggcgtgagccaccatgtccagccagtgataagaggatttcagtcatctgagtatctgtaaaggtcttcagttgaagaaatacctgaaatgaacaatacttatgtcaaaggctgaaaactaagggagcttttactttggatcaagttatggcaaacaagaagaatgatttaaaagttataaaacttgaaagaggtggtcatattttagaatcaatgatgaccaaattgggaaatgttggatatagtgagtcttgtacctactgctttaaaaatgaggtagtatgctgggcacagtggctcatgcctataatcttggcactttgggaggccaaggcaggaggatcagttgaggccaggagtttgagattagcctggacaacatagtgagaacctatctctaccaaaaaaaaaaagaa

SEQ ID NO: 164302 - DNA, 259 bp, Homo sapiens
tgacagctaatatggatgagaaagccaacaaaagtggtaaaatacattctgatacctgaaaataattcacatcaagtttcattttacataatcgaactattgtttttactgtttctgattgctaaatacttgcaaagccagttccatatttgctaaggttgtaaaggtctaccatctatttgcaaggactctaattcaagcactcaagtcctaaggtctatgcctgcagctttaactttataaaaagtttctgtacaga

SEQ ID NO: 164303 - DNA, 194 bp, Homo sapiens
cagaggctgtgaatggcttcggttcagctgtccaagcggcgatttttcctctgggtgaaatggattagattttagatttccacaagaggctggttagtgcatgatcctgagttagagctttttaggtggctttaaattagttgcagagagacagcctcgccctagacaacagctacatggccctttccctcctg

SEQ ID NO: 164304 - DNA, 539 bp, Homo sapiens
ttcttacttgttttgctttaaaattttttcccagcctctttcaacatatttacatttttctctataatttttggcattatttggacttcaaaaatatttgagattgaggatttatatgaatagtatcatttggagaatttttcccttaaagttgatggtgggtcagtcttttggtttgttcttccgtatgcaattacaaaaccagtgggatgaaatttggggatcacttttttccttgagcctcttcacccacttgacaatgaatttttttttttttttgcgggggggagccctatttttggtcttaaagctaacgaaggccgggtgtggtggctcatgcctgtgatcccagcactttgggaggctgacgcgggtggatcacctgaggtcaggagttcgagatcagcctggccaacatggtgaaaccccatctgtactaaaaatacaaaaaaattagctgggtgtggtggcgggtgcctgtaatcccagctacttcgggaggctgaggcaggggaattgcttgaacccgggaggcagag

SEQ ID NO: 164305 - DNA, 465 bp, Homo sapiens
ccagtgttttccaagcaacacgtaatactcctggtcagaaaggggcttcccacggccgaggaggggagagtgactcgacaggtgggtgggtgggtgggggaagcgaattccctggcccactgccgggccttgacttacaggctggacccagagttcccagggggctgtgagagcccatgccaagtcctttcttctcattcattcattcattcattcagtagacactgttgagagcctgctgtgtgttggggattgttctgtttaggtgctgggaatagagccatgaacaaagcagataagagtctatgctcccctgagcttgctctctcatgacaggagtcaagtaaatacagttacgtcaggggtggggactgtggaggaaagtaaagaggaataaagaggcgatggcaaacgtgaatttggggtgggatgctttttatgtgggtgctcagagagggccttgct

SEQ ID NO: 164306 - DNA, 741 bp, Homo sapiens
ttcagacttcctatctcaatttagaaattactaattgttagaaacctttcctaacttctccctccaaactaacataaataacacttttacatgttttcatggcatcctgttcttccctggtactacatataattccatgtgttgatttgttgattatctctgtctcccttcaaatcatgtagttaaacagacagaagttggaaaaccttgaagatgatgcagtttaaaagacagtaacataatctgacataagctacacacacacacactcaatgttaattcattcaatcataattcaactgaaacataaagttggtttgagaatcactcagaccagtaactcataaaaagtatttgtactgtttagccagtttttttcccaaagatttaaaaacagctcctcagtcacaatctcaacagaactttatagttctgataaattatgccacatgctttccctaaaatgcatgctctagaaattgtttattcaatgataaagcctatcagtgacctctgttagccctctagcagacttaatcagtggaaggaagtgggatataagggaggctgcaaaacagcagggctctggaacactggttttactagttattagcggtgtgacctagatcaagttcctcagcctgctgaacctggttcctcagctgtaaaacaagcatatctcttagcttggaatgctattatcaggatgagaaataatgtatatgacatgtccaacatgct

SEQ ID NO: 164307 - DNA, 1426 bp, Homo sapiens
gattcttcaggagacctcatctgaaaatgttaagactgccagtgagggaaggaattgttaaaatgccagcggcttttttttcctctttttttctgtaattctgtaaaaatgcagagaaagttgagtggtacttcagaattgagggagagggttaccgcagcgtagaaatatatttctagatttcagttccacaccacaaatccacaacaatgccatttttcaactgtacaaaaatctgcttatgaactggacatgatcttaatggtagtgtcaaaggccaagtttttcacctgttaatatttttccacatttgtccttgaatctgaataactttatacagtactgtaaatttaacttacatcgagtttgttgtcaattcttatgaaaagagctttctgcatgtaacacatacggttaaagaacacagcaaaggacaaaatttgcaggaacagttttggaaccaacagaaaatgtcaccttttatttgccatcttatatatatctatcagttttaccagctacttctaaatttgtacattatttgtaagggaaagaaggaaaaccctaagacttgtctaacttagtggagaatgtgtgtgttgggcttaggatggatagctaagtcttattgagctgtgttacctaacttgtatataaaaattgtaattaaaagtttgggttcacctgtttctcacagtttaaaatgatgagtaattgcaaactctggaaatgtgactagtatatgatttaaggctgtagaagcaaggaagctctttcaagtgctaaaactaaagacttctagtttttggctcaaataagtactgtttgtataccaggatatgtgagatgtaaatgtagtaggtcacttttcacccttgtagctataaaataaaaattttgtagaacagaaatagcttgtactactgaattaacaaaagttatactaaagtatcatgtttaaaaaaaaatatatatatatatacagagttaagcttgttgctgttaccctgtctggatttgaaaagtgtgctgatttatatatatatattacacacacacacacacacacacacacacacacacacatacacctaaaatggcctaaagcagacatccatgtaattacagttgcaaaatgaaaacattttggaaagaacattgtatcatagttcattcatttgcagtggatctttgttcctttttactgtggtaattttagaaatgagtgtcaagtttgaaattagatctgctaagttggggttttgctgcttgaactctgcactgggtcctcaaataaaccgatgtgaatgtagttttttccccctgtgtgaagaagcagttacaccccaacaataggaggaaaaatctagaactatttcaagttttatctttttgtatatgaaaataaaataataataaaacaatc

SEQ ID NO: 164308 - DNA, 1422 bp, Homo sapiens
gattcttcaggagacctcatctgaaaatgttaagactgccagtgagggaaggaattgttaaaatgccagcggcttttttttcctctttttttctgtaattctgtaaaaatgcagagaaagttgagtggtacttcagaattgagggagagggttaccgcagcgtagaaatatatttctagatttcagttccacaccacaaatccacaacaatgccatttttcaactgtacaaaaatctgcttatgaactggacatgatcttaatggtagtgtcaaaggccaagtttttcacctgttaatatttttccacatttgtccttgaatctgaataactttatacagtactgtaaatttaacttacatcgagtttgttgtcaattcttatgaaaagagctttctgcatgtaacacatacggttaaagaacacagcaaaggacaaaatttgcaggaacagttttggaaccaacagaaaatgtcaccttttatttgccatcttatatatatctatcagttttaccagctacttctaaatttgtacattatttgtaagggaaagaaggaaaaccctaagacttgtctaacttagtggagaatgtgtgtgttgggcttaggatggatagctaagtcttattgagctgtgttacctaacttgtatataaaaattgtaattaaaagtttgggttcacctgtttctcacagtttaaaatgatgagtaattgcaaactctggaaatgtgactagtatatgatttaaggctgtagaagcaaggaagctctttcaagtgctaaaactaaagacttctagtttttggctcaaataagtactgtttgtataccaggatatgtgagatgtaaatgtagtaggtcacttttcacccttgtagctataaaataaaaattttgtagaacagaaatagcttgtactactgaattaacaaaagttatactaaagtatcatgtttatgaaaagtgtgctgatttatatatatatattacacacacacacacacacacacacacacacacacacatacacctaaaatggcctaaagcagacatccatgtaattacagttgcaaaatgaaaacattttggaaagaacattgtatcatagttcattcatttgcagtggatctttgttcctttttactgtggtaattttagaaatgagtgtcaagtttgaaattagatctgctaagttggggttttgctgcttgaactctgcactgggtcctcaaataaaccgatgtgaatgtagttttttccccctgtgtgaagaagcagttacaccccaacaataggaggaaaaatctagaactatttcaagttttatcttcgggtctatcaacattcactactataaaccatctggtcttcttaaacaatgcacttcggggggcccggtacctggcctatgggatcgtc

SEQ ID NO: 164309 - DNA, 261 bp, Homo sapiens
caggatcttcaaacaccgcaatctttttctctgtttctgacataaacatcactgccatatcaaacctttttagttcagaaagtctttataagatacacagatggcaaataagcagatgaaacggttcaatgatgttagccttgtaagacacgcagaaaatgcaagatgagatgccactgcatgcctaccgtgatgactgaaacaagaaagagtggtgacaccagaggccggagaggatacagagaaactagatcactcagg

SEQ ID NO: 164310 - DNA, 493 bp, Homo sapiens
ggttgcactgagtagattaatacatcatctgggcaaacgagcacacaaaaacttaagggattctttgtggtaccagaatgaaacgagggagaaagcgcctctggaaaagtgtgtcaaaaacctcaaggggtatagcttgattaagcataacacaatttaaataaaactgtataaatgtaaatattaaacataatttcacatttgaaaattttgtctagttttcttagtacagatttcaaagaatcaaagtttggcatatgttttcattttgttttgctgtttttagacatggggtctcacgatgttgcccaggctagagtgcagtggctgttcacgggtgcaatcataatgtactgaagacttgaacgcctaggctgaagtgatcctcctgcctcagcctcccacgtagctgggactactggtatgcaccaccacaccctggcaaaatttcttttatttttgccagcaaggctagaccaattgcatctcaggt

SEQ ID NO: 164311 - DNA, 528 bp, Homo sapiens
gtcccaaagacactctttagcaaaaatcctgctcaccaagctccatctcagaatcggcttctgactggccccagtgaatcacagcctatgtccaccccttcacagtaactgtgctttcctcccttccagaggggcagcctatttctccccaccttgaatctgagctggcttcgtgacttgctttgaccaagacaacgtgtagaagtgacggttgggacttctgagcccgagtttaagtggacttgcagtttcaccttcactctgggaacccagcgccatgtaaacaagtccaggctgtcctgctggagggagatgatatggaggagaactgcggcagcccagtagatagccagcaccatggccccaggcaagcaagagaggaagagaggcccttgtggctctttcagccttggttgggctgccgtggccaacacaactggagcagagataagctatctctgctgagacacacaaattctgacccagagaattgcgagtaataaaatgactgttgtttgaaagccctaa

SEQ ID NO: 164312 - DNA, 561 bp, Homo sapiens
actggtggtggcctgaggattccaagaacagactttatttgcaactgtggacgggagtatggctcaagggctggccttgatctcacctgactggacattctcccagtgctgaggtgctacctgggggatatttgtaggaaacattcacaacaaatttattattctctgctgcctggggccacagacagcagatgaggcaaacaacagactaaccaaacaggccagggaataaaatgctctgggcgatgggggcctggaacgcagacagagctgtgcaggagctcaggagaggcctgcgagggccgaagctaagctctcacgtctggccgccttcaggctccgcacacacaggaagcaaaagctaaggcagagttgaaaatgtgtttaaccgcggaagggctgaccccacatgcacacagacccttctacaaactctgggagggttttatgggtttttttgattccagatgtttaaggaaatctctgtcctatcactgaccactgggctaaaagaataggaagaaacggccatacgtgacaaaaaatacagactttacaacc

SEQ ID NO: 164313 - DNA, 502 bp, Homo sapiens
ctttcattggcctaacagagttgggaaatctagatgttattcccagttctgcctgactgaccagttccaccttgagcaagacattccctctatctgggcctctatttcctcattttgaaacctatctgtgtctcccagactttcctgtaacagaataaccttgagtgtttgttaaatatacaaagtcacaggccccttccctaaatcaggggtggggacagggagctggaatctgtatctttaaacctagcatcctggtggattctaatcatctggcaagttcaaaacatgaacaccagatggttaccaaagtaccattctatgctatgatctataatttatacaaataatctcttagaagaaaggagatgaagtttggtacagattttgaaatcacgtgtcttgttctttactgaatgtagtttatcatgatcctcagttttcatttataaacacacacaagggggaacattttgtatattcctttgcaaggtgaaaaacc

SEQ ID NO: 164314 - DNA, 517 bp, Homo sapiens
atgcactgacctgttgccagaaggaacatgcctgtaggaggtggctggagacccctgctgggaggtcccacccactcgggaggaatgggatcagggacccaccccaagaagccctctggctgccctttggtagagtaggtgccaggagacccttccttgcctggaccatttgtattttccaaagttggcaggctggaatggctgagtttaccaaactgcagagatgacagctgctcttcccctgtgagcttcattccagggagagatcagaactttgtctgtagaacccttgcttgtgtggctgaagcccctgcagggaggacttgcccagtgaagaggaatagattgaggtaccgcttaaagaagcagtctggccatgatctggcaaggcagctgtgctgtgctgcagggaacctctccttgctcgaacttcttgtattcttcaaagctagcaggctgaaaccaataaatttaaatttaaataggtaaaaataagtaaataaagataaagaaaaat

SEQ ID NO: 164315 - DNA, 322 bp, Homo sapiens
gtctttctccatctcaaaaataaataaataaataaataaaaataaaatgctcaaataaataaaaacaaaccaatgaacaggagtgctggtagacctgcttctttgcgactgcttaatggcttaaagggccattcatttggttttgaagccaccaaagccagggcaaggtgaaacgtttagtccaaatgggtccctcaccccatttgggaaccaatcactgtcccctatagacctagttcattgaaggcatttaactgaatccaatcatccacattactaattgacctccacaagccaacaaaagaaaagatcggttcatcca

SEQ ID NO: 164316 - DNA, 258 bp, Homo sapiens
tgcatctctgttcacagggctttgcgtagtggcagctaaccagatcacagtgataaaagaaaagctgatagaacatgccataatattgggtttttacatgctcataaggatcagagtcaggagcgtggttgggtggaggtgggggaggtgtcatatggcggctaagcaaaatcagcagagaaaagagcagcagtcttgcagtgacatgatctgaccccaccacttgcccctggcttcaaataagtaatgtttggggtc

SEQ ID NO: 164317 - DNA, 104 bp, Homo sapiens
caggacttagattctggagtaagtggtgcagagacagaaacattatttggaagtcaaattcggcataggatcagtgtccgtgtgtggcctagacttgtaaattc

SEQ ID NO: 164318 - DNA, 187 bp, Homo sapiens
tccagagttctgagtctaacaaattattgaacctgggggggtcctgggaacccccaaatttgcatccagttggtcagaagtgtggtggcctggggatccccaaagttcgactggcatctaaatcagggcggtcttgtgggatctgatttagatgtggaagctcttcacctgtggggtctgcactaac

SEQ ID NO: 164319 - DNA, 525 bp, Homo sapiens
tctagaggatcccgggacactcttgagtgcatgggaatgtgaaaaacccttgagataatcaaaagctgtggtcactatagcaacagctcacccttgtctttccttttttgagcctgtcttaaatcagaatcctaaaacagagttattattggttatttgtacccataattttttttcaacatgagaaaaactattgtatatttgttgttcatagatattctcttagcttagtggcctttgttttcatgtgactgctgtcagctgctctttccaagttgtctgaaagagctgatggttccatttaggttgggagcaggaacaggtgctttcagccttaaactcctttcaggttgccagtggtgggcacgtgatggaaaagggggttcttagaaacaaagctgggtcagtggcttgctcagcagcaaatgctttgctttagttggtgttttcctttatttcccagccttggatgggtggcatgttctacacaaataactactttcttcttctgagctcttgccccaa

SEQ ID NO: 164320 - DNA, 200 bp, Homo sapiens
tgcctcacagtgggaatgctggcacagctgtcttggcaatcagtagaccatcctgtcagttcttcaagcccagagagggtccgtgacttgctcagagtcacacagcaatccattagcgaggccagccccttccctgggctctgcatttctcttgtagtgaagagctcctcacagtttatttgcatactgtaaatttgcaa

SEQ ID NO: 164321 - DNA, 523 bp, Homo sapiens
cgctggaaatgggaatattttcacataaaaactagacagaagcattctcagaaactactttgtgatgtttgcattcaacccacagagttgaacattacttttcatagagcagttttgaaactctctttttgtagaatctgtaagtggacacttggagccctttgaggtctatggtgaaaaaggaaatatcgtcatataaaaactaaacagaagaattctcagaaaatttttgtgatgtttgcattcaactcacagaattgaacattgcttttcatagagcagatttgaaacactctttttgtagaatctggaagtggtcaattgtagcgctttgaggcctttgttcgaatcgggaatatcttcacataaaaactaggcagaagcattgtcagaaacacctttgtgaagtgtgcattcaactcacagagttgaaaccttcttttgatagagaagctttgaaacactctctttgtagaatcggcaggtggacatttgttgtgctttgaggcctatgttgaaaaag

SEQ ID NO: 164322 - DNA, 310 bp, Homo sapiens
tgattgcagacatcaactaacttgatgtccacagaggtctcaatccaaaggtgtgacttcatggtggactgtttgtgaaaattcccataaggaataagagtgtgagcatctgaggtagaaatttatctttttatattcagaacacttatctatgcctagcagatattacatatttgatgaatgaataaatgaatgaaacaggtaccacttccagagatggccctagttttttgtccttgtgatttctcactgtccgtgtgttctaaccacaacaggatctacatatgatgctgttgttgccatcagcact

SEQ ID NO: 164323 - DNA, 228 bp, Homo sapiens
ctagttattttaaagtaatttttgagtcagccagctttcagtcaccagtgtggcaagctaattatattgcacaatagagtattgcaaagtaaagattaaataaatttgattccattactttttaatgtagaaagagactgaatcttatgcttagagcaaatgcaagcaatatttccttatatgattgaaaaaggttctatagtgtgaagcttatgattccataatgga

SEQ ID NO: 164324 - DNA, 324 bp, Homo sapiens
ggccgactgggagaagcaggttacagaggggcacagccgagggcgccgcccagacacggtgcggctgaggctcccggagaaacaagcagggaggctgagcaggcagcgggcgctcagggcagtgtcgccagcacatggatatttatggacatggaaagccatgagcctcccctccatgggctcctcaggggaggaagcatgaagggaagagggaggagaccgaggagccccacaaccaccgaggtggtgtgagacactgcctccaacagtccacatctgaaagcagttctccaggaggcaagggtgcaggccatggctcagccc

SEQ ID NO: 164325 - DNA, 501 bp, Homo sapiens
taagtctcaggagttcaagtcatggcactggattattcataatatcatacaagagagggcgagtggatgtggagaaaaagaacaaataagtctcgtaaaagcacacacaggtatttgttttctttggtcacaaaatgcaagaaagaaaataggaactattgtgactgtaaatcacattttaaattggaggctgtcaaatgtgcggtagagtggcagtgcttaatctttatttaacaacaaaggcctctttaatgatattttcacttttctctctgcgtctgcatctgtccgtgcttccccatgagtttgggtctagccaatttctgtccagcagatttcacctctaggtcataattattttctgtagaagccaaaatgtgggggtgctgcgtgccattcagtcctctcagtgtttgtatctatgcttcctctagggtacaacttctttctcagccttagcaacacgttccggaaggatgctattatctttcctggctttaa

SEQ ID NO: 164326 - DNA, 1241 bp, Homo sapiens
ctctgcctcctagataaaaatgattaaggtaactagtcattaattgcacccacttccagacaatatccaatccagactgaccctctcttcctcaaatcctctttagaattaccaagcaaaaccccaagtcctataagcccatctcaactccctccttatgcaacaccccatggttcctctgcagtgcctgctaaatctaacttcgggttattacaggtgcacgagtgatggtctttgactcatgacctttaacttgctgtgggtgtctgttgctttggagcagcccagcgctgatttctacttctgaaaagtgccctgacttgctttgaattggatgccagtctaggaagactcatatctgggcctcttgtaggccaaggtcaggcatgtaccttagcttgaaaatgagatacgcctccctaggatttgaaacctgagtgagaggcgcagcactggggttggtgtccaggccagaccggccatgttgcgagaccactgccgtgcttcctgcttcctggtcctctagtcctgcccgttcctagccagggtcctcagctttcccatcaatgcagtaactcctttcacttaattgagccggggtcaattttgctgttgctttccagcaaagaggatggagatgcacaactgtcatctgaacagtggcactcactcaccacctgaacagaggcgctcattctgcatcagggcgggtgaaaacgccttacgttgatccactcctggggctggggccgggactctcaggccctgggaatattgtttccacaattttattaacctggaaaatgtgttcctttgttctgattgtgtggtcaccaacaacggctgatttttaatatgggctctcatacaccctgttaccgattatcagacaccagatcctggtcacaagaaacaacagctcccatttgtaaatgaatgccttgacattgagctttacccacaatggagagttggttaacaggaggtggtctctctgtgcctgaacaatatgtgtgttctgacaaaatcaaatcaccagccctgcaatcccacagacctcacaggctcagtttgacccaccagggaatgctgcctccataagctactggccgccttccatggcatttctatctgtgacaactgccacaagctacctccgctggatgtcaaacaggcactaagctttgtgcactgggtctttgctcaaatgtcctttttagtagggagatgtgatccaaagg

SEQ ID NO: 164327 - DNA, 775 bp, Homo sapiens
tttggattatttgagaaaatgtcatacttatttttttttttattattattttcgagacagggtttcactctgtcacccaggatagagtgtggtatacaatctcagttcactgcaacctccgtctcccaggttcaagtgattcttgtacctcagcctcccaagtagctgggattacaggcgtgtgcctccatacccatctaatttttgtacttctttaatagagacaggtttttaccatgttggccaggctggtctccaactcctggtctcaggtgatctacccgcttcagcctcccaaagtgctgggattacaggcgtgagccaccgtacctggcccatacttctttgcaccattatacatttccagcaacagaacataagtctcccatttctgcacatttttgccacttgtgatgtactgttttttttgtcttttgggttttttttttaacaataaatattccatattggatgtgaaaaaaaaaaaaaaaaaaataaaacaaagaaaaaaaaagacgaaacgcagaaagaacaacaaacaccaaagacaagacaaacaacgcaacaaacagaagagccacaagaacaaaagaaggaagagaacagaaacgcaccagacaagcagcagacagagacagaaagagaaagcaacaggacgagcaaacgaccaagagaagcacaacaggacggaagaagaaagaagacgaagagagcacaggaacacgcggagagggggcggggcgggcgcgggcaggccagggagagttagtaggcg

SEQ ID NO: 164328 - DNA, 733 bp, Homo sapiens
aggctggcggatcacttgaggtcaggagttcaagaccagcctggcaaacaaggtaaaaccccatctttactaaaaatataaaaactagcaggtgtggtgtcgtgtgcctgtcctcccaagtagctgggattacaggcgtgtgcctccatacccatctaatttttgtacttctttaatagagacaggtttttaccatgttggccaggctggtctccaactcctggtctcaggtgatctacccgcttcagcctcccaaagtgctgggattacaggcgtgagccaccgtacctggcccatacttctttgcaccattatacatttccagcaacagaacataagtctcccatttctgcacatttttgccacttgtgatgtactgttttttttgtcttttgggttttttttttaacaataaatattccatattggatgtgaaaaaaaaaaaaaaaaaaataaaacaaagaaaaaaaaagacgaaacgcagaaagaacaacaaacaccaaagacaagacaaacaacgcaacaaacagaagagccacaagaacaaaagaaggaagagaacagaaacgcaccagacaagcagcagacagagacagaaagagaaagcaacaggacgagcaaacgaccaagagaagcacaacaggacggaagaagaaagaagacgaagagagcacaggaacacgcggagagggggcggggcgggcgcgggcaggccagggagagttagtaggcg

SEQ ID NO: 164329 - DNA, 609 bp, Homo sapiens
ccctatctctaccaaaaatacaaaaaattagctgggtgtggtggcatgcacctgtggtctcagcaactcgggaggctgagatggatcacttgagcctgggaggtagagtttgcagtgagccaagatcatgccgcttcactacagcctgggtggcagagtgagaccccatctcaaaataacaacaataataataagcaaggatagccacaaatatttgagaaataggaggagtgtggtcagtgagataagaaccctaatgtaaagttgtaataaacagaagttcaacaagtatgaaaacaaagtaactattagtcattaaaaaaaaaacccaaaaactgatgtacatatgatatggcagcacttcaaatcataaaaccaactatacatgccaagacaattggttaccaccaagtaacaaaatccagaaaaagtaagacctaacgtctacattttaacattgttaagaaagcacagaaatatttattgacatggaaagatgtttaccctgttatatatgtgttattttttaacttgcctttttacataacacagggtgaacatctttccataaagtgaaacaagccagtcacagaaggacaaatactgcat

SEQ ID NO: 164330 - DNA, 498 bp, Homo sapiens
gccccagctcacctttaatgcttacaacaaagcccgttcacatttttgacagaagaggaaactgaccctcacagagggaaagtgacttgcccgagggatgctgcagttaaaactcaaccacttttcctgattccgaatccagtgctccttcccctaccccgaccctatctcgccttccagatgagcacagtctccaagaagggaactctaggaggcgaacccaagctccactggattctgcatgttctccctcaagccccctgaccatgggcctgcagacgctctgagcatgcctgctgtccctgttctatcagctgtctccacggggtccctggtttctcatgcccaaggagtgggtgacttgggtccacagaccatcagtgcaagagcagtccactcttcccccatttacagatgagaccgaggccagagaggaaaggaagactccccagcagtcctggctccccaccatagtgcctaacacatggcttccctgcc

SEQ ID NO: 164331 - DNA, 1695 bp, Homo sapiens
gcttgggtgcaatggccgctcaaagggcgaggcttattcgaagcctcaaattcagaaaacccagccagaccttggaagttaagaaggtggaaggcagatcgcggaaccagtgttctgatagttgtggttctctgagggaagccaattctggggaccggtagtggaaagctcttgcgctgtttccggccacctcagcgggaagcggagacgcaagcagctggatctccggtaactgagacatagggtataactgttgtcgcggcggaggaagtgaggacggcgccaagggccttccgggccagtgttggatccctgtagtttgtgaagatggtgttgctaacaatgatcgcccgagtggcggacgggctcccgctggccgcctcgatgcaggaggacgaacagtctggccgggaccttcaacaatatcagagtcaggctaagcaactctttcgaaagttgaatgaacagtcccctaccagatgtaccttggaagcaggagccatgacttttcactacattattgagcagggggtgtgttatttggttttatgtgaagctgccttccctaagaagttggcttttgcctacctagaagatttgcactcagaatttgatgaacagcatggaaagaaggtgcccactgtgtcccgaccctattcctttattgaatttgatactttcattcagaaaaccaagaagctctacattgacagtcgtgctcgaagaaatctaggctccatcaacactgaattgcaagatgtgcagaggatcatggtggccaatattgaagaagtgttacaacgaggagaagcactctcagcattggattcaaaggctaacaatttgtccagtctgtccaagaaataccgccaggatgcgaagtacttgaacatgcgttccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgccctgaaaatgaaaggttgcacctcatttaatgaagcttaaccctatgtagaaagtctctttcgggggcagaggctttctctgggtgccaagccatatatattagggaatagtagattgttaatttcgttttttccctcccagtgcattttaaaaacagcactggctggggcattctcattctctgatggagccatcaatgagatttaacttagtcaacctgtgccagcaacattctgaaattccttcaaagaaggcagtcctttgggaaggtgttttttttttttttttttttttgactctaatcaacattccttttgttggtgacatttgtgattttcagtaatctgagtttttgatggccttttaaacaagactccagtatgtgaaggttaattgctgtgctccacagatctcgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagac

SEQ ID NO: 164332 - DNA, 1585 bp, Homo sapiens
gcttgggtgcaatggccgctcaaagggcgaggcttattcgaagcctcaaattcagaaaacccagccagaccttggaagttaagaaggtggaaggcagatcgcggaaccagtgttctgatagttgtggttctctgagggaagccaattctggggaccggtagtggaaagctcttgcgctgtttccggccacctcagcgggaagcggagacgcaagcagctggatctccggtaactgagacatagggtataactgttgtcgcggcggaggaagtgaggacggcgccaagggccttccgggccagtgttggatccctgtagtttgtgaagatggtgttgctaacaatgatcgcccgagtggcggacgggctcccgctggccgcctcgatgcaggaggacgaacagctacattattgagcagggggtgtgttatttggttttatgtgaagctgccttccctaagaagttggcttttgcctacctagaagatttgcactcagaatttgatgaacagcatggaaagaaggtgcccactgtgtcccgaccctattcctttattgaatttgatactttcattcagaaaaccaagaagctctacattgacagtcgtgctcgaagaaatctaggctccatcaacactgaattgcaagatgtgcagaggatcatggtggccaatattgaagaagtgttacaacgaggagaagcactctcagcattggattcaaaggctaacaatttgtccagtctgtccaagaaataccgccaggatgcgaagtacttgaacatgcgttccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgccctgaaaatgaaaggttgcacctcatttaatgaagcttaaccctatgtagaaagtctctttcgggggcagaggctttctctgggtgccaagccatatatattagggaatagtagattgttaatttcgttttttccctcccagtgcattttaaaaacagcactggctggggcattctcattctctgatggagccatcaatgagatttaacttagtcaacctgtgccagcaacattctgaaattccttcaaagaaggcagtcctttgggaaggtgttttttttttttttttttttttgactctaatcaacattccttttgttggtgacatttgtgattttcagtaatctgagtttttgatggccttttaaacaagactccagtatgtgaaggttaattgctgtgctccacagatctcgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagac

SEQ ID NO: 164333 - DNA, 608 bp, Homo sapiens
cggctcactgcaacctctgcctcccaagttcaagtgattctcctggctcagcctcctgagtagctgggattataggcgtgtgccgccacgcctggctaactttttatatttttagtagagacggggtttcactgtgttagccaggatggtctcgatttcctgacctcatgattcacctgccttggcctcccaaagtgctgggattacaggtgtgagccaccgcgcctggccaactcagaacttttaatctcctacctcagtactttgatggccatgaaagaaatggtcagttttcttcatcattctagatactttcattcagaaaaccaagaagctctacattgacagtcgtgctcgaagaaatctaggctccatcaacactgaattgcaagatgtgcagaggatcatggtggccaatattgaagaagtgttacaacgaggagaagcactctcaggtatctaaaagcaatgagtcttatgaagaaatggttctcattccatagacaaggatagcttattttgcagtgccttttatgctattagattctacctagaactgttaagaatttatctcccagaagtacattacattacaatgcttccaatat

SEQ ID NO: 164334 - DNA, 1475 bp, Homo sapiens
  misc_feature (41)..(41): n is a, c, g, or t
aattcgcggccgcgtcgacacggctgcgagaagacgacagncgggaggaagtgaggacggcgccaagggccttccgggccagtgttggatccctgtagtttgtgaagatggtgttgctaacaatgatcgcccgagtggcggacgggctcccgctggccgcctcgatgcaggaggacgaacagtctggccgggaccttcaacaatatcagagtcaggctaagcaactctttcgaaagttgaatgaacagtcccctaccagatgtaccttggaagcaggagccatgacttttcactacattattgagcagggggtgtgttatttggttttatgtgaagctgccttccctaagaagttggcttttgcctacctagaagatttgcactcagaatttgatgaacagcatggaaagaaggtgcccactgtgtcccgaccctattcctttattgaatttgatactttcattcagaaaaccaagaagctctacattgacagtcgtgctcgaagaaatctaggctccatcaacactgaattgcaagatgtgcagaggatcatggtggccaatattgaagaagtgttacaacgaggagaagcactctcagcattggattcaaaggctaacaatttgtccagtctgtccaagaaataccgccaggatgcgaagtacttgaacatgcgttccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgccctgaaaatgaaaggttgcacctcatttaatgaagcttaaccctatgtagaaagtctctttcgggggcagaggctttctctgggtgccaagccatatatattagggaatagtagattgttaatttcgttttttccctcccagtgcattttaaaaacagcactggctggggcattctcattctctgatggagccatcaatgagatttaacttagtcaacctgtgccagcaacattctgaaattccttcaaagaaggcagtcctttgggaaggtgttttttttttttttttttttttgactctaatcaacattccttttgttggtgacatttgtgattttcagtaatctgagtttttgatggccttttaaacaagactccagtatgtgaaggttaattgctgtgctccacagatctcgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagac

SEQ ID NO: 164335 - DNA, 884 bp, Homo sapiens
gcttgggtgcaatggccgctcaaagggcgaggcttattcgaagcctcaaattcagaaaacccagccagaccttggaagttaagaaggtggaaggcagatcgcggaaccagtgttctgatagttgtggttctctgagggaagccaattctggggaccggtagtggaaagctcttgcgctgtttccggccacctcagcgggaagcggagacgcaagcagctggatctccggtaactgagacatagggtataactgttgtcgcggcggaggaagtgaggacggcgccaagggccttccgggccagtgttggatccctgtagtttgtgaagatggtgttgctaacaatgatcgcccgagtggcggacgggctcccgctggccgcctcgatgcaggaggacgaacagtctggccgggaccttcaacaatatcagagtcaggctaagcaactctttcgaaagttgaatgaacagtcccctaccagatgtaccttggaagcaggagccatgacttttcactacattattgagcagggggtgtgttatttggttttatgtgaagctgccttccctaagaagttggcttttgcctacctagaagatttgcactcagaatttgatgaacagcatggaaagaaggtgcccactgtgtcccgaccctattcctttattgaatttgatactttcattcagaaaaccaagaagctctacattgacagtcgtgctcgaagaaatctaggctccatcaacactgaattgcaagatgtgcagaggatcatggtggccaatattgaagaagtgttacaacgaggagaagcactctcagcattggattcaaaggctaacaatttgtccccttcattctatagaatcaactattaacacctgga

SEQ ID NO: 164336 - DNA, 1330 bp, Homo sapiens
cggctcactgcaacctctgcctcccaagttcaagtgattctcctggctcagcctcctgagtagctgggattataggcgtgtgccgccacgcctggctaactttttatatttttagtagagacggggtttcactgtgttagccaggatggtctcgatttcctgacctcatgattcacctgccttggcctcccaaagtgctgggattacaggtgtgagccaccgcgcctggccaactcagaacttttaatctcctacctcagtactttgatggccatgaaagaaatggtcagttttcttcatcattctagatactttcattcagaaaaccaagaagctctacattgacagtcgtgctcgaagaaatctaggctccatcaacactgaattgcaagatgtgcagaggatcatggtggccaatattgaagaagtgttacaacgaggagaagcactctcagcattggattcaaaggctaacaatttgtccagtctgtccaagaaataccgccaggatgcgaagtacttgaacatgcgttccacttatgccaaacttgcagcagtagctgtatttttcatcatgttaatagtgtatgtccgattctggtggctgtgaaataatgaatacagtcactggtaagggagaacctagaacccagtaggtgtatattttcaggaaactgagctcacagagatgtgtattagaatccaagtggaacttctgcctctaaagaccttgcaagaaaagagatgccctgaaaatgaaaggttgcacctcatttaatgaagcttaaccctatgtagaaagtctctttcgggggcagaggctttctctgggtgccaagccatatatattagggaatagtagattgttaatttcgttttttccctcccagtgcattttaaaaacagcactggctggggcattctcattctctgatggagccatcaatgagatttaacttagtcaacctgtgccagcaacattctgaaattccttcaaagaaggcagtcctttgggaaggtgttttttttttttttttttttttgactctaatcaacattccttttgttggtgacatttgtgattttcagtaatctgagtttttgatggccttttaaacaagactccagtatgtgaaggttaattgctgtgctccacagatctcgtctattggcccctgtagaaagttaacctttgttgttttccttttataatttgcttattgcacaattgctttagggtaagtgaattatattaagatgccttgaaattatagcactccttgattaagaagctaaaatgtttctctcatttactccttaaacaaaagac

SEQ ID NO: 164337 - DNA, 735 bp, Homo sapiens
  misc_feature (41)..(41): n is a, c, g, or t
aattcgcggccgcgtcgacacggctgcgagaagacgacagncgggaggaagtgaggacggcgccaagggccttccgggccagtgttggatccctgtagtttgtgaagatggtgttgctaacaatgatcgcccgagtggcggacgggctcccgctggccgcctcgatgcaggaggacgaacaggtggactggctaactgtgggccctttgtgactttgatcttgaaagcaaactaaagatggagtctcactctgttgcccaggctagagtgcagtggtgtgatctcagcttactgcaacctccggtccccaggttcaaacgattctcctgcttcagcctcccgagtagctgggattacaggcacctgcaaccctacccggctaatttttgtatttttagttgagatggggtttcagcatcttggccagtctgatcttgaactcctgacctcatgatccacctgccttggcctcgcaaagtactgggattacaggcgtgaacccccatacccagcctcatcttgcctttcttaaaggttcacagatcagaattgcacataatcgatacactggatgcaaatatgtaatgaatgaatgatttttcacattacaaaattaatttgtgcatattgtagaaagttcagtaaatacataaaagcaaaatgaccaaaatgttaacagtgtttattaactataatctgtactcaaattatatccattttggtggatgaccttaa

SEQ ID NO: 164338 - DNA, 280 bp, Homo sapiens
aatgctccctgtctagtgcatgcgtgagctaagttgctaggaaatgactcattctttaatttgcaaagtcacgacgcccatggaacatgtgaaaagcaactaccagccgcagttctaagccgtctttcaccaacaaggaagatattactaaattaggaagactcattttgcccaaacgtactacaacgtagaaattcagatgagttttctcttttgaagtcttcttagaaggctgaatatttatcttactacagccaaagcccagacgtttcctaaaaca

SEQ ID NO: 164339 - DNA, 344 bp, Homo sapiens
aatccatttctaaaagtttattttttatgcctgtaatatttaaaaagcctaaaaatgatcttgctggttttcttcagttgagtgttgtgtaagtgaaaattacttcacaaatcctactattagctattataatcaaatcagctttcactcttccatgagactgtttccttcacaagactttggttgaccataaccaattttatagtaatatacaacaaaaaataatgtggagaatagcaaaattaaacatatttttttaaaaaatagaggtgttctttcccaggattttttttaagagtaaataatgttagcttatgggattgtagtgcacagcacagccccat

SEQ ID NO: 164340 - DNA, 104 bp, Homo sapiens
atttactcccctttgtgttttagatctttgataccatactttaatctgtatcttcagtttctgaacataagtatgcaaaatctttttaaggtgcatactctgct

SEQ ID NO: 164341 - DNA, 227 bp, Homo sapiens
gcctcatttggttcctggctaaatctggcttttcagtcttctcatccattccatatgtactcaatctaataaattcattttctgcttaaattgactagcatcaatttttaatttacatttttgcaactgacaacccagactagtacaggtcctaaaggggactctaattcacatgtcctcccaagaaaggcaggtagcaaggtatcttatttgtatgtgtctgatag

SEQ ID NO: 164342 - DNA, 383 bp, Homo sapiens
cacgcccagctcaggcttcagggacacgagcgccccgcggctgcgcggcgtgggagggggttccgacagcctgcggagcccagccccaccctccccagacccgctggcagcaagaggggttcagggctgttgccccgggaaggaggcccgaagagcttgcagccgccgggaggggtggggcgggagggggcgtcggaagacaaaaggatgtgaggctttaaattcaaaaagatgttttgaaagccaagcgctggggtttgaaaggcgctgggaggacggcggcagagcgatcccaatcagaaatgcgatttgaagtcctaatgaacttgattgcgtgaacatttataatcccccatggccctaaatgaaatcagatataatca

SEQ ID NO: 164343 - DNA, 754 bp, Homo sapiens
ttgaggctgcagtgagccattgacggtgccactgcactacggcctgggtgacagagtgagatccgtctcttgaaagagggaaggaggagaaaaatagagacagagacggtagatactgagaatgtgcggatctaacattgtcttgaatcttgagagctttcatccatcccagagattcctgacaggtcataattctgctaagacatagatttgcattgcagcccagctgctaactcttaagtcattaaaactttctttgtgaaaaatggctcttttgcaacgagaatcagctgctactattggtgatatcagggaagaaaaagcaaagattatctaaagaagtgatagctcttagccagagaaagggagttttggataaactaaagactggaatgatgactttttgctgtgctgggagcaagcccaccatgtacttcttggggaacagggacgttcgtgagcattttagcagttgcttgagccagggcaacgtttgtatgagtgaggtggttttagagaaagttgaatggggagttgtagtgagaggtgagacattaacagcagcaacaaccaccacagatcaggagctgggcacagtggctcacgcctgtcatcccagcactttgggagactgaggcgggcggatcacctgaggtcaggagttcaagaccagcctggccaacatggtgaaaccccgtctctactaaaactacaaaaactagccagacatggtggcgggcgcctgtaatcccag

SEQ ID NO: 164344 - DNA, 391 bp, Homo sapiens
cttctggggtctctgcaagtggaacaagaggccctggcctctgagtgggcctgctgctgtgggcagcctctggcgtaccaccccccaaagcccaggaagtggcatgcatacgctgggaccagccctgtccacggggccctggggcctggtgtgctctgccggagacgggatgcattttgaggaaatgcctctgactccaggcctcccatacaggtctgtgcagattgcacctggcacctacccagagaactcagctgttctgtttacattgtggaggcacctctcaccctgacccacgcaaaggttctggagatttctggagaatatatttattaaagccacctcttcaccaaaagttaccaaaagggttggtttaggaagtaaatgaagg

SEQ ID NO: 164345 - DNA, 413 bp, Homo sapiens
gttgaagggaatattaattcccttcattgacagtggtccaatataataataattatttccaatagagtattcacagttgagaattccataggagacaataatgtttccttcattaaaaaaaagagggagggaggaaggaaggaaataaagaaaataaagagagaagaaagaaagaaagaaaagagaaagaagaaagaaagaaagagaaagaaaggaagaaagaaaagagaaagaagaaagaaagaaagagaaaggaagaaagaaagagaaagaaaggaaggaaggaagagaaagagaaaggaaggaaggaaggaaagagacagagaggagagagagagacagagaggagaaagaggcagagagacaagcagggagtcaaagagagaaggagaaagatagaaatagtaaaaaaa

SEQ ID NO: 164346 - DNA, 320 bp, Homo sapiens
atcagttaaaaaataaataaaagaaaaataaaaagtaaactaagaaaatggattggaggcaggaaaatgaaggtagagagcttataaggagcttgttctaatactgtaggggaaagatgatgaccttgagactaagaaggtcacagtggagaaggggaagaggggtgtggggttcagaggtgtttaggaggtagaatccgcctcaggcaaacttgactccgttcctaatgataggaataacaaagtgttcatttttatatattattgtttttggtttggtgctagcattcatttgttgcttcagtggctagggagaatgc

SEQ ID NO: 164347 - DNA, 592 bp, Homo sapiens
ccagtgaaacctgaggtggaaaataagaggctggggagatcaatgacctaaaacactaagtacaggaaaaacaggtagatcaaagtctgaatctttttacagtttttatggaattagaaaagacactgaaacaaaaaatactttaaaattctgttttggaatactaaggaagaaaatgaccacaaataacccttgggtccaattcggtttagtagaaggattaactttacattcagatttttaagaagtttgacatgttttctcaagtggttgagagtgttaagcatttctttgcgggggtgggggcagtaggcggggatggagtcttactgtttcccaggctggagtgcagtgccacaatctcggcattctgcagctttctacctcccgagttcaagcgattctgctgcctcagcctcccgaatagctgagattacaagcgcacgccaccacgcccgtctaattttttgtatatttagtagagacggggggtctcaccatgttcaccagcctgatcctgaactcctgacctcaggtgatctgacccttcttggcctcccaaagtgctggaataggcgtgagccgccacgcc

SEQ ID NO: 164348 - DNA, 503 bp, Homo sapiens
gaaagggagagagaagagccgggagtgcctgtgtattgatcccagaagctgagctggaagaaagagttggctagaggctcacggctgggcctccaggaccagcacaactttgtcggttcccctgcaaaggacaccccggatgcctccagccatgcaaaaagcattaattaagtaccttctgaatgcagatgttgggactgtttagtcaaggggtgtgaaggaagatgctggcatggcagagttgaagagaatgtcccggctctgccattgtctgtgtgacccatggccactcacccaaccccctctaagcctcagcgtccccgtccatcaaatgtgaggtacaattcacataccatgtaattcacccacgggaagtgtatgattcagtggtttcttatacagacttctgcagccattaccaccatcaactttacgacattttcatcagcccatagaagactaccactacagtccattagctgtgccccatgcctactccacct

SEQ ID NO: 164349 - DNA, 185 bp, Homo sapiens
aacagtggatgaggtggtccgtaaacatggaagaaggaaaccgctgagggtgagatgagttagagctaatgcagccagacccgagttcctgcagaggacccagagtccagggggctcaggaggggcatggggcagttcgaatgtccatgggagggatttccactctcacctggctcagccagatg

SEQ ID NO: 164350 - DNA, 204 bp, Homo sapiens
ctgtaatcacagctactcgggaggctgaggcaggagaatcacttgaacctgggaggcgtaggctgcagtaagccaagattgcaccattgcaccactccagcctgggcaacagagcaagactccatctcaaaacaaaaaacatccttttcttgactctccccaaaagctgccactccatttccttgctaaccccccctgccacaa

SEQ ID NO: 164351 - DNA, 868 bp, Homo sapiens
gagaaatttacttttttgcatacctaagttcatggcccataaaaatcatacctacgacacattgtcttaaaagtgcagtctgattcgccatagccaaaaccaaaaggcagagcaacccaagtacccactggcaggtcatagacaaacaatatgtggtctacacacacaatgaaatgttactcagctctgaagaggaagaacattctgacacgtgttacaatatggctaagcctggaagccattatgctaatgaaataagccagtccagtcacaaaaggataaatactgtgtggttctactgacatgtagtagccagaattgtctaattcatagagatggaaagtacaatgaaggttgctagagctaggaagaggggtaaaagggagttattatttaatgggtacagaatttcagttgcaagggcaggcacagtggctcacgcctgtaatcccagcactttgggaagccaaggtgggtgaatcacctgaggtcaggagttcaagaccagcctggccaacatggcaaaaccccgtctctactaaaaatacaaaaaattagccaggcttggtggtgggcacctgtagtcccagctactcgggaggctgaggcaggagaatggcgtgaccccgggaggcggagcttgcagtgagccgagatcgcgccgctgcactccggcctgggtgacaaagcgagactctgtctcaaaaaagaaaaaaaaattaactttttaaaagtgttttccacagcagcagcagatcagttttgaacccttgacactgtcaagtggtgaccagaattcaaggctaaagaacaagccaacaagcatgtaagtaggtgatagcagagagagaggatgggctggctgagg

SEQ ID NO: 164352 - DNA, 163 bp, Homo sapiens
ttaaccagctagtataaaaatagccaccaaaacaagtcaatcacccaccttaaatcagcccagtactcccatcttgagcggagaagcccattctgaatcacagtcaagacagtgatggaaaaacagctctctctgggtatcaaaaccacgctcgccccaaatc

SEQ ID NO: 164353 - DNA, 647 bp, Homo sapiens
ctcatttatagtgggagctaaacattgagtacacatggaaacaatgaggagaacaatagacaccaatgccttctggagggcagaaggtgggaggagggtaagggttaaaaaactacctgtcagttactgtgctcattacatatgtgatgaagtcatttgtacaccaaaccctattgacacgtaatttagccatgttacaaacctgcacttgttcaccctgaacctaaaataaaagttaaaaaaggaaaaataataacaaaggactacaccattaaaacatgtcttaaatttcttcctttatggagcttatcttctagctgaagcgtccatccaatttaattctctttaaggttcttacctctttaaaactgtttacccttttactgctgcgaattttcttcctcctgtccctctcctttccctctctcattgtccttaccaggaggctccctctccactttcccacctcttctgctcctcctcgctctctctgttacacagcaacatgtccaagcaacaaagagacaatagtatttcctttttggtccagtgactttgttgggccatagtaggatggcaaagaccccaacactccctttcataaatatgatctccccttgagccactttccagggaggaatgtgatc

SEQ ID NO: 164354 - DNA, 162 bp, Homo sapiens
tgctgggattacagacgtgagccaccgcgcccggcctcaacaagatattttgtcttgtcttgctcaacaagaagtgatggttcctgacagatgaacaagaggacaaaaagtagcaaaatgtgaaggtgttacagttctaacactcaaaagagaaaaagaaca

SEQ ID NO: 164355 - DNA, 463 bp, Homo sapiens
ctcccatagcgtttctcagtaccttttgtagcatttttcatactctaataatctgtaactcgtataatcttctcctttagaccaccctcaaataccttactttcagtcctcaaagcttagaacagtactctaagcactaacttaatggtggttgaggaaatgataaacaactattaaagaaatgaatgaataataaataggcctattcatgtactttatatttgcaaaaatctctctcaatctaaagtcatttcttaggtgacaatggtccacatgcaataccatccactgcaatatttatttaaaagggcctccattctaaagtaaccaccagaaaattcacatgttctagacggactgaggtcacaggttccaaatggagaacagggtgttagctgccctcactctagttaaagcatactgatgttctataataatctactggggtgccaatgacaatcac

SEQ ID NO: 164356 - DNA, 499 bp, Homo sapiens
cctcatccatgacacattacatttaatggtcctgtctccttaggctcttcttggctgtgacaatttctcagattcttcctgggttttgatgactttgacagttctgaggagtactagtcgggtattttgtagaatgcccctcaattttaacatttggctgacagtttttctgggatgaagacttttcactgtatacctttgaacaggttttttaaaaacatacttgaactatgttaatctataagctatttaaatgttgacgtaccttaatttaaaaggcgaactgtaggaattagaagaaaagggaggagaggaggggagggagaggaagaagggaagttggggaggagaaggagaaagagagagagaaagggggcaggggagcaggaggagcaggaggaggaggaggctacctggaggggctgggctgatcctgccttgggcccactctcccggcgacctcccggctcccagacctggctgagcccggcggccgcca

SEQ ID NO: 164357 - DNA, 499 bp, Homo sapiens
ccaggtttaagcaattctcctgcctcagactcccgaataggtgggactacaggcgcccaccaccacgcccggctaattttttgtatatttagtagagacgaggtttcaccgtgttagccaggatagtctcaatctcctgaccttgtgatctgcccgcctcagccttccaaagtactgggattacaggcgtgagccaccccccacggcctagtttggtctttttcaccatcatgcagtgagacatggtgtgcacaatccgcatgttttctggatagtcccttctgaaatgttcatttatgattttggctcttccagaggacatcacggtaaataatctcgtgcattttccaagtgtttccctcgtgtttcctgatcattgatcatgcgcattttcaactgtcctaaatattgccaaattgctgtccagagtggctatgactaatacatccctgccagtttgcctgggggcttctgtttccctaaatccttcccagcactc

SEQ ID NO: 164358 - DNA, 460 bp, Homo sapiens
caccttcctgattcaactcaccatctcttgcctcatcaaatgcaatggcctcctaacaggtctcttgtgctctgtcccctcatatctgattattttcaacacagcagctaaactgttcctttcaaatatgcctaatgttgccacacctctactcaaaaccctccaatgacttctgatctcattgaatgtcaataaaatgtccataagggccctttcgatcccatcttccactagtgtcccccttaatcagttagctaaagcttcactggttctgtttctcaaatatgccactcacaccttgcctcagggcctttgtacttgcagtaccaactcaccttctcagtgtagtcttgcctacatgagatcagtgtgctttcatctgcagcaccaagagtccttatctccctccccatcatctaacatactatgtatttttttaaagtaggtaatttgtcttact

SEQ ID NO: 164359 - DNA, 382 bp, Homo sapiens
  misc_feature (364)..(364): n is a, c, g, or t
gagaactctgggagttatctgctggattaaaaaacattgctcataaatacaataaactgcttatgtaattttgtaatttcaggatttatcgcccaagagttgcttgtaggtgagtacatcaaaccttggtaactttgtgagtctgttttaattccactaactttagggttttgtaacgaagtcacttactgaaaagccttctcttgcttctggtaactatgcctttttggccgatactatctgacacaaatcttctgctctagattgcattatatagagggatcagatgcatagctgaaattcttggaaatgtcttacatttataatgctttcagaaagttcaaatgttggaagatagggggancctgctgtcgtcaccgga

SEQ ID NO: 164360 - DNA, 389 bp, Homo sapiens
gagaactctgggagttatctgctggattaaaaaacattgctcataaatacaataaactgcttatgtaattttgtaatttcaggatttatcgcccaagagttgcttgtaggtgagtacatcaaaccttggtaactttgtgagtctgttttaattccactaactttagggttttgtaacgaagtcacttactgaaaagccttctcttgcttctggtaactatgcctttttggccgatactatctgacacaaatcttctgctctagattgcattatatagagggatcagatgcatagctgaaattcttggaaatgtcttacatttataatgctttcagaaagttcaaatgttggaagatagaggacaacactttataagttattcttcagcc

SEQ ID NO: 164361 - DNA, 459 bp, Homo sapiens
atttcccaagagctttatgaggtggatactatattatttccatttatagagtaacacatgtgacttgcccactaagctacacagacaccagggcaacctctaggaatccagggtttaatttgattttaaaataaaaaccaaattattaaaataaaaacaaaagtttaaaaaagtactaagcaaagccatcaatgaccacacattgcaagtgagacagacatcataacttgtcccagacaagttacaaaacaaacaaaacagcaacaacaaccattacagggaaaataccagaaatcagagtttgatataatagcaaaacatccaattttcaacaaaaaaggaattataagagatttaaaaaataggaaagtgtgacccacactcaggaaataaagcagttaatcaaaactattttttaatgcattcagatgttggatttagcagacaaatgctagagtt

SEQ ID NO: 164362 - DNA, 476 bp, Homo sapiens
atgtaaagatcttttaggctacaatatatttgaccaggaaagaaagcttgtcttctattcaacatttggttaatagttatttacatagtttttttttttgctatagtagaataaataatcaggctcaacctgaataataaaaacttactaatgtcttacaaatactagatcaagatgaaaattatacctatccttacatattattccaccttctactttattatcagaagagaattaattggtagctagtgttctcctcttacagacaaatatagcatctatttttcatgcttctttcttgaggacataacttaaaatttgaaactgaacatttggtctgtgcaaactttatttgtagaaatatttccatggtcaaaatgaaattttcaactttaagaagctgaggcaggaagatcacttaagcccaggagtttgagaccagcctgggcaacatagtgagaccctatgtctacaaa

SEQ ID NO: 164363 - DNA, 331 bp, Homo sapiens
cttccatctagcagctgagtgtaattcacaagggagggctagagacaaggtgtagctaatctttgttggagcagccacatacaatatcatttataacactttgaaactcttagaaaaattcaagtatgaaactctgatccctttccattttcacaataagaaaataaaaaaaaaagggcatacaccaggaactaagcaacccatttgtgattcaaatgaggcataaaataaagaaaaacagaaaaatattgtattgtttcagatttcaactcccatctctaatttaaatttctactcattaagcacaaaacctatatttcttacccatgca

SEQ ID NO: 164364 - DNA, 564 bp, Homo sapiens
atcccaaagtatctacacagattccaccctcgcgttcttcctctgattctgggcctggcctgcccacatctcctctgaggccttcctccatcagtttgcccatctttcccctcaagagtgggaacacgcatagccgccctcccacctcccatccattctttcaccctcactgccaactccaaaaagcagctggtcacagaccccactggctcatggcctcgcctggctgatctttccttttcaaccctcttcaccggctgctttccctcccactacaccgtggtgcctgcagcctacttctcattctctcctcctccgtcctagacaatcttgtccaatctcaaggctttcaccagcacctgtatgctgataacgcccacttatttccatcctgaccttttccctaaatgtcaggatctttagtaaacttcctagagacaattttatctccatggtccaagggatttacatgcaatacatttaaatccaaagggttcctctttccccactcagcttgctcttcctcctactttccctatctcatcacacaagctagatagcctc

SEQ ID NO: 164365 - DNA, 594 bp, Homo sapiens
tgttctctatagttaaaggggcctggatttggacccagaagaatctctgttgtggttctaattctgccactagcaatgcaaacttaggtaattcatttaacgtctctaaacatgattgccagctgcaaactagggaccatatttgactggctataaaaactaaaaaatagtggcctggcacagaggttcacacctgtaatcccagcactttgggaggctagggcaggtggattgcttgaacccaggagtttgagaccagcctgggcaacatggtaaagccccatctctagaaaaaaaaatataaaaattagctgggcatggtggcatgcacctgtagtcccaactacttgggagactagggtggaaggatcgcttgaacccagaaggtggagatggcagtgagctgagatcacaccactacagtgaagcctgggtgacagaagtgaaactcttgtctcaaaaaaaattaaaaaatataatttgaagccagtcatggtggtgcacacctgtagttccagcaactcaagagactgaggcaggaggattgcttgaacctgggaggcagaagttgcagtaagccaagatggtgcactc

SEQ ID NO: 164366 - DNA, 595 bp, Homo sapiens
ttttactgtatatgttccagtacctggagggtcctcctaattcaactatagttgcttgtttatatctattttgcagacagggactcaggctaatattttgtttaagaaaagtgttctctggtaaaaaaaaaaaaaggtcataaaacattaagaagtaagatagaaggaaggaaagaaactgcaaatttatcctactatataaaccatttcacttgataatttttttcacttagaaacatttttaaaatctttacaaaattataaaaataaaatttaaaaaataaaaatttggggtccagattggtggaaatatatatctagcctacaatatctcacaaatgggttactgacaaagctgggactaccaccagctattctaaccactactcacatcaccccaggtctcctatgcagtttcttcactaatttccactttcttttccttctctgctggccccaacacgtaattaaaataatcagtcaaggttagtacaccttaattacttataacatccatggtctaacaacgctgacatcttccttggcagtgttagccaagaacatctgagaacctcagcctccacagtaaacatag

SEQ ID NO: 164367 - DNA, 159 bp, Homo sapiens
agagggagggcctaaactggactgagctgtccctagctgtgacaagactcccagccttgttgagacagagtatgtaaagtgcagcagctatattttttgcatatggaattttggaatgaatgatcttttaagatattttaaaagtttgttttctatgat

SEQ ID NO: 164368 - DNA, 620 bp, Homo sapiens
tgcttatactgatccttgaatttttaacttcaaagtgtatatagtaaatctggtttctcttcatttctttgcatgcatctatcagcctagtgatttaaggaaacatcgtagaaaggtaaattgtttagtaatttaacatatctttgtatctccataatgtattgaagagtacctatcatattttccataaatgtagcattatgtagttgtataataatgaatggttggcgttttaatggaagtgtttaaagtgacctagcaccttactgacaattgttctattggaaattggtcattagcggttttcacagaacactgggacaaatgtaacagcttgccattctctcaccttttcagccttctgatcattacatgcttattcatagatgtagtagttttaaaaataagaaattactagtgcaaagctatagaatgtagatgcggggggacccattttcataataatcacagctagcattgggctcttgctgtatgccaggcactgtgctgagtgctttcccagtctggtataggctgagtgtccctgatctgagatgcttagggccagaggtatttcagatttcagatttgtttaaattttgaaatatttgcattacact

SEQ ID NO: 164369 - DNA, 327 bp, Homo sapiens
cccggactggataaataattagacctcttagttcctcattttcctcatctgtcacatgggataattatggtgcccacgcccaggcatgtcatgaggatgaatggagttaatgtttataaagagtttagggcaggacctggatgtgaagttcattcacactgggccatcttttcctccagaaccagaggggtcaggactgacctgggcacatttatggatccaactcaggccactgtgagggcttctctgtgtccacctgccttggcccagtactcacagggacacccccaaggtcatgtccatgttctcgttcacctccggcctctg

SEQ ID NO: 164370 - DNA, 106 bp, Homo sapiens
ccggaaagtagatgctgggtacagaaacattaatggttgaagtatatgataatgtttcttcaactcaaatctaatgtttccaattaaagaataaaaagatgttgct

SEQ ID NO: 164371 - DNA, 298 bp, Homo sapiens
ctagaatgtcccccacaatgtctccacttgcccagctctgtcctctgtgtccagctttgaggctactttctgcagtcaccactattatcccaccccatgtagttctctgtccccgacctgcatgtaacctgtttccctcctccggccgctctcagccgctccttcatgcctccttcctgggctccctttggtacttgtgtgtgcaccgccttctcgcctccaagtctgcagttcctggagcattgagtcatcctgttaccattgcttctgactcgaaggacacggccccttggggctg

SEQ ID NO: 164372 - DNA, 379 bp, Homo sapiens
actacatacttccgcatctctattgtgcatggtaaatactgtattctcaaattcctcaaggcattatagtttgtttgcagctcagccatttggaatttcatcataaattattactcaaaaaagcctggatcttgaaaataaaaaatatactatccttctaagtattaagaactgaaactatctatgcctgcccaacttactctgcacatgaacatgaatattccaggacactgttgcccaggaagatggagttccaaaggccttttattgtatatttcagggactcctagaagtactcaaaaagtaaccatagataactcaaacaggttcaccaataatccgaggcctgctttgaacggaagtatgtagtctgctaccg

SEQ ID NO: 164373 - DNA, 434 bp, Homo sapiens
aaaataagacggtaatatctgataaaattgaaacatgcatgcactatgacccagcaacagcactcctgggtatacatctaaagcagagccaaggcatgttgatgggcaggaagtgagttacagggatacatgagacatcagcaatccctcagtccttagggcaactgagaaggtcttagggcagccagagtccctgaaccagtctcctccaaacttgagcagccttatctatttatcccagtgagctgtacaaatattatcattttctgcaggtgccatcctatgaaaaatattcagaaaccctgtgctggagcagcactatccaatagaacttcccacagtgacaggaactttccatatgtatatcatccagtacaataactactagccacatgtagctattgagcacttaaaatgtggctaatgcaaccaaa

SEQ ID NO: 164374 - DNA, 506 bp, Homo sapiens
agacaggtgcttggagcagtttggggatgacaaaagtactaagatgacgtctcccagcctctaactgctcatgtgtcttgtggctgtcccagggcactgagggctgactgggcaccagcgtcatgtggaatagtttgggaagtaggaaagagacatgctggcctgagaggtccagatggacaactatatatttctgagggggagcactgacatctggagttgagtccaggccactggatgatgaagaccttacttcctctggggactgagaagttttcatgattcactgggaactggagatctctgcggtaagacagtgcctaaaggttcccctgccaacagctgatgcagcccttcactgtccctctcccactgccctataggccctggctgttccctacagtccctttggcagagcgcaaaaatggccctacttatctcgctcatctccacccagccccactgcactgtgcctgtcagtcctcccgtctagggagggagtctat

SEQ ID NO: 164375 - DNA, 378 bp, Homo sapiens
ttgaatgaatgctgaaccagccttgaatacctgggataaatcccacttggtgtataattctaacatccctgccatatctgactctggttctgatacttgctctttctcgtcaaactgttttttcttgcctttaatatgtcttgtaatttcttttcttgataactggacatgacacacaagttaagaggaactgctgcaaacaggcctttagtaatgtggtgataaaatatggagggagaggaagggttctatagtcctaggagggggtctcaatcttttagtgagcttgtaccactgaactgtgaacttcacacatgcttctcaggcccccctgacccccttgcacaggacaagatggctagagtgtattggagttgg

SEQ ID NO: 164376 - DNA, 330 bp, Homo sapiens
ttgaatgaatgctgaaccagccttgaatacctgggataaatcccacttggtgtataattctaacatccctgccatatctgactctggttctgatacttgctctttctcgtcaaactgttttttcttgcctttaatatgtcttgtaatttcttttcttgataactggacatgacacacaagttaagaggaactgctgcaaacaggcctttagtaatgtggtgataaaatatggagggagaggaagggttctataccaagtgggatttatcccaggtattcaaggctggttcagcattcattcaaaagtcaattaaggtagtccaaaggcag

SEQ ID NO: 164377 - DNA, 451 bp, Homo sapiens
tttatagatgactgagaccctgcagaatgtgcctttggggagtgtacctttgagaattcccatgcttccatagggtggggccactttccttaggcagtgagtctctaagccttgttctccagaaagggatgggaatgactcaggagattaaacacttttgccttcctgattgttttgtcaatacaatacagtggttttatgggaatacccgagtagtgtgattatcagtttgagctgatagggatcttcttgatgagtcctatggtgctcactgggtgaaccaaggctctctgtggggaacgcaccaagtgcctggacaaaccacagtgaatactatccatgagctctttctcacatcacttccccattcttttttttttttttttttttttttatttaaaatggggtcgggcttggtgcgccaggtgggaggccagggaggctggcaaaa

SEQ ID NO: 164378 - DNA, 577 bp, Homo sapiens
ttaaggatcttactttttaaaatggaaggcatagaagtaggcaaatatgcaaggggagaaaaagaaaacaaaaatcaaaactaataaaaatctggacaataaagtaaatgcatcatcactcatatttccagaggaaatgctacatggagaagaaggtcagggataagtgcctaattagaatagacagaaaggaaaagaaaaatagagaactaacaaaaactgactatgctaagtgggactgaagagattctcttgtaatacattctaaaaatcttcctggaagtggtgtttctaataatgatttgaaggatagcagtaaatgttagtggtatagaacagaggtgtaatctgttggaaaagtgagagcaagaggtaatacaatttcttatggaataaacctttgcattggtctcttttggtagactaagaaaacgctcgaagataagaaaactgctttattcatgtctgaatacccaatactatttcatagggttgtctgggggtcaaattagttactatgtgtgaaagacctaatagtgagcttggcagagtagacacataataaatgtccctagat

SEQ ID NO: 164379 - DNA, 388 bp, Homo sapiens
gaagtagtcataggtataaattttagacacgaggtcttagagccaataaagttattggccagctaaatcaaaaatggtttgtcaaaactactgcagctctctagatccaatcatattgaagaaaaaaatagagataaaaaggacagggaacttacaataactacatgggacaaagtgagttggtaacaaaagcattaacctgaagataaactgtatcttacacagtaatatataactttccctttacaaatatatttctccttattattttggcaaaaatctaatatagaagcaacttttctaaaagcaacagcctaaaagcaacttcaattaagaacttgaaaatgtgcactctaaactacttggaaaagccagtaattcatactct

SEQ ID NO: 164380 - DNA, 422 bp, Homo sapiens
gtgaataatgctctttagcgccactcctggtaccaacgatcttaacctggcttccacagaaaacagaaatggaaacagaggcatctgtgctgtgattctgttagggagtgcagtcctagagggttggagggaggagtaggggagtgaaccagggaaggaaggagggcaatgcgatgatgttactgagctgagtgttaagtgggagtgattggttcatcctcaggaccctgcccctgagaagcacatactgcactcggaatcattccttccaggtaaggaaggggagaaaattgatccatgggccctgctttctccgtagtccaaaatttgtcccactggtcctaacttgctctaccttttgggttgcacgtgtgtgatatgggtgctgagaagagttccacagtgactccaacagttaaatt

SEQ ID NO: 164381 - DNA, 399 bp, Homo sapiens
agacaagatggtccatgcaaatgagctgacacaagtcatgtcgtgtgcaatcaagataggatcccagacatcttcagaatggtttacagtcacaagaaataaagttccaatgaagtggttggcatttggaagcacactgttttaaatatatctccctgaaggtatgtttatatattagtgcactggtcaatatctgacactatctgtcattttattgcaaaaggatatcagggcaattaataggagggatcttagcactactttagacaatctttaaagcctgggtaagattcattagctacccaagtggcatttctgacttcaaattgtagtatcatgcaagatttatactgtattaatggagcctggagtaactctacatttaattatttccattat

SEQ ID NO: 164382 - DNA, 339 bp, Homo sapiens
catggggtagatatttttggaagtttgggaatggtagcaagctgggtcaggagagataaagcccagatcaaatatgggcaggagaggctcagtgacaggaagaacttgaatttgggcagtagccagcaatgaccaggatgtgaggcatgaaggcttcaagtttctgaaaggaactctggtataaagtattttgtttgttttggtgctacctgacagattggtgaaaagctttaggaagcaatactactgcagataataaaattatggtggggctaggtgctgtggttcatgcctataatcccagcactttgggaggccaatgtgggaggatcacttgaa

SEQ ID NO: 164383 - DNA, 136 bp, Homo sapiens
cggctcctgatcaccggtccatcaggcgagttgtcagcttgttttataatcacacctatggatacctttgcaagacttcacgcctctactccaacaataaactactaaaacctctggaaacaatctagaacttgca

SEQ ID NO: 164384 - DNA, 396 bp, Homo sapiens
ctgcaacctccacctcctgggttcaaccgattgtcccgcctcagcctcccgagtagctggcactacaggcgtgtgccaccactcccagctaattttgtatttttagtagagacggagtttctccatgttggtcaggctggtcttgaactcccgacctcaggtgatccgcccaccttggcctcccaaagtgctgggattacaggcatgagccaccacacctggccattttagactttaaaaatttagatgagatggtctgttccaccagaggagtactctgcaaagagggaacaaccaagcacagaactgagtgataggagggactccagccatgcaaatatcctggggacaaatgtcaacttaccagacactaatactgagcaattatgtgacctc

SEQ ID NO: 164385 - DNA, 390 bp, Homo sapiens
gtgcctgcctcccttatcccatggtagccccagcatcatgtcacacccagtattctggcctctcacaattcctagagcacagcactaagctctcacccaccccagggcctttgcacatgcggttcccattgactggaccactcttcccctgactggtactttcttatcctctaggtctcaacttaagtataacctccttcaagagaccccactccctgggccattttttaaattatggtaaaatggacaaagcataaaatttaccattttaactacttttattttatttatttttttgagacagagtcttgctctgttgcctaggctgaagtgcagtggtgcgatctccactcactgcaacctttgcctccttggttcaagcaattctcc

SEQ ID NO: 164386 - DNA, 704 bp, Homo sapiens
agccagctccagcacaaaaatcatcatcaagacaatcatccctcatttcccatctcgcctcacaggtataaagcaccttcttatgcagtaatatctctgagcttcccagcagctcgccagagaagacaaattattcccattttccagataaggaaactgagactcagttggtgaactgcctgtctctggttataaactcaaaccaggtctccttacccagagcctctgctctgcgaccacttgtcccacacaaatcatgagccatgattcttacccatgccctccaggcagaccctctactcctgcaaggacccgtcctaccccatcagaaacataattgtggcaggttctattattgctcagcaaatgtttcttcagcctccatgagaggagtagacttcaactcattgatgtcaggcttgccacgtgacttgcttcagcctatagcatgagagcagaagtgacagcttctcagttcagaacggaggcttctgttgtccaccacagaagaacacgccctggctggctgccacccttcagcctgtgaatctggatgaagattcacgagccagacctgaacccaatccaaagcctagggccagccttgctggtgaagcctagctaaggtcagccaagctacctgctgactcgtgagcatgaaacaaatgtttgctgttaaaggccactgcgatgtaggagatgtt

SEQ ID NO: 164387 - DNA, 436 bp, Homo sapiens
  misc_feature (46)..(46): n is a, c, g, or t
  misc_feature (225)..(225): n is a, c, g, or t
actgtctacaaaaactgcactagtccattacccgtattaagtaaanctgttctctcgccagtattaaaggttaggataatttctgtacatgtaaaattattgcttttttgaaaaatatatttagcatgctcgttttaatccatttcctgcctttacaaaatttcacaattaaaaaaaaacctagtaaagcttttgcaaaaaatttcacagaacattttcattcanaccctgccgaattcggcacgagccagaaccggagtggggacgggagcgagaaccaaggtcggagctgaagggggcacaggagcctggatgagagccaagggaggagctgaaactgggactgaaagcggggcaggagctggagccgacaagggaaccgggcctgaagggggagcagaagctggcacaggcaccaagactgaggccgaaacag

SEQ ID NO: 164388 - DNA, 421 bp, Homo sapiens
gggtcagagccaccctgttcaggaaccagaggacagcctccctaggccctgaggcggagggcctgagatgtttcgaggacagttcagaaactcaaagagtctgtacggacctcccagggtgtctccaaacttaagacaggactgcacctgaggctatcacagaccgggtgggccaggcatggaaacagacagtccccacagcaaggaaatcctccccatattgccaggagcagcccataatcttgatcataaatttctgtaagtgatccatgctatgccagcgctcctgctgggcaagaccaggcctcaggttcccggagccagccaggtggccgtatggcagctgactcctgttctccacattctcccacttaacagagtataaacacaaatattccatttgaatttaccattttaattc

SEQ ID NO: 164389 - DNA, 347 bp, Homo sapiens
cacccttggctaatttttttattttatagagacagtctcactatgttgtccaggctggcctcaaactcccagactcaagccatcctcccacctctgcctcccaaagtactgggataagagatagtagccatcacacctggcggcccacaccctttgacctagcattacactaacaggagtttattctaagactcatacttgtgtgagaaaattcttcgttcactgcaaaatctggaagcaacctagaaactgcaccacagagaggttatgtggacagtctgtgcacgtaacagaaaaaaatgaatgaggaggctcgctatatactagaattaatgcctgtcaaaata

SEQ ID NO: 164390 - DNA, 418 bp, Homo sapiens
ataaaagtaatccacggtcaggaatatccacaaaatcagaagtaagcacttttccagcaagataaagtcacaataaaaaaaaatatatattcagtacaacataaaattaatttctgagtgcataattctgctatcaatttccctggtttatgtagtgacctctgagacgtgtggtcaggagaaggtgggctgggctaattacaaccgagggtgagttaacagagatatcaggggcagcctcagatgaggccaccaaagatatcaaatacatatgtcaccctttgttttgtattttaagtttgtatcagctcccatgccggaaatacaccccgtcaggagtttgcaatctggagtctgattgaggtgacaaacacggagcagctttgggacaggatttgtccaagactgggccaagcca

SEQ ID NO: 164391 - DNA, 261 bp, Homo sapiens
caaggagggtgtcaagcccttatctgatctggatttctaggccaaagttcagccttccagcctgagtgcatgcaggtcacttctgggtcccagatgtgggtaggtggggtatagccaagtggaaccccacagctcaggaatccatcagacctcaccatccactctgcagaaaagggacctctcccacctgccccagtgccacccagctcttccgatcgccacttccttctgcttgacccttcttgccgatacttccttcct

SEQ ID NO: 164392 - DNA, 328 bp, Homo sapiens
ggatgttttttctcgcagaaaggccaagtcattgtcaaatggtagactataaagatccccaaatcagtgactaacctctttatgatctcggggaaatattctgtggatttttttctccccactcaggaacaatgaatggtgacgatctttaagtcaatgatgtgaatgaatcacatgtggatgaactaaggctctttcctgattctcagtcctaatgagcagctcttcatttaacctgtgggattcgtttgtgctgccctgaaaaactatgaagttttggcttgaggttgttgagatcctaaggaaatatcagccaaataagtcattt

SEQ ID NO: 164393 - DNA, 363 bp, Homo sapiens
gcgaatggctccgtgggtgagagagccgggagggctcgcagaacgatgaggacgtcccgtgctgtaagagggacagtgggcagagttaaggtaaggctgggaaggctgacgccccctgtgcctggagagctaggtgtggaggaaatggaccaaaagtcaggctggaagagggagcctcctggtgcagggcatcgggttccacctcagagcactcagaggcgaggatgggccacagagaaatagaaatagttttggaaaagaaaatatgaatgctttccctaagtcctagaccaagctgaggggaagcacctttctgtctgagaacaggaaaaggccagtattgccaggagccagtgagatgcc

SEQ ID NO: 164394 - DNA, 331 bp, Homo sapiens
cgagggtgaacacttctttggtgttcctctgtgctagccagcgtcctgagcgcttcccacacatgagcaacatgtggggtggttactatctcaattccactggtgagctagggaaactggggcacagggaggttaagtaccttccccaaggttgcccagctcctaggtgggagagctgggcagtctggctccagagtcctgctcttacccactgaggaagacgcctaccgcgccagctgtctacctcacgttcacacagtcaccctgtggacagaatccacgcacacctctccagtcacccctcacccacgctgtcactcatcctcacagc

SEQ ID NO: 164395 - DNA, 579 bp, Homo sapiens
ttattgtggtgttagcttctttgttcagttacaccgacagctgagttttctatttggggccatagttttggggtcatgattcctggagtagaaaaaaaacaacataggagctcactcagaaggatccctgggtaaatgccatcctttcctgggccccagtttcctcacgtgttcagggggaaaagaaggtggtggtgaaatgccccccaccagctccaaagtcctgtggttctgaggctggaatattctgcaaaaggacatttgcacaccacccttccactgcccccgccccagtgtcgtgtccaggtccagttctaccagccacagatgtgagcatgtctggaacctgtctacctgtctcattcattccatgacctctgatttttgaggtcagtaattctgcagcctccctcacctttctggtttaaagcaacctcctctctcaggaagttgtttgaaatcaatttaattcctttatatcccacatgacagctacgactgccactgtttagttgatgttggcgtcgggtttggggcttacttggcttttgtgtttgcttctaacctgcagaaagagtc

SEQ ID NO: 164396 - DNA, 821 bp, Homo sapiens
gactgttcatgaacttgggtacagggctattgacagagtatcgtgctgggaaaagaaagatcctaagctcatagtgtggggcagtcattttaaccccttgcctttgctatcgcccaagcaggttatacaaagcagagcacaccaaccgtgcccataaccccctcacagtctcctcatgccacatagtttctgagttattttcttctttgtgaatattctttaaatccattttcaactagacatgataacaatgagaactgggttaggaaaaatcattatgaattaaccatgttgaattagccctaagaaatgcctcttgccagaagagctacatttgttttgttgtttaccctcttccaaatcagcaatccttttaaagagaaaaatctactttagtaaaatttgggtggctacatgattactcacttacccatgtggttcctatggaaagtgccctcttcaatcacccagaaatattatgacaatggtcagaaaataggaccaatgaacaaagaagcaggagtccctgtgggttaaatgagccttgatatctttgctccagaaaacaccctcattgtagagcgtggtgtttgggggcatgaatacttgagttctgcttccaggggctcttgcctggttcccatcttttgacacactacatcttgaagcctcagttgtctctccgtcaatggcctctttctttttgagactactggggagggggctatcctaagttggcaatgtgtgataggtactttgggagatatgacagagaaacaagcaactttcttaacagtgctcccttgttaccctgggtcatg

SEQ ID NO: 164397 - DNA, 396 bp, Homo sapiens
aagaaattttatgggagaagtatgaggtatttaaaagtcatctgcctttgggaaagtgaatgctttaataatgaaagacttctttgtaatggctcagaagaggaagagtctaagcttttcttggtaatgttatatcatccatgctacgtcatcatttcagagcagagattctgcgctgtggagaggccagccgcggaggcaccgtgggggcatttgcctgtgtgtgttgtgcaccttttcttccattgtttcctgtgatctgccttcctcctctcctgccctggtttcctactgactgactctcatctcattgcttagttctatcagttacctggagctaaaaagtgtgctgacccctgatctaactgaatgcctttcctataatttttgactatt

SEQ ID NO: 164398 - DNA, 347 bp, Homo sapiens
aaaaaaagggggggcagcaatgggtaaacatgaaagaccttcacctaaccttgctctatgctggtttgtaaggagactttccggctcacaggcttctaaagtccaatggagtacatagggtaagatgattcttctcttatggcaaacgcctttctagatgggcaccggtcttggcctgcaggctgcttgcttaggggtatggggagagaaacattccctttctcatcctgcacataatgcaaccataaaaggttcagaagcttagtcactcttacagacttggaagtgtaaactcgatcctataaacaccagaatttttatttctacttcaaaaataaattgctttt

SEQ ID NO: 164399 - DNA, 404 bp, Homo sapiens
ctacttatcttggtataatcctccaccaacataggtgtgcacttccagcagaccgtattcagctaatctccaaattccaatccccaccaccaaacaactactcctctccttcttagacgttgttggatacttctgcctttggataccaggttttgccatcctaaccaaaccactctataaactcacaaaaggaaacttagctgaacccacagatcctaaatccttccctcgcccctccttttactctaaaaaaggccctagaggcaacccctactcaagcgcttcccgactcctcccaaccctccttcctctccacacagcaaaaacgcagggctgcgctgtaggaattcttactcaggaaccaggcctgtgaccagtagcctttgtattcaaacagcttaatc

SEQ ID NO: 164400 - DNA, 348 bp, Homo sapiens
cggatttctatacattgactcttgttggttataaaacagcagtccaacgacgtgtcaaacaatgagctggtttgatgggacgactgatgggagaagagcgcagtcttctcccatcaggaggtctatacccatccgacagtaactccttcccctccccctgaccattgttggcactttggaaaagagttgctttttttttttggacagctgatgggccagtccttcgtcccatcagggatttctatatatggatctcttgtgggttataaaaacagcagtccaacgacgtgtacacaatgacgctggtttgatgggagcaagagctgatgggagaagatgcggggtacc

SEQ ID NO: 164401 - DNA, 543 bp, Homo sapiens
acattatggtcctgttactactcacttattttctcatgattacaagttggagaagagctaaaagttctcaaaaaagcagtttttaataactgttgaactatttttgggtgtaattcaactatatgtatcagtaacaagttttgttcttattatttctcatctcttttagtcacatctgccttgtcaatgagaagaatgtttatgaaattaaaaagttcattttgttgaatcagctacaaaaatatctgaaccataaaaaaattccaaaaactatctcttaggagccaaagggtagcccttatagaattttccatggatagatttgcttacttaaagtatttggcaggctttgaaaacataacagaggtcaataatttgtgaccacagaagatctgtgtttagtttaaatctgtatgggcacataattaaggcagaaaattgaacacaaatggagatctagttcaaacccatttgtaaaaaatgagatggaatcagaattatcaaatcagaatgcacacatgatataggaacctcatgatgacc

SEQ ID NO: 164402 - DNA, 351 bp, Homo sapiens
atggggcagactgtgagcaggtgtatgggttctgcatcccgctccagccttatgcactgtggagctgaggaagagtctggaacctgtcaggacagttgtgaggtggtggggcccactttccagcagtcttatatgaggaccctggaaatgtgccttcagcactgctgggtttttatatcaggggccccatgagttcatagctgacctgacacccggactagtaagggctgtgccttgttcttgcctcccacttggtgaacagcatcttgaggtatctttcccatccttagaaaccaccccaagtattgtcaatagaaatgtggggtgtaattgatcacgccatgaactcat

SEQ ID NO: 164403 - DNA, 398 bp, Homo sapiens
ttacgctaggggacccagttctctctccatgttgggccagaccctttcttagccctcttttctcaggcaagccctcaacaaatatgtgttggattctaaagaggtaggaaagttggaagaagatggccagatgtttaattgacaaatacccttgaccatatagtttcacatgggcagatagcggtgagggcgtcaaacaaaaatccttcattgaaaacatattacacataggtatcagggatatgaagatgactagggcacagtcctcactcttaaagagctcaaagtgtaattccaaccacttctccctatcctttgctcctcttttaaatggggactaatgataccttccatacctgctttacaaggttgtgtgaggctcagcatcttagagctaa

SEQ ID NO: 164404 - DNA, 409 bp, Homo sapiens
  misc_feature (16)..(16): n is a, c, g, or t
  misc_feature (20)..(20): n is a, c, g, or t
  misc_feature (23)..(24): n is a, c, g, or t
ctgactctagaggagncccnccnntccccgggtaccggggcagtctaaacattgcagccttctgagacaggcacccaggaagaccaggcaagagtacagtcatgtactcactgtcagtaaacattaggctttcacaaagtccaggcagacttcagaagacgtggatgaagtccttagtgttagctctcctggggcatttctctccacctagtgttgttagtgccctttggattgggtgagggaggggtggaggaggtgaggaaggaaagtgtcgagaaaggcaggcgcccactgactagagtagggaagtagctggcactttgggaggccgaggcgggtggatcacctgaggtcaggggttcaagaccagcctggccacatggcaaaaccccgtctctactaaaaaata

SEQ ID NO: 164405 - DNA, 570 bp, Homo sapiens
gcgtgctgactctagaggtatcccccaagctagttatacagactcaggcggttgaaaaggctttcctgaagaaatgagatgtttgttgaggttaagaggagagaagtagatgttagctggtgggggcagagagtgggtgaacgggcttaggaagaggagagcctttcatccgaaggaaactgcacttgcaaaaatcttaaggcttgcaacagtgagcagcaaatgcataagaagaacctaagaaaggccagccaagcaggggagcaaagaaccattgagcaaagcagtgataacacaggtggcataggccaggcatggtggcttatgcctgtaatcccagccctttgggaggccgaggcaggcagaacacttgaggtcaggagttaaaagaccagcctggccaatatggtgaaaactcgtctctactaaaaccacaaaaattagccaggtgtggtggtggagtgtgtctgtaatcccagctactagggaggctcaggcaggagaattgcttgaagctgggaggcggaggttgtagatcgcacactggactccagcctgtgtgacggagca

SEQ ID NO: 164406 - DNA, 552 bp, Homo sapiens
agggagaaaaaaaaaggtgcctgtgtcggaaaagcctttaaaacgttcgtgtatctagccttcccacagcattattcacctttcagcctttcctctagtgtgagaattccctctacaggaagttttttcctaacccactttagagaccctgaactctctatgggaagaccttgaccaccatgactagaggtcttgttagatgaatttataactcataagttactgacacattcctcctttgtagatgccccttccctagtatgccgcataaacacaccttcctgattttgggtatatgtaggtattctaggcaagaacattctatatttcagggacaaagaaagcagaagtagcttaagtttttaaaagaagtacctccctatatctcttattacaacccaaatttcattgttaatatcttcctgccctcaggatttccttctttaactgatttgatccagatattgacagaagagtaagatgattgtcagagagtgtctaacaatcaggagatctgaagaacaaattattctaacttccttctggggaagc

SEQ ID NO: 164407 - DNA, 139 bp, Homo sapiens
tggagcctggcttcttgaccaggggatgttgaagtagcccaagtaagagacgatggcggttgggactgggtagcaggacagagggagtgggcagatcccactaactttcagaggtagtgctcatagggcactgatgagt

SEQ ID NO: 164408 - DNA, 104 bp, Homo sapiens
cagtttaaggtttccaagacacagaactttggaagagagttaagtaggattgctgtgagtggagttttgttttgtttgttttagtgtaaacttgttgaatagaa

SEQ ID NO: 164409 - DNA, 309 bp, Homo sapiens
tgacaattgcctaaaaggagcttccaagaaagattctataatattcttcttgtaagtctttcaaaatgaagatgctcttcaaagtagtgggtcttcaggatgaaaattactcctgagtccaagcatgatttgacttcatctttcaactctccatatcaatctcttaaaattctgtcctccggtcatttctacctagtctatatgtctatgtatgagagactagaaaactccaagatattgttacatcaacgtagcataatactggatacctacagagacgtgaaaaacaccagggtttctctttctgca

SEQ ID NO: 164410 - DNA, 146 bp, Homo sapiens
ctctagggtcaagcccattccatcacccgctggccaggtgggtggtcttagagccacagcgggggtgcaggctgcctttgggcacctggtgccccagccgtgggtgtgcctgtggggcgctgacccgaacgggaactccttccagt

SEQ ID NO: 164411 - DNA, 622 bp, Homo sapiens
gctatatcaaggtgtctggaaagtaccttttcagcactggcacaaggctgtgtttcggatgtttcagtccagccattgtcagaaaatgacttcccacgctcacgccacagataaaagcccctgctggggctgagaccactcaggagtcatcttgtaatttccactgccacctgctgcctaccacacgtgattaaatacgagtcacccaagatcccaaaacaagagctggggatagtaaaggacttttgatctgtctcatcccctcccgttctcagcagaccacggtagttagaagctcaggctgtgtggtcagacccaattgcaagctctggccctgccacttgttggctgtgtgatctcaggtaaactatttgacctctctgtgcctctcaccttctcaactgtgaagcagaacaccgtcgaagcttcgacggtgtctggaggtagaagtaatacctggaggaaaatgaaaaattttagaaccagttttctgcagcacaaactgccataaacaatgtatttgctataactgtccttggtttctaaatgcatagtacagtgattctttcataaaatggacgacaatgaaggcaaatggaaatgaaggtgctgctcaaacaga

SEQ ID NO: 164412 - DNA, 347 bp, Homo sapiens
cataagagatagcatcctcctcccatttttcttcagaaaaatctcttccaaatcaaggtaaaatttcccccaagtcctgggggaggtcagtgagcctcagagctaaactgatttgaaggcactggcaagaccacatgcctttggcttgtttctgaaaatccataaatgtgtgttcattcatcaaatcacctgcaattatgccttcttagtacatactcttttttttcagggttgcatttaaaaaaaaatctccttaatatgaataaaagacatattaaaattagacttacaaatgggatcacaaatataagttacttcttcatttggcctaacagctaagagaagcc

SEQ ID NO: 164413 - DNA, 550 bp, Homo sapiens
tgatgatcagcctgccctatggatttcagacttgcctcgtcacacctcgcaattaagccaattccgtgcaaaaaatctcgaattatacatctctcacgggttctgctgagaaccagggagttattcagtagttgttaagccaaagggcatcagaataaaataacacaaggtcaaatctcatctcttctccctgcgaccttcgtggctgcagttccttcagctataaagtggggatctcggtgttcggtgcacaggcatcctgtgaagggtaactgctctcaggagtgtgtacgttcactacacatcaggactgagtgatggcagctgctcttatactgctaggctattctgggccatgagcaaataaatgttcagacaaaaaatgcggctggtgttccctcaccattgcttgacatctaaagtttagggccttggagtgacctaatccggcttcccccagcttgctcccgcagtaggcaagagggcgcctgcgcacacacagacacgtggacgctgcaccccagcaggtgcaggacaccgaggcggccgc

SEQ ID NO: 164414 - DNA, 480 bp, Homo sapiens
ccataccaaatttggtccttgtctacttctccgtctcactctactatctgccttagttacttatactcttattcatttatcttcttttaattccactaacacattagtggtgttctcctcttcaccccttcacacatgctgctctgtctgtgagaatgctttctctgcgcctccagtccccgtctctttccttcatttacatggttatttctcatcctttgaatctcgcttcaaagtcatttactcacagaggccattcctgaaaaagttaattgcaagttaaacccccctgttttccttaagagcactgatgatatatttgtgtgtttactcaatgttagtttctcccgtcagactataagctccctgaaacttacctattttgtacaccactatattcttaagtctcattacagagcctggtatgtagtcagcatttaagtaaatatttgagggaattaaatgaaattttttttttaa

SEQ ID NO: 164415 - DNA, 493 bp, Homo sapiens
gttttgttttccccttggccattcccagcatgaggggctctgcccctgcaggtgaaggcttgagcttcctaggtgggactggaaactggatcttatttggagaataataagagatgaggaggaaacttcttaaaacccctgcgaacttactagtttcatgttgttttgaactgccacctactggtcaaacagtgggagcatttgacttggaatctgagccagtcacgctgcccaaaatagcaggaatccatgcaaaggatgaccccataagccccaaggatatattaagaagtagcatgttgacagctgacagcttcctgctaagtcatccacttttatttgcttcctccaagtggtatcttcaaatggtattatatcaaaaaagatttttacagagcaaccagccttggctaaatgcaattttcagacattctaaattccaaaggatcttggaaaatggtctcagaaacccagaatactttctaggcagtta

SEQ ID NO: 164416 - DNA, 763 bp, Homo sapiens
ctggaaattctgagtatgcctgggtcaaagaaatgtgtgattggcagtcgccattcagaattcaccaagctacaataaaactgctgcacttgagctcagaaaatgaaaactgtaataaggcagaatttgccaaaacacaaacagtgaaagctagtttccccataaacatttccaaaacagattaattctactaattattttcaaaagtccttcaatccaaggataatacatgtgtttctactgaaaacactcaagagtaatggcattgtcaccacaacacctccatctgacccctactgctgctcactccctgctcaagagacatcctgtccagctgaaggcttgtcccacaaggcatattattctccttccctacagagccagtgacacgattcttccaaagtatataaactctgcgtgttcatctctagcttcttaacctgcatggacataactatttcaacatgtactactatccctctgcctttttatgtagaaaaatttatttctaatcctctcctacagtgtgtgaccttaaaccttcccagctcactccagcttctctccaactggcatgccagtagcagaggctctctggaggttgagaatttacctctcagatatctgatcctaccaaattgggtacagattttttttttttttttgagacagtctcactctgtcgcccaggttggaatgcaatgacgcgatctcggctcactgcaacctccgcctcctgggttcaagcgattctactgcctca

SEQ ID NO: 164417 - DNA, 381 bp, Homo sapiens
aatgtgtccactcctgatgagggaccgtgagcctttccaggcgtttgctgttatgaactgtcctcctgtcggtgattcttgggtgtctcttggacacatgcaaggcctgtgtgcagcccaacctaaatgtggccccaggtcggcccccaagagccagttggtgctggtctccaggaggccaggagcatgagccagaaagagcactggccatgccacctcggccctctggcccagctgacctcgctttttggtagcagtgctctcccactgaaggaagtatttgttggcctctctctggctcaggctcgtaggtggttttcaccactatttgatgagccctgttagggaacacgtagaccaagaccagaacttgcacatttc

SEQ ID NO: 164418 - DNA, 466 bp, Homo sapiens
cgaaccactggcaacagagtgagacatggtctctaataaaaagtaaaaactaaaaaagatttttaaaaatccattgttccatttcatacagacctttacccatgcatgattttggaatataatacattggtcatttggaagataatggttcaatgagttatgtggatcttctaaatgttgacccatttcattaggcaatttaaaaattcattaatatggctgggagtggtggctcacacctataatcccagcactatgggaggccaaggtgggtggatcacttgaggtcaggagtttgagaccagcgtggccaacatggggaaaccccgcctctactttaaaaaaaaaaaaattagccaggcatggtggtgcgtgcctgtgatccttgctgcttgggaggctgaggcacgagaatggcttgaacccgagaggcggatgttgcagtgtgcttccggggtaccgagct

SEQ ID NO: 164419 - DNA, 218 bp, Homo sapiens
gaacccctccctaagggacgatgattaggtcctggctatgcttatctatatccagaattaaccttatttgccttaccaaaaagagcacattgaatcagaattcctagatacaattgaagtgagcttgaggaagttctgggagtggtgtgaagcagagggaagtatcgtatcgtatcgtatcgtatcgtatcgtatcgtatcgtatcgtatcgtatcgt

SEQ ID NO: 164420 - DNA, 523 bp, Homo sapiens
ggactggtgttatactccatcagtatcaacagcacggcagagacaaggacaagggacatttgtgggcgctgactgcaccctgcctgaactgtcatgggcggaagccccccagctccaagctcggagctgcagttgtgcccattttgcaggtggggacaagtaaggtaacttgcccaagaacagagcagatgagatatttcggccgggcctagagctgcccaggtgacctcacctgccacctgcagtggacttggtgagcctcggtcgcgtggcggcctgcggggctggctgagtgcgccttgcccagcaggcagagcctcctggcggggcgggcgcggttccagcggaggcggcctccaggctgctgatccccatcccggtttcctcccacgtctccttgactgaaggagggaagagcatagataattcagctccttccagagcaaacaatggaaatgtcggagagcaacgattggaacagaactttttgctcaggtcataattgatgtatttagggtgaggc

SEQ ID NO: 164421 - DNA, 529 bp, Homo sapiens
actgcaacctccacctcccaggttcaactgattctcctgcctcagcctcccaagtagctgggactacaagcatgtgccaccacacccggctaatttttagtatttttagtagagacagggtttcgccatgttggccaggctagtcttgaactcttgaactcaggtaatcgcctgccttggcttcccaaagtgctgagattacaggcatgagccacccatgcccaaccaagtcttctgcttcttgactcatctctgcttccaggactctggtgggttttctcctgggaaccccttcattgcttcagtgattgcttgtccatgtgagctcagggtggccattttacattgtactctggtcatgccattgtcctgctcactggcctttaatggcttcctgtcattttcagaatgaggtccacagtcgtagccagcacagccacggggcccttgccctgcctcctgccaccctctgccccagccaggtcagctccttgcagctctctgtgtgctgtgctctactgtgcctttt

SEQ ID NO: 164422 - DNA, 161 bp, Homo sapiens
agctactttgaaatacacaatgtttggttgttagttatggtcactctattctgctatcgaatgatggaacttatgccttttatctaactgtaggctttcatgcgttaacctccctctcttcatctccccccacccacacccttcccagccaagtagtgtct

SEQ ID NO: 164423 - DNA, 358 bp, Homo sapiens
tatgctcgcttgatgtcctgacttggtcgaactctttaggtatccccccaggtatagtctaaactaattaaataatgataaacgataaacttagagaaatagcattccaactcatcacccaattcgaaatcttgctgatttgagacactgcacgcgtctgtcaaaacaatcgtgtctgagtaaacatcacatgctgggggatgtaatttacaggtggtggtgtgacatcatttaattggcaacgtattttgtttttagttgcttcataaaataatcaggtagagtcagtggcaccttagattctaggaaatatggtaaagatgacttctacgtgaatggcactgtgttagatcatgag

SEQ ID NO: 164424 - DNA, 470 bp, Homo sapiens
tagaatttgcagcagggcagcaagaaggccctgatgctggcagtcctgggaagcctgagtgtttctcacttgcctagtggcctggggacaatcactttctccttccgcaccttcagatcggggtctgagggttgagtccccagggctctgggtcagagacacaatgtcagagttgttccaaaggacagaaagtcccctctcctccaggcgcccaagcctcacccttaactcctctgggtcaggccacctcctgtcccctctgcctgctgaaggtgggaggagtagggaggaggggtggggtagcagaggagaagggccctggaggaatggcgagcccctccagggccagggtgtctctccccatccccgcccagagcacagcggactttctctagttcactcctcccagcggctgggtctccaggtgccttcctttaattaaaagtatttagccttccgctacactggcc

SEQ ID NO: 164425 - DNA, 479 bp, Homo sapiens
caagttttggacccaatgcctgttttcaattctcttgtgtagagagcactttttagcagaaaaagaatagatttgtggcctccctttgtgtgcggtcagtgccttgagaagagtgaactgtgctgccacctccggagccgtggagagcgcggggcttgggtagcagctaggacgatacaagttgggacaaggccaggtgcaatggctcacgcctgtaattccaacactttgggagaccgaggcagggggatcacctgaggtcaggagttcaagaccagcctggccaacatggtgaaaccccatctctaataaaacagaaaaattaactggacggggtggtggacgcctgtaatcccagctactcgggaggctgaggcaggagaatcacttgaacctgggaggcggaggctgcagtgagtggagatcagaccactgcacttcagcctaggtgacagagcgagactccgtctcaaaaaaaa

SEQ ID NO: 164426 - DNA, 624 bp, Homo sapiens
ctgagtcctagctgatttgatggacaccaggttgtctccagtttctcactgtaataaacaatgatgcagtgaacatcctgtgcacagtggctttcgaaggtagaagccaagaagtggacgtgatgtaaaaactttgtcaaattgccattacttttataattaaaaacaaacctaaaagaatatgtccaaaatgcttggggagaagcctctaactccttcccagcagatatgtactctgggcaaagccttcaagaacaagtacgaatttgccaaatggacaacgtgctgattctgggatactgtggcagaggagacagaatgctatcgcttttcaaacggcaagattttacatttaaactcacagagttatccacaaggcaagattctgtctctgtcatagctaggaacagctgaagagtctgcctcttgctccaacatggctgggtaccgtggctggataaccgttcccggtgcaggtaacaggtggacaatatcacaatatcactgcacccctctcgtgaaaaagaaagggaacacagtctagcactcaccagagaagcaggtttttcttcatcttccagaaatgtgttctaaaacaccagaaaaaaacatcagccaatcatc

SEQ ID NO: 164427 - DNA, 657 bp, Homo sapiens
ttacttggcacttagcttacacatttgccttgtactggcagtattgtacatttagcaatgctggcacaaactaagtgctcaaaaaatctacttatgattgtcttctatgcatattgtctagccaataacagtgtacgatcatacacaagaatgtataaaatgaaggaaacaggatggtgggattgtgtaaactttgagcaatataaacctagaacaataatttttatccaccacttactagtacttagaacaaagaaaaattattttacctcttggttacctcagttactcaactgtaaaatggggagaataccatgcaccttgcaagctcttgaggattaaatgagatattttaaaagcttttaatatacaacttgttgcctaagaagtaattattattttgattattttccaacgactagagcatctagaaaagtcaatgacttttcagaatgtctatgactaatggtaagtaaacaatcaggaggcatagcagccattgctttatcgtattctagagaaccaaagcacaaaatggtatctgttctcaaagtctggttattcatatgccaccaacatgatttctgccatatccacgtactgcaacttaatagctttctttaaatcaactcattttatgtaatcataatcattcta

SEQ ID NO: 164428 - DNA, 324 bp, Homo sapiens
gctgcaagctggaaagaagagggagcggggtcgtatgccgccagcagcagggagacccctcacaatggaccccatgtattgctctggcttctccgtgggcagaactgcatcctgtggtcctgcctgattcgatgatttgaaaaggcagaaacatggccgctgccattggcctggccagtgaaaacgggctccctgggaaattcacccagcctgacctgaagcagttgctgagaggcagaggagcagctccaggtgttttggcagggaagcagctggcagctgtgcgggagccccttgcctcccgtgttcttactgaggagtgtg

SEQ ID NO: 164429 - DNA, 452 bp, Homo sapiens
tatgtactgtagattgaggtctgcagctgtggttgtccaccactccagacagatgattctccttgtaaacagatgatgtaaacttacagtatcaacaaatacagtattgtaaatgtattttctcttcctataattttcttaataacattctctttcctgtagtttatttatcataagaatacagcacataatacatatgtaaaatacgtgataatccacagtttacattattggcaaggcttccagtcaacagtaggcttatttgtaagttttcttggagtcgaaagttatatgtggattttccagtgctcggggaactggcgccccaatccccgtgttgttcaaggctcaactgtatgcttgggagttcaagtacagtattgggtaacacagaaagggggggtaagagggaaaaaggcatttttatgatcttcaggtaaagacagcaagag

SEQ ID NO: 164430 - DNA, 645 bp, Homo sapiens
tgacagaaaaccttttaagtgctacctatctcttacagagtaaaatacaaaataagggatgtgtattatatttagtgtcagcctacttctccctttctcattttacagtattgtccaaaattgaactccttacagtttctaaacacacaagctgtttcccatttcagtgtctttgcacattctatttcctttacaaccctgttcctctccttttctttttcaaagccactttttagacaacacatatcaccgtcagcacctctaccattcagggcactcctgttccttcagttgactgctgtattttgaaatttgcaagtttatacttgttcctatgacaatatattgtaaactgtttagcaaatgcgtctcacctattggattatgagttccttgagagcagaggttgtcttaagctgaaatgcaagtgcaaaggcatgcagtagtcaggcaggtcaagttaaaagatgtaagctttacatgagtggtacggattaaagggggcagctgcatttggccccagccaattgttactacctgagaattttggcctaccgatgtcagaccttctgatttcaaagagaaaccggaaatttggatctctatgtgaaatatctagaactataaacattatctcaagtgatg

SEQ ID NO: 164431 - DNA, 519 bp, Homo sapiens
gcactcttctgtcctctgttcctctgccgctgttcccatctccatgacccccgatctcttctggtctggctctgtagacctctgtctccccctatctagtggtacccctcttctccccatttttgtctccactctaactctcccactagttgtcccagtcttcctccttcttggttctgtgtctcccacagacacacaatttccctctctagctaagtctctcacctctgcgtcttccccctgactcttcttttcctcctttgtctctccctctctcctcctccttttcctatctctgtctcttcccccttatctctctgattctccttggtctctctggctctgactttccctctatatccgcccccccgccccctcatatctctgtctcttcatctctctctggcccttgctccctcattccctccctctctctattcctcggctctctccggctccctctctcgcctcggatgacagcgctgcctcttttgttggctccgcagccaatcgcggccg

SEQ ID NO: 164432 - DNA, 230 bp, Homo sapiens
ctcactgcccaggggaccactcaacaccaccctccaatcagctgagcatcccaaatgcagtctccttactcctgagtgttaatgcctaactggccgctcctactcttccaggacattcccaaggctacatcctatgccatcaaaaccatttctatacctcaggggcctactccataaggctggacgtttcaccagctaacacattttaagttatcaacctgtttgctttt

SEQ ID NO: 164433 - DNA, 583 bp, Homo sapiens
cttacttggaacttttggtgttcttatatttgagatacgtctcttgtaaaaggcatatgtttgatttcacttttatctttttatctagtttgactaaccttgtctttaaattggagtagtgtgtttacatttaatgtaatttgggtataaattgagtatcttactctttgttttctacctatttggtgagaacaggggagtgagagaggaggggaaggccatggagggtgattgatgggcaggtccttgcacacaccctctggaagacaggcacactgaggcactgtcccacatgctgagggacccccacatactgaaggacctgggtgtttttctgccaactcctgtccctcattgttgaggctcctcctggtgtgtgaaccacctgatgcttctgtcccatccacaggaaggcggggaacaccccccaggcagagagacctgggcagccaccgccatgaatgagagctctctggctgtccccaggccagctatgctctgacggccaagcgtggtggtccttgcctgtgtccgagcgtggggttagttctggaacatttgatcacttctcctgctccactct

SEQ ID NO: 164434 - DNA, 454 bp, Homo sapiens
tcatgacagttagctaactttctacttgaaatcatttccttattgttcaagttctgccaatgcagtcactctcatgacagcccaaacactagctgcctcaaccccaccacatcccagcacccaagaaacagctctctctgcccttttattattatttttattttttgagatggagtctcgctctgtcacccaggctggagtgcagtggtgccatctcagctcactgtagcctccacctcccaaactcaagcgattctcccacctcagcctccggaatagctgggattacatgtgccagccaccatgcccagctaattttttttagtagagatgagatttcatcacgttggccaggttggtctcgaactcctgacctcaagcgatccacctgcctcggcctcccaaagtgctgggattacaggcgtgagccatggtgtccggcctctctctgccc

SEQ ID NO: 164435 - DNA, 535 bp, Homo sapiens
taaatatgggtgttctcagtttatagagggtatttaaaaccgtggtacgggttaaggttatctaaggagtgagcaaagaacagatctgaggattgagtcctggggcattcccagtgttttaagttccgagacatgggaaagaactcgctcagtacagtgaggagtagcagttgggaacagaggagaggagcatcttagtctgacttggccttgccccattatgcgttatcttccttttacccaaattttagcccaaagacattcttacaggtttatttcacttccataatgagggcacccctagtcagttctggaccacaggtcatttgtattaatatgtagtgaatcctgttttgactacactccttaaggggagtatagtctataggggtttacagtttcagatttgaaagaagtgtttagatctagtgaaatctcacttgaaatactggaattttctcaataatagtgacttttatcatttttagggttattatcccttttgagaatctagcataaggactcttacctgaaa

SEQ ID NO: 164436 - DNA, 462 bp, Homo sapiens
gctcagccttgaccctaaccccactgaggcagcgccacccccaccaggctcaaggtgccaccaccaggatggccattgctcaacagggtcggtcccattcagggccatgggtggttcccgacccttgaatgttcacggcctgactccgtaagccagatcacccacacccaacccctctgcaagcctcggggacagagggctcccgtataagactcctggccacggagaccctgtggatgccctcatgtggcctgggcagtcctccaggactcacctgtgcaccaagtctcagctaggatctgcactgcgttgggttgaaagaaccctctcttgcctggacctctgttacccctgcaaggtttcagggaaggtgtccttcttgggactgatttccaaggaaacctgcttcccagagaaaccattcatcactggtgggttaggtcggctcccttaggaaaccct

SEQ ID NO: 164437 - DNA, 213 bp, Homo sapiens
cctcactcttgaaggataagctagctgagtacacaattcgaggatgaaagctattttgtctcattaaaaaaaaatgttatttgctggtgtttaatataggttgagcatctttaagccaagaatctgaaatgctccaaaacctgaaacttatgtgtgcagacatgatgctcaaagaaaccctcactggaggattttggcttttttttttttttt

SEQ ID NO: 164438 - DNA, 459 bp, Homo sapiens
aatctttgcctaacccctggtcataaagatttcacatcaggctaaggtggggaggatcacttgagcccaagagttcaagattaacctgggcaacgcagtgagatcttgtctctacaaaaaaattaaaataaaaaagattccacatcaaggcacagtggtgtaagcctgtagtcccagtgcctaggaggctgaggtgagaggatcaccttagcccagtagttcaagccagcctggacaacacagaaagacactgtctttaaaaaagaaaaataaaaacaaagatttcacatcaatacctcgatgtcttggttactgaggctttataagtcttaaaatcaggcagtgttaatcctccaactttgttcatatttttttcaaagttgttttggctagcccagttcttctgaacttccatataaactttagaattagtcaatttctttgtccctaatccaggag

SEQ ID NO: 164439 - DNA, 259 bp, Homo sapiens
tagggacaatggatcagagaacagagattaacttgtacattatcttgtgaagggtctgtttaggtgtggttaccttcttggtcctacaggaggagaagaaaagcagttgttcgttttggtgggtctggatcttaggcagatgaaggctttgggatatggtggggggcatcaggagggcagggaggaaagtcagagagaccttgaggcttcttcattcagcatgtcaaaatgccatattttgggtatcactgagccccaa

SEQ ID NO: 164440 - DNA, 363 bp, Homo sapiens
tgtttattgtattcccctcttggagagacatgtggctattagcatagtaaaagctctgagaagtcctgctgcatggtgacctgtttagctctgtttaatccagtgttctctgaacatatctagccaaggaactaattttcccaagaagcacctacaaatgcagttggtgagacactgcccagatgaggattctgaaaaccccttttgcccacttgcctgccattgtgattgctgagtagggaagaagaaattaggaagtatcatctgcattacacagggaagctgctctcctagggttgccaaacagaaatggctgtagtggtgccagtgggtgctttgtagggaccagaagaaaaaggagga

SEQ ID NO: 164441 - DNA, 365 bp, Homo sapiens
aggcagaaaagcttcggtgccaaatgggggaggatgcagagccacttcgagtcccatcggaccactcaggccgttgcagctggagctgcctgcctgaggcaaagtaatgccaaagtgagcggtaggagcccgtcacagccaagcaaatggcaactggacagagttggccaagggctgccagacatgatagagcagggaaagaggcagagatgagggaataaggcagctgtcatttatttgggagggaagaggttggatcctgtaagggcaatagggtggaggggagggagagggctcagagggcctagggtcagattggaagcagcagaccccgaagcgtgctgatcctgaggcagagggtgcag

SEQ ID NO: 164442 - DNA, 220 bp, Homo sapiens
caggtaattatatgaacatgtcaactcatttaatgacagcatggagtttttaccagttatacgtaaatagtgtatttgtacaactggaagtgatttgcaacaactttgacttatcaagaatactaactttagcactgataaatattagtaaaatgttggatgggattcagaccacattggttggaataaaccagtgtaggtttcaggggaagcagagggt

SEQ ID NO: 164443 - DNA, 282 bp, Homo sapiens
gtaggtagttcctgacttctaggatagaatcttctctgacaggtaagatagacatgaatagacagaaaggaaaccaagcaaacacacgtaatacattgattccaactggcaactgaaggggaactcactggggaggtcctattccatgtagcagaactcacagatcctattccatggaatgctgaggttctgccactgcctgaatgaagaggcagctttgtggggcccaaacatcccagatatgcttaagaaaaaatattccaaaacacaatggactttgag

SEQ ID NO: 164444 - DNA, 455 bp, Homo sapiens
ggcaatttggatcatgatggtgatattagaggtggagaaaagtagttagctagattgtaaattttttttaacctttaattatagaaatttggatatgttttgaaaggagagctaacacaagatatgcggatgcactgaataaaagatgtgaggagtcaaggatgactccatagtattttggctcaagcatctggaaaaattgggagctaaaggaggtattggagaagaaaattaggagtttgattttggacatgttaagttgatgatgtgtattagacacccacctatagtattgagtaggcattggttatatgagtttggagttcatgtgggaggtttcatgattaatgatgtctcatgtggctccttcaacattcatgtcacaagagtacttgatgacttcactactgttcatggtgtgatgagagaaagttgagtagaatggaagagatgag

SEQ ID NO: 164445 - DNA, 354 bp, Homo sapiens
atttggagtagtttagtataccatagtggttaagggaaagcactccaagagccagctaaagcatgaattctggctctaccactttgtgaccttgggcaagttactcacttaacttgtgtctccatttcctcatctgtaaaatgggcaaaatagtataatttacttcgtaggtttttatattttagaagtctgttttcctaggaaatcgctgttgtaattttcctttttcttcctttttttttttaatgcttgataacagtctttagagttctactggattttggtgtgcttcagttagttgtaaggaaataatggaaattggaaattggatgaagttaactgcctgcagtagta

SEQ ID NO: 164446 - DNA, 275 bp, Homo sapiens
aaacacttaaaataatttgcttcaagaaaacataaaatgtttgaggtaaaggaaaagtagaataaaaataacgtattaagttcggtctgtatatactcttcaaaagtattgaaaattaagataaccagatattttccttttttatgtgtttactcatggtaatttcctccatccttctattgattatatgttacaatacctttatcctattaagattattacataaacattttaatgaaaaatattttttgaacaaaatttgtttagcatcattg

SEQ ID NO: 164447 - DNA, 370 bp, Homo sapiens
tctatagtttcaacagaactgatggttcatctaccttatgttacctgcccttttctgacacaatcactctgtccaagaaaatagaatacacagcttgaccaagccttcttgtgtgctcaatctggaatcgggagtggtggcagagaagtgtcccttcccccctaaagttgtgcattactaggagggagaaaaacgaatactatgtaggcaaaaataatcaatgtatactacctgaggataataagaattttttcaataagtgagaattctgccttctcattttttcttgtcacaaagtatgctttcacatagacataaaatgtaattgtagcaaagagaactacaatgtgcttgatacccattttcagag

SEQ ID NO: 164448 - DNA, 333 bp, Homo sapiens
gtaaagaactggaagttgcagaagcaccttccactttagttttggcctccgacaattctgtgctatagacacagcatcgtttctggcacgactttgtgggcattttgaagtacttaacatttcttcatgatttgcctgtgtgtgtgcgattttagttccacgtggtgacttgtgaacattatggatttaaagggaaaaaaaagaagtctgttcccctcatatcacaaacatagtaactgataggtaaaaatactgcatgattcaattttccacgtatgttcaattgcttgttgaaaaataaactaagatgtacatttttatcttttagacaat

SEQ ID NO: 164449 - DNA, 189 bp, Homo sapiens
ggttctcacagttcacagccttcaaaggcctctctgtccaaccaggtaaatctggcattacaatgaattataaaactaacaaatcactaagatcacccattcatttggtaccctgaccagaaacaatctgcccaaaatgaaagaggaaaaagtatcccctgagctacattcccatgaccctgcgaatta

SEQ ID NO: 164450 - DNA, 305 bp, Homo sapiens
aaaaatacaaaaattagctgggaatgatgatgcgggcctgtggtcccagctagtcaggaggctgaggtgggaggattgcttcagcctgggaggtcaaggcagcagcaagcccctgtctcaaaaaaaaaaaattttgtctctgccccttcaagggtgcttatgttcaataataattattacagtactttttagtataaaagcccttgggattctctagaatgagagacttgaaaagttcactagcagtttttgaactatgatgttaatagtgaataatttgggaaatgtgtaaaaaatgtataaag

SEQ ID NO: 164451 - DNA, 101 bp, Homo sapiens
ccagtggtttgcaccaacctagatggttaaaaaaaaagcaaagaaaacccagaggttgagggagggtagatccaaccagtttcctaagctgttccacattc

SEQ ID NO: 164452 - DNA, 158 bp, Homo sapiens
aactaaaagaatatgggggccatgaagaaaagccagtcaaaagtaactctataggttcattaactcaataaatacctacctagagtgattttgtgccatgcattctatgttcagtaaagacatggtgctaacaacacaattaaacaaaagtactatgc

SEQ ID NO: 164453 - DNA, 719 bp, Homo sapiens
ccagtgatttgcagttgtatcagtcacattagactgatttaattcatgcttagacactgtataatgtgggtgttcatgattggatgcctctattggttgggatacagtctcctactatcagtggctcttctttgctgtaggtcctcagagctctccccatttctccagagaatggaggttggggaggggtacaactcatcagacttgggagtaggcatttcacttccacccacattccactggccagaactcagttacatggctacatctgactgcctgggagcctgagaaatgcagtctagctgtgtgtcaagaggaaaaggaaatggtcggggaaccatattctgccacacaggttgattctcattttatataccacaaggattgtccaacttattgtgagctactaaaatagtctagtctgtgctatctcttgaaataactgtgtactttaagtaagtgggacttaaaattatttttattttttaatttatatttttatttatattttaattagaataaaggtacaagtatttgacccatattatataatagaagcattcaaaaaagggaaaaagggacaagaaattatttgaagaatggtcataaagttttgaggagagaatcaaatatgaataaattgagcacgagttattttactcaaacatatgaagagtgcacattatcacgataaaggggaaaatgggagactcctgtaa

SEQ ID NO: 164454 - DNA, 348 bp, Homo sapiens
tgatggctttgaattcaggggctcaatatttaacttcctctttttatgatatctttgttcgtcttttcttggtgacttccagttgacaacttctaactctgcttctctgtttgtttcccagtcctgtggcttgctttcatttgcctactattcagtatttgcatacctctggttttcatctttccttttctgtttggtcctgcaaaatggccaggcttgctaatgtaactccaggccctccacattagaaaacagaggggttttgtccattggtgattacttcaaatgttaaacatttctctttgttattgagtagaaatgtgtccctttatgatgtcctcatattgg

SEQ ID NO: 164455 - DNA, 914 bp, Homo sapiens
gggtgaaagctcatgaactcaaggagcacaacggacatatcacaggtattgactgggctcccaagagcgaccgcatcgtcacttgtggggcagaccacaatgcctatgtctggagtcagaaagatggtgtctgtaagccaaccctggtgatcctgagaattaactgtgcagctacttttgtgaagtagtccccactagggaacaaatttgctgtgggaagtggagcacgattcatttctgtttgttactttgagtctgaaaatgactggtgggtgagcaagcacattaaaaagccaattcgctccacagtcctcagcttggattgccatcccaacgacgttttgctggcagcaggatcatgtgacttcaaatgcagactgttttctgcctacattaaagaagtggatgacagctactcgggaggctgaggcaggagaatggcgtgagcccgggagagttcgtagtgagccgagatcgtgccactgcactccagcctgggtgacagagcgagactccgtctcaaaaaaaaaaaaaaaaaaaaagtggatgaaaagccagtcagtatgcactggggcagcaagatgccctttgggcagctgatgtcagagttaggtggcagtggcactggtggctgggtccacagggtcagcttctctgccagtgggagccgcctggcctgggtcagccacaacagcaccatgtctgttgctgatgcctcaaaaagtgtgcaggtctcacacagagttcctgctgctcctaagtgtttcatttgtctcagagaacagagtggtggctgctggccatgactgctgcccaacgctcttttcgatgaccgaggctgcctgaccttcatctccaggttggacgttccaaaacagagcatccaacgcaacatgtctgtcatgaatgctttt

SEQ ID NO: 164456 - DNA, 548 bp, Homo sapiens
gccaaatgagaattaaatgtattagctcctttaaaagatatatcaagaaaatacatcgccactggaggaatttcaagaatctgttccaatagttgcaaatatgtttgagtgggcagggtcatcactagtactgtctgaagtcatgacagcaacctgaatttctgctttttctacatgtagacttagggatatactttttacaatttttaaaacttattcactaataggaaacagactcatttaccatctgcttgaaatgtggtgattataatttatccatgaaaatattgaatgtttccttatcaacttgggagtcatcagggaggacccagaagtaaaggttaacagagagggaaaacagattgtctagattaattttgcatatactatgcagtatgaaaaacctcaacttacagtatttaattttttactcaatgtaaaaggaaaccctcaaaaataaaaaaagctaaaattttacatccacagataattaatgattttgttgtattgctcactttttttgtatactgtttaataaagttgagatc

SEQ ID NO: 164457 - DNA, 451 bp, Homo sapiens
ttataaatattgttcagttatttcagtactcatggaaagactgaacaaccaaaacgttgcctctgttggaagacctctgaggaatttatcacaggaataatcaagtgctttgcttttaagtctttgttctttatttgtatctactgcaagtttgttatttctttccttcaatatgtattaaacacctcgacctctaccatgcaccaggtaagctttgaggccaaaaccataaacacaacaaatgtggttgctgcccccacagtatttacagtctaggagatggagcagttgggggcaggagtacacatgaacgaaataattatacactgagtcattacaaactgtgttaagtgccatgaaggagaagcacagggtgactgaaagtgttcagtaggctcctgacttcgtgtggaggtctcagaagatttccctggggaaatgatgtttattc

SEQ ID NO: 164458 - DNA, 245 bp, Homo sapiens
agaaaacaaaaacaacaaaaaaaatcaactgacccagaaattactggtaatagaatcagtagaaaaagacatgaaaagttcttatatgattatgactatatccatatgttcaagaacctagaggaaaaactgaaaacatgttgagtgagataaggttaatataaaaaaagacccaaacaaaaattctagaaagggaaattctaaagtctgatactgaatgggataaaaggtagagaagacaggtt

SEQ ID NO: 164459 - DNA, 184 bp, Homo sapiens
taattgggactacaggcttgcaccaccacacccagctaatttttttttaagcaaggagtcctcacattgcccctagaagggatgtatccttgccatgcccattttacagctgaagaaactgaggctcagagaagcatgaaatcttgtgacagagcgagtaggtagagccaggcatccagcctgg

SEQ ID NO: 164460 - DNA, 631 bp, Homo sapiens
aagttgtcttgaagaatccttgctgctaactctggatcctgcttttcctatagtcagagggctccaaggtagaactctctaagtccctctcaatggcactctttgcctagaccaaactaatgaccaaacagtaatcaatctatcactgttgaagtcctggttttctcaaccaaattttaagtctttcccaggtatgtcagtcgagttgccatgaatcctcacctgtaggagtttctgggattcattttaaggaaactggaagaaaattaatgttttaatgtaaatgtttttaaaaccaagatcaccatagagttcacacaaaattttaggcagtgtttcaagaagcactcttatgtgttgttctttcagcccatgctccaggtcaccggtttttaggtaaacatgacatgacatgtacttgtaatatcagtgaaaggggcttttagtcgtctcagtatcttttttgcattcaggtattatagcgtttccaacaaattgagaaattacttatttggtgtaaaatgacgagagagctttagaatttaataaaatgtcaaaaatacaatttgatacccttaaaaattattcatagatctggctgctctgtactactggatgggtggaataggga

SEQ ID NO: 164461 - DNA, 321 bp, Homo sapiens
tcttctaattttttttcttttttagacagagttgctctgtcacccaggctgcagtatgcccagacacagtcacggtccactgcagctttaactttttgggttcaagtgatcctcctgcctgagtttcccaagtagctgggactacaggcacacactactacaccaggccgatttaaaaaatttttgtaaagacagggtttcgtcatgtcacccaggctggtcttgaactcctgagctcaagcaatcctcccaccttggcctccccaagtgttgggattacaggcataaaccaccatgcccaaccttcttcactgtctgcac

SEQ ID NO: 164462 - DNA, 495 bp, Homo sapiens
attaagaaaaatatctccacattttgatacatgttgctaaattgcatttctaaaaggttgtaccaatttactaccataaaagtggtgtgtgtgttgttcttagctcactttttcattattttaaaatcttacgtctttgctagtttggtatatgaaagtattaatttgctttatctggattttttattgcaaaaattcaagtttttttttaatgtttaatgttttagcttttgtgtataaagtttaataattgatattcaagaatgatttatttgctcacttaatcagtaattcaacatatgagtgcctgctctgtgccaggcactgtttatctaaaatctagggatttagctttgaattgaaagttctgcccctcaagaagcttatattctggtaatttaattgtactgatttgccctatctactctggtgtatttacacttttcccccaggtttgagtataaaagcttgtgctttttgtataatcagatatca

SEQ ID NO: 164463 - DNA, 420 bp, Homo sapiens
aggcttccccaggttgggagtcccctggaatctttcccaagcagtgatcacagttccctcatttcctacagtgcaacaaaataaatcctaagggataggtcatctggattgggtttgggaaataatgagaaggggctgggcacagtggctcacgtctgtaatcccagcactttgggaggccgaggtacacagatcacttgagtccaggagttcagagaccagcctggccaacatggcaaaaccccatctctacaaaaaatacaaaaattagctgggcgtggtttcacacacctgtaatcctagcttactctgatggctgaggcatgagaatcgcttgaatccaggaggtggaggttgcagtgagccgagatcatgccactgcactccagtctggatgatggagtgaaattctgtctcagg

SEQ ID NO: 164464 - DNA, 271 bp, Homo sapiens
atagtaaccaaagtcccaacaccagtaaatgggacaaacagacatcatgtgcctcctgacactgtgctctgagaaacacttctgtggaattcctgccaaaagtgcataacctgaatccaaccataaggacaccgaatatatgtaaattaagcagcattctacaaaataattatttactcttcaaaaatgtcaaggccctggaaacacaaagactgaagaactgttcagattaaaagagactgaagagtggccaggcgcagtggctcatgcc

SEQ ID NO: 164465 - DNA, 473 bp, Homo sapiens
tcttcacctcccggcccttcatattaaaatagtcatgctcatactttgaattccccaacatgccatgctattgcttgagttgcttctgcttcttctccttagaatgccctctctccaactacctgataaatgtcagcttcagttttcaacacttagctcagaatcatctccttcatgaagcctttcctaacatctctcaggcagaactgaccttttccttctccctgtctacactgtaccctacacatatatagatcataacctttaactgcaattatttttatatatgtttatttcctactaagcagagaattccctgtaggccctctcttattcatctttataaccccagtcctatacatgatagtatgtaacaggcattcaattaaattttccttaataaacaatgggctcccctccccctctactgactactctcacattggacctataagcccaagttccatttgagg

SEQ ID NO: 164466 - DNA, 123 bp, Homo sapiens
tctgccttagcttcccaaaatgctgggattataggcgtgagccaccacgcccgaccaaacttctctcttcaacattttgaatcaggcgtaaacaaaaagccctctttgtgtttggttcctcag

SEQ ID NO: 164467 - DNA, 222 bp, Homo sapiens
aaattgtaatatacaaactagaaagtagttctcagtgaaatgagccaactattttttaagaatattaaacttttataagaagagtctttcttgctgatttaaaaaaaaaggttcaaacaatgaaatcctgattactggagagctaactgttttggggtggagggcacgtctagtatagagcaaggaaaactatgttaaccaggacacagaagacccaggctc

SEQ ID NO: 164468 - DNA, 377 bp, Homo sapiens
attttctatattaaaaaaagttctatgaagtaccccaaattagaagaacttttgaatgttcatgaaaattgtcagataggatggaaacatgatttctttaggcttcaggcagtgaagtgtgtctatgatgtttaggggctcaatagtgctttcgtattctgtttatgagagaagactctgttctaccttataactgtgagtgaatgaagccatgtgaagtcttaggaagaggaacactattaataaaagcttctcggctggtgcagtggctcacacctgtaatcccagcactttgggaggctgaaatgggagtactgcttgagcccaggagtttgagaccagcctgggcaatgtagtgagacccctctggctccaca

SEQ ID NO: 164469 - DNA, 513 bp, Homo sapiens
atagatttttaacttgtctgtcaactccaattcattggcagcagctgcctggagcactggattgaggagtcccaggtgggatgggtgctcggtgggagagagctctagaactgctaagctacactgcacgggtgcgggagtggagagcggcaatgggtatgtgttgtatttgctgtccccacatgatgctttgccttgttcattgatcaattttgttaggacctagaatcagttgaaagacatgtatttaagtttgttccagaggaaacaataaatttatttccttgtctcttcctttctctggaaggtaaagttaagtttttgagcctatatttgagaaggtgtaataaactataaagtgaaatgaaatatttatggtttttgtatttgtgtctaatgcatgttttaacatgattgacacaatgcattttgtaggtatttttctggaaaagtcaatcttttagaaattgtttttcagatcttcaataaattttttctttaaattacaaaaaa

SEQ ID NO: 164470 - DNA, 409 bp, Homo sapiens
tgacctgaggtaaaaggctgtttaagatgaataatggcaatctgttcccaacttacagaaaaaaaaattaagttaatggaaagaattctctgaattttgctgaaatcctgctaccatttatctgctagcagacaagaaagagataaaagagtaatgtgataatctgtaaaggatactatgatttccatatgttctgctaattgaacaatttggaaaattactagtttgaagagtttacactgtgaaatcaaattacagacaaggtaaaacttataaaagtacataatttaagttctggtgagcttaggttattcaataaattacacatttcgatcttaccagaaagctaaagtggtttttaaaaaagcatggttcaaaaatgtttaataaactcaggaggctgaggtgg

SEQ ID NO: 164471 - DNA, 384 bp, Homo sapiens
gaagagctgtatctgccatggctgacatcatcagggcaagacacccactgggtggagagttgggcttatgcattttacccctgtcttgaagagaccatgcatgcctgcctctcctgggaccagtgatactggagacccccctctgggtccactcatgaccataagcttaggatgcggtgtgccttgcttcctatccacccaggtgaggcatcctggagaggatgcgtggggcgaagcttgtgtgcgcacatgaagcactggaactgggtgtcaccggcctgtttctgagctaccacctgactaagtgataagtgtctcatctacctgaccccgcagcccgggtttctcctccacctgccgacccatgccctcttggggagaatg

SEQ ID NO: 164472 - DNA, 357 bp, Homo sapiens
gagccactatgcctagccaagagagattttaataatggtgactggaaacagaagagattaatggaaaaatggacatataagaaagttagttaactaaggtatttgaaagtatgcaataaattttattcataagtattttgtggtcttagtgctaatggtttcttaaaattgtggctcatgatttcaatagaggtagaatcggcactaaatgaagttggaaaaattggtcatagatgagtttcatctcaatttcttagagactatgatatacataattcttgtcctcatttaactatctagaaggtaaaatagaaataaacataggtaactattattttaaaaacacatgacacctta

SEQ ID NO: 164473 - DNA, 323 bp, Homo sapiens
acacagtgcaagggaggaacttcccacaggctgaagcatcagctggaactcaacaaacgcacgcagccctcatcccctcaccccgcggcctgcctcgcttggggctgttgcaggtgctcagcactccagcccagcttttcagactcttgggctacagcttctgttccttttccttttctctctcttcccagtctgtccaaccaacatttttttttttttttttggtagagacagagtcttgctctgtgacccaggctgcagtgctggagggctgtggcacgatctcagctcaccgcaacctccgcctcatgagttcaagcaat

SEQ ID NO: 164474 - DNA, 191 bp, Homo sapiens
gaagttgagagccacatggctgacttgaccaagattaaacggctagtaagtaggaataagtactgaaacagaaactttacccaattgcagtccatatgttttctgggatcccggagttccctttcaacaatgtaaaatacaaacttaggtcaaaagttcccatgtctgagaagactcaagccaaatcagtt

SEQ ID NO: 164475 - DNA, 182 bp, Homo sapiens
tacagagttgtactgggaaaggaaggaataaaaagacacttaagaggttgcttaaaattttttttgagtttggttatcaggtctagactagaacattatttggcttctgtggttcagggtcaacaaaataacccaatattctataacaaaatagcctctatcttaatttcccttatccagtt

SEQ ID NO: 164476 - DNA, 403 bp, Homo sapiens
ggaaaatccccacacgaccaatttaaagctttacagcctgttttaggacagaattcatcagttctaaatcagatcctttgcaattctgacaaaattcacaaaccacctccactgttatgtaagatacatagagatagatggagagaggtagatatagatacagatagttactcccgttttgcacttaagtaaatggagttgtttcctgggcaaaaatacctatgagctgggcgcggtagctcaagcttgtaatcccagcactttaggaggccgaggcgggtggatcatgaggtcaggagtttgagaccagcctggccaacatggtgaaaccctgtctctactagaaatacaaaaaaaattactggggcgtggtggcacgcacctgtaatcccagctactcagg

SEQ ID NO: 164477 - DNA, 308 bp, Homo sapiens
gcagtagaaaatacctcagatgcaaaagagggaaagaagctaggagaactagaaatctggggccacccttcccaccatatatatacttcttcctcttggtcccctctctacaatcttcctatcccaatctctaacccatgtcaagaggtgaatgcagatgtaaaacttaggttaaggaagatgcatgtgggggaggtggaggtaggggtcaaggcttcttaaatatttctactgctcctcttgcctcactctgataagatcccaacagaggaatagtcaagaattccacagctcttacatagaaaaaa

SEQ ID NO: 164478 - DNA, 235 bp, Homo sapiens
caaaaaaaataataataataataataataaataattgcagaatgaaaggaaactttcacttttgtaaaatctctttcagcaaacttcccaaaactacagatctccaagaaaagattagaccctcaagtatttggtctaatttagagcataaaacaagctgaattccagtatgcagaaaaacaaagtataaagttgtaggcagcaattaattcagcagaatttttgtatttggttg

SEQ ID NO: 164479 - DNA, 452 bp, Homo sapiens
atttcagtgttgttttatactgaatttcttttattacaagtgtgtttgaatagcctatttcgtaagttcattgcccatgtggtatttcatttctatatttcctgttaatgctgttttcagtttttttctgagagtattttaaaaattatttcaaaatagcactttaatttcaaaataagtgtgtactcaatagagaaactttaaaaaaacacagaaaaagacaaaggaaatgtaattacttatgattccgttacccattcttacttgattgctgtcattttcactttgatgtgtgctgaggtctgaatgtttgtttcccctctgcaaatttttacattgaaccctaagcaccagtgtgatggttttaagagaggcacctttgggagatgattaggtcaccagggtagagccctcatgaatgggatgagtgcgcttataaaggaggcccccca

SEQ ID NO: 164480 - DNA, 435 bp, Homo sapiens
gaagggggtgggggttggggacagcatgggacatcctgcatatggtatctgagaacagcagtggagcctggggtccatgaccccctgaagcagtgttacagccagaaggaggtgggcaccactcattcaggagctgtgagcatcgactctggcaccagactgccttggttccaaaccccagcctcaccacttaccagctgtgggacacatagacttcttgttcttggttcctcatctataaaattaggataataataattgctagcttatgggttgttcagaggatttattcagttgatctaagtaaagtgtttagaatagggccagctcttacagaagctatgccagtgttagctttcactgttcactcattccgcaggtacctgctaggcagggtactgggaacacagccgagaaaaaggcccagtggcccta

SEQ ID NO: 164481 - DNA, 340 bp, Homo sapiens
agttcgtgatgtagcgtattcaaggctctcagaatcctaaaaggtcacagtccttttattcttgcctcttttcacttctttactgttcttattgatttatttgggcacataagaaaacacagtaggcaaagcccactacttctattgaaataaagtattctgcagtcaaaccacacaccataaagaaataattgcagtctgtatatattgctaatggacatctctcagcaattccctgtctcataagctttaaacacagacattagtataaatatgcagaaatccccattcgggcaaattactctgcatttctgaatggaaggaagattaaccatgtgct

SEQ ID NO: 164482 - DNA, 111 bp, Homo sapiens
ttacctgcctttaaggccacgtagggaagcagagaaatttagtgtctttttaagtttctcacctactattaggaaccctcctctctctctctccctccttccccagactct

SEQ ID NO: 164483 - DNA, 473 bp, Homo sapiens
cctctgaaactgtcatcgtaggacactgcatggatctgcttctctcgggcctctgagcctccatgtcctaccctgctgaaactttggtcccctgtctttggattgggcacctaggcctttggatgaggagataaggggggctccaggagtacacatgaacctctgaccatgctgccactgttgaggttgtacagaatgaaaagcagtagggcagcagcagcctcttagttttgcccagaccaaggtagcctttaatgcagaggtactgggttgatagctacatatgactgcctccgtggcgagagtcaggctccagaaatctgcaggctacagcctagcaggccacatttgaggcttcatcccagtttaaaaggcagatcttcccaagtgaaaggaagaaggaaggacactgcgaagtttctctcttttgatatctctgtatgaccaggtatctggcaggggaaagggtatag

SEQ ID NO: 164484 - DNA, 585 bp, Homo sapiens
ccgctaaggtctcgtaatatttatatgatatatattcttctaattcatagtcagcaaactttatctatgaagagctagatggtaaatgttttatgctatgtgagccacatatggcctatgtcacatgttattctttcttatttaaaaaaaaaaaactctttaaaaagtaaaaaccattcttagcttgagggccatacaaaacaggtctgggaccaaagttgggtgacctctcctctaactgtttcataattagccttgcctttgcggtcaacgtcaactttgctgaatgcacggtaaggataatttggtatttccacatagagatttgcacagggtctatgaatacaagaacagaggttctaaaaatacttgaactgggtcaggcctgtaatcccagcactttgggaggccaaagtgggcagatcacatgaagtcaggagttcgagactagcctggccaacatggggaaacccccatctctacaaaaatacaataattagctgggcatggtggtgcctgcctctagtcccagctactcaggaggctgaggcgcaggagaatcatttgaacccaggaagcagaggt

SEQ ID NO: 164485 - DNA, 649 bp, Homo sapiens
tcttggtcattatgcattattattttttatatattgctggatttgatttactaaaattttttcaaggatttttctctccatgtagttttctgtaatagtctttctctagttctggtgtcaggacctcatcaaatgagttgaggaatgtcttctcttctacttttttggaagagtttgtgtagaattggtattacgtcttccttaaagttttggtagaattcacagatgaaaccatctgagcagggagttttctttgtctgaaaatatgtaactgcagattcaattcctttagtaaatactgtaaaggcttattcaggcaactatttcttcttgagtaagttggtagttgtgtccttcaaggaatttgttcatcgtatctctgttttttttaatttattggcataaagttgtttataatatccacttcttatccttttaatgttttgggatctgtagcaataccccccttccatttttgatagtgctgatttgagccttctcacttctttttctgaactgtccagctataagtttatcaattttattcgtcttctcaaagaaccagtttttgttatctgagcatttagaactgtaaatttccctttaagtgatggtttaggtgaatttcatggattttgatatgttgtgt

SEQ ID NO: 164486 - DNA, 772 bp, Homo sapiens
cgagaccagcctgaccaacatggtgaaaccctgtctctactaaaaatacaaaattagctgggcgtggtggcgcaggtctgtaatcccagctacttaggaggctgaggcaggagaatcacttgaacccaggaggcgaaggttgaggtgagccgagatcatgccattgcactacaacctgggcaacaagagtgaaactccgtctcaaaaaaaaaaagattgattactcttattgttatgggttaggcatatttttactcttcagagctgggatgtgggatatgctggatccctcttatgctgaaactcagacgctgaacatagcatagctcctcagtcattaaattcttaattcccttattaaagtaagctgagaaagaaagatgaaaagcaaagtacacaaagtcttaatgcagttccttcaaaacttaacatacaaaataaagctgaatttccaatgtcaccaacttgccaaagcacaagtaaaattaaactaccattaaactgtattaagattaaggtccaatacgtatcggtcaatttcctaatttatgctatcgagttaaggaagatatttagaagacagaacattctgttctttcaactttaggacaaacaagaaacaaagattagtggttcttaaatgtaggcacttatgaatcacctggaaactaggtgaaagtttttttaaaaactgcacatacatggggcagaatgctctgtgtcctaatgcaattcagtacagcagtgctaatctctacaagcaccactttgt

SEQ ID NO: 164487 - DNA, 386 bp, Homo sapiens
aggctagtggcatgatcatgactcactacagcctcaacctaccagtatcaagtgattcttctgtctcagcctcccaagtagctgggagtacaggtgggcaccactatggccagctaattaaaaaaaaaatttagagacagggtctcactttgttgtgcaggctggtcttgaactcctgggctcaagaaatcctcccaccttggcctcccaaagtgctgagatttcaggcatgtgccatgacacctggcctaaaattttaagttttaataaataaaaatccatacatacagaaccaggttcagctccactgaaacccctgcaactcagccaaaagtaaatgtaacatggttttgaatgctgtcttaatccagggcacatgaaaaacc

SEQ ID NO: 164488 - DNA, 226 bp, Homo sapiens
ccatatacagttcacaacaatttaaaaagaatgacaggcaggcgatgaaaggcagatggtcgtgctagaaaacgcagagatgcctaatccattctaccttcactgccagtatgatcagagcatgattctgctatcatttattcctccccttttctcccctgccccattctctgtccccattctatcatttcctggtaaaacgatcttacagactactgctactagg

SEQ ID NO: 164489 - DNA, 385 bp, Homo sapiens
cctcccaaagtgccgggattacaggtgtgagccaccccacccggccaaggaaatatttaaaaaataaaataaaataagttatttaaaaattggggcaagttggctgggcacggtggctcacgcctgtaatcctagcactttgggaggctgaggaagggggatcacttgaggtcaggagttcaagaccagtctggccaacatggtgaaacactgtctctactaaaaattcaaaaaattagccaggcattgtggcaggcacctacaatcccagctactcaggagactaaggcaggagaatcgcttgaacctgggagacggagattgcagtgagttgaaatcatgccactgcactccagcctgggctatggagcgagactctccctca

SEQ ID NO: 164490 - DNA, 774 bp, Homo sapiens
tgctaaagttatttgacacttcaggcctgagccagccatgagcctaatgatcccttcttccctaagcatgatgagtataactgttccttgaaaataataagcagaaagtgtttcggatgcaaagaaagtccccacaggcccttgtgccatgctggaagttagccccttccaaagatcatttgctctggttatcagcttccagatgagagtgttttcctcctgcctttctgttcttattcatttgaatctgctgagtctgaccattgtaattatccctggtattcattttgtcaaagtatattagtgagacatcaataatatggatcaacccattccctttctacttgtttggttgtattgattcagtttaaataaaagtcaacctactgtataatgtttgtttaccctgacccttgctgaacatttccacatcctcacagactatgtttgtgtcatttgtttgactaaaaatacttagtttccctggggttcccatgtgacagtacgccagtgttggcctaagctaaactcactttctcaataggactgatggacgccgctggtcgttggcttctctcccttcctctggctatgggacaaacacacccagctctacggtctctgtaagtgcctgactttttttttttttttctcttcctcacaacaacagagctattacacaggcagtgttttctctgggtgtttcctggtagggaggagaagataaattctgcatgtctgccactctgaataagtgacacatcaaatgatggc

SEQ ID NO: 164491 - DNA, 664 bp, Homo sapiens
ggtattgtccaagtttaactcatcgatctctcctgttcatttgaagagtttctttctgaggtagttatgtgacctcactttggtttttttcagtcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggtaagaaccatgtaccatatagttttctgatttattttgcttttccctgaaaaaaatttttttttgcttacaagttataaccatgaaatggagttcacattccagagaagcaaaaaagaaggaaaaa

SEQ ID NO: 164492 - DNA, 986 bp, Homo sapiens
gcgtgctgaagtagaggtagtacagcatggctagactgttgtgagaggctcagagaaagcagagggtgagatggatgagtccagcattctaagacgaagagggctccagaaggagctgagtctccccagaagaggaagtttgatagattcccagaagtggaattgcttggtcaaacgttgccgaacaagcaaccggaaaagcttaataggcaatgggcagtcaccagcattgcctcgaccacactcacctctctctgctcatgcaggaaatagccctcaagatagtccaagaaatttctcccccagtgcctcagcccatttttcatttgcacggaggactgatggacgccgctggtcgttggcttctctcccttcctctggctatgggacaaacacacccagctctacggtctcttcatcctgttcctcccaggagaagttgcatcagttaccataccaaccaacaccagacgagttacacttcttatcaaaacatttctgtaccaccgaaagcatcgccactgagaacagatgcaggaacacgccgatgcgcccccgttcccgaagtctgagccctggacgttctcccgcctgctgtgaccatgaaataattatgatgaaccatgtctacaaagaaaggttcccaaaggctacagctcagatggaagaacgtctaaaggaaattatcaccagctactctcctgacaacgttctacccttagcagatggagtgcttagtttcactcaccaccagattattgaactggctcgagattgcttggataaatcccaccagggcctcatcacctcacgatacttccttgaattacagcacaaattagataagttgctacaggaggtaagaaccatgtaccatatagttttctgatttattttgcttttccctgaaaaaaatttttttttgcttacaagttataaccatgaaatggagttcacattccagagaagcaaaaaagaaggaaaaa

SEQ ID NO: 164493 - DNA, 545 bp, Homo sapiens
tgtaggaagaaggccattcctccagtgctgctacttccaacactggggaaaacaagcttcagaaaggaacggtgtcaaagaggcaggacccaccagcaggactgccagcggccagacgaccacagccccagcattccccagccactacggccgacagcccaggctccagaaatgcacagcttcaaccttcagagtaaaaaccctcccaagccaactatttcttcaacaatcggattggggaatggagggttctaaccctgcccctctctataccacagatcatcagatcccagttcttatcagattgggaagtggggggttctgaccctgtccctctctataccacaggtcatcagatcccagttcttatcggattggggagtggggggttctgaccttgtccctctctataccacaggtcaccagatcccagttcttatcagattggggagtggggggttctgacctgtggtatagagagtctccgtcgaactagttcgacggagactctctatatacatttcccttatcttttaaagctggga

SEQ ID NO: 164494 - DNA, 265 bp, Homo sapiens
gcaagaagggaggggggcttctgtgtcctcatcccccagaggtggggtccccagcatgagcctccatcctcttggggacagttgagggggtgaggttctgtttccccatctttgcctgggtcttagatgctccagaatcaagcttagaaaagaatggagaaaggcaaatgtagtagatcttgtatgttgagggcagagtggagagaagacaaaaaggtcattgctgttctttttattttttaattttaatttttttttttggttt

SEQ ID NO: 164495 - DNA, 844 bp, Homo sapiens
tgacgtcacggggctagctgacagaaccccgggcgcgggcgctcgggaggtattgtccgtccctccgggctttgtagaatcgtcgccggcttacctggccgtgggcgcgtcctggccgctgcagcccggagcagggtgccagccgccgccgccgccgccatggtgtccccggtcactgtggtgaagagtgaaggacccaaactggtgccgttcttcaaggccacctgcgtgtattttgtgctctggctgccctcatctagcccatcgtgggtcagcaccctcatcaagtgcctgcctatcttctgcctctggctcttccttctggcccatggcctgggattcctgctggcccaccccagcgccacccgcatctttgtggggcttgtcttctctgctgtaggtgacgccttcctcatctggcaggaccaaggatacttcgtgcatggtctgctgatgtttgctgtgacccacatgttctacgcctcggcctttggcatgcagccactggctcttcggacaggtctggtgatggcagcgctgtcgggcctgtgctatgccctcctctacccatgcctctcaggtgccttcacctacctggtgggggtctatgtggcccttatcggcttcatgggctggcgagctatggcagggctgcggctggccggggcagactggcgctggacagagctggcagctggcagtggtgcactcttctttatcatctcagacctgaccatcgccctcaacaaattctgttttcctgtgccctactctcgggcgcttatcatgtccacctactatgtggcccagatgctcgtcgccttgtcagctgtcgaaagccggg

SEQ ID NO: 164496 - DNA, 514 bp, Homo sapiens
aacaggatttcaccatgttgaccaggatggtctcgatctcttgacctcgtgatccgcccgcctcggcctccctgttcgtatgttttcttcaaagaatttaagttttacctttttacatttagatctttaattttgagttgatttttgtacagggtgtgaggtaagggtccagtttcattctttgtcctatggctatccagtggtcccagcgccatttgctaaagaggctgttcttttccctgttaaatggacttggtactcttgttgaaaataatttgaccatatatgtgagggattatttctgggctctctatcctattccatttatccatatgattacctatgtatctattattatctcagtatcaaactgttttgacactgtagctttgtaagttttaaaaccaggaagcgtgagtctcccaactttgttcttcttttttcaagattgttttggctcttcttgctttcttgtattttcataggaattttaggattagcttttccatttctg

SEQ ID NO: 164497 - DNA, 504 bp, Homo sapiens
acggagtcttgctctgtcgcctaggctggagtgcaatggaacgatctcggctcactgcaagctctgccttccgggctcacgccattctcctgcctcagcctcccgagtagctgggactacaggtgcccgccaccacacccagctaattgtattgtatttttagtagagatggggtttcaccgtgttagccaagatggtcttggtctcctgacctcgtgagccaccgcgcccggcctggacagtgtctttggtaataaagttcagttttttttaatgtaaagtgccacacccaatgacatattttgtacaaatacaaaaagtctgaggtatatgaagtggaaatgatgaaaataaaggaaagggaatggaaaggtgtagaggcctttgctgtttgatgggaagggaaactagctctgtctttataatactgaattaaatgtcattggacttttggattaatttctcaaatttttgattccaaaataagttactcttggcatattt

SEQ ID NO: 164498 - DNA, 331 bp, Homo sapiens
aaagaattgaactcaatgctctaacagagcaagaagaacccaactctcaccccaagacgtccttttccttaactgttgtttatttgttggaggaaaggggaaggttttgaatggtctgtgctcctaaacagtataggaagcccacttgcagcctgtatgttggccaactccatcaacagccttctgctttagagaatgtgtaaagggagatattttaaaggtataactgatcaagtcagtttaatagactgcatacaacatcatgtcacaatgtgaggtgatagagtgaacagggtctcttgggcattgctagtggagtgcaacatggtac

SEQ ID NO: 164499 - DNA, 523 bp, Homo sapiens
gaaaataaactcacatgttcctcttagagcctctgacaatcatccagtcctggacaaatgtacctctctcctctgagcatccaactcaatcacatcagtaagatgtctgccttttttctcaacattactcacctttgcttaagaaccacagccagtcgaattgctaactctgacaagcgtccctgtcttaactgtctcctactcagtagcttacaccagctttctaacctggtgggcctttctccatcctcatgcccctcccctgatttcatcctgcacacctgccaggtgaaccgtccggaacacccttactccagcccctactcactaaaagcagggccttcaataaggcgtcttaggtaccaacatctctaagatcaaaccctggcccccaaggccctccagaatcaggaaggtctgctctaactaagaaatctaccttttctccatatcgtagctaggttattttccctgtccccaatacatcccccttccaagcccaccttacccttgcataactcaa

SEQ ID NO: 164500 - DNA, 256 bp, Homo sapiens
aagattactgtacaagaaaactgtggttcaaaatgaatagcaaattattatgtagcatgattttgaaaaagtcatgaaaataaaaacataatttattttaattattatcataaactttttggaagaatgatgggcaattaggtaggattcaatatctctttctgtacaaccagtaactactttgttctgaagtgaacattattcatatagtcttaataaggcaacttttatttcttccctacttttgggatcaacc

SEQ ID NO: 164501 - DNA, 231 bp, Homo sapiens
cccttttaacaaactgatacattttatcttgttgcttctctcagtgctgtacctcttgtatctcccctggagaggagttgctgagggttcttggcaggtgccaagacatgtgtgagctcctgggacttgttacatgctaactccctgtttggtttgacacacacttcctcacccctgcaacttggcaaattccttctccttgggagagtttctcatccttgggagcaattt

SEQ ID NO: 164502 - DNA, 498 bp, Homo sapiens
tctccaacctggaggagaacgatgagacccgcttcatcctcagcaaggtgcccagtgaggcaccttcccccatgcccactcaccgttcctatctggggcccggcagcacatcacccctggagaccagcggtaaccccaatggacgctatgggagcggctacctgctggccagcacccctgagtcggagctgtgaccactgcccaagccctgcccgcctctccccccacgctcaacctgcccacttgtccaggcctggcctctttcttgaggtggccaccaggcccaggccaggccctttgcccaagaagagagggtctgccctgcctcactcccctcttcagtcccagtagactctgctccctagccctgagcaggaggctgggagcagctctgtttcctaattcaggaccccactcatctagccctccaagagcctccgccaaattgtagccatgtaattggaacaacccataaggcctgcttcccagtccatggga

SEQ ID NO: 164503 - DNA, 701 bp, Homo sapiens
cctacaacacacccagttactcctatagcacaccaacttaatcctaaccctagagcctttaaaatctcttattccttctagaatctttttcctcctgacactggcatggctgatttttcttgtcacgtaaacttcagctcaaatatcgcctctcaaagaggccccgtttaacccctccacctaagtgaactgtgacatctgcttcgcaacttgcccatctcttgcctcatcacattaccttccagacatccatcatggtgtgaactatcttggtgtgaactgcctctcatggtgtgaactgccttgttatttgcctttattattttctctatctttctaaaaacccagcctctacaagagcaggtccttagctgacttgctttgtactctatttccatgcctagaatagtgcacagcacataatagatgttcaagaaaaatcaatggtgaggatgcaatgaatcaatcaataatgaatcaacagcagccgggcacagtggctcatgcctgtaatcccagcattttgggaggctgaggcaggcagatcaccttaggttgggagttcgagaccagcctgaccaacatggagaaacctcatctctactaaaaatacaaaattagccaggcgtggtggtgcatgcctgtaatcccagctactcggaggctcaggcaggagaatcacttgaacctgggaagcagaa

SEQ ID NO: 164504 - DNA, 319 bp, Homo sapiens
aagcattgggggcaaggaggaatggcagttgctgttcagtgggcatagtttcactcatgcaagatgaaaacgttctagacatctgctgcacaacattaagcatacagttaacaatactgtagtgtatacttaaaaatttaagaaggtagatttcatgttatatgtttctttaaccataataaaaaaagtaaagggcaatgaaatctatattaagtattcatccatttatggtaatttaaggccaggcgcagtggctcatgcctgtaatcccagcactttgggaggccgaggcaggcggatcacttgaggtcaggagttc

SEQ ID NO: 164505 - DNA, 610 bp, Homo sapiens
ggtggacacaactatcaagtcttggtcaattctggggcacacattttgaaattagaagccacatacagaagaacaattgaagaaagatctgctttggagacatgagaacttggggcatgggaagcccataattagccatcaggatatgtaaaggaagaggatttgtaccttgtggttctagggaatagaactaaggccagtggatggaagccacagatagaaagacatggctcaatttaaagactaatttgcagtgagagctgtttaatgatggagtagaagatggcatgatgtgattgttatcattaaccagtcttttactactaaacttaaatggccaattgaaacaaacagttctgagaccgttcttccaccactgattaagagtggggtggcaggtataagggataatattcatttagccttctgagctttctgggcagacttggtgaccttgccagctccagcagccttcttgtccactgctttgatgacacccaccgcaactgtcggtctcatatcacgaacagcaaagcgacccaaaggtggatagtctgagaagctctcaacacacatgggcttgccaggaaccatatcgggtaccgagctc

SEQ ID NO: 164506 - DNA, 424 bp, Homo sapiens
ggtggacacaactatcaagtcttggtcaattctggggcacacattttgaaattagaagccacatacagaagaacaattgaagaaagatctgctttggagacatgagaacttggggcatgggaagcccataattagccatcaggatatgtaaaggaagaggatttgtaccttgtggttctagggaatagaactaaggccagtggatggaagccacagatagaaagacatggctcaatttaaagactaatttgcagtgagagctgtttaatgatggagtagaagatggtaaacttcctgtttgtaggaggttgaacaatcatttggcagctgtgttttagaggatataaaaatgttgaatcactaacaagtgttcacttttcctcattataaatggaaaaggcaagaaacactcaaaatttaaatt

SEQ ID NO: 164507 - DNA, 484 bp, Homo sapiens
agtgaattcataaatcgtcacttaactcaagcaaaacaatgttactctctttgtacattgtacagatgcaggataacaatgcagtgttatcctgcatctgtacaatcaagcacccaaactggttctgtagaggcaggaccttagcatatagcagagataacttatcttccagcagatccggagctccattttgtagacagaaatgaatgctctgtgccacagaaggagctgttgcactattcattcccgtttcctcccattcactctccacatctccaatcctggcattgtctgctttgttacttgttaaaaacttgatttcgtagattgctttaaaataagaacaaaatgtactttgacacacatcattttgtttggttctcattaattttgagagaaaggcaagatagatatttaaatgacccctattttagtggtaaacaagctgaaattagataaataaaatgatttgcctaatgcctca

SEQ ID NO: 164508 - DNA, 266 bp, Homo sapiens
actcccaatcttctctctgcagagcccaaatcttgtgacacacctcccccatgcccacggtgcccaggtaagccagcccaggcctcgccctccagctcaaggcgggacaagagccctagagtggcctgagtccagggacaggccccagcagggtgctgacgcatccacctccatcccagatccccgtaactcccaatcttctctctgcagagcccaaatcttgtgacacacctcccccgtgcccaaggtgcccaggtaagccagcc

SEQ ID NO: 164509 - DNA, 234 bp, Homo sapiens
gatccatgagtatgtaaacattgtaaaataacattgttgacaatctgccatctggcattatcacagtctcttaagaatgtgaatctttttgtaaagtcctgtaaactgtgtttttcaatatcttcacttgaagaccaatatgatggatttttgataatgatcataagttttgatatagccccttttagacagcagcctaatagttaaaacatgcaaatacttaatatattcgca

SEQ ID NO: 164510 - DNA, 225 bp, Homo sapiens
ggctaggagtttgacactaggctgggtaataaagggaggccctgcctttaaaaaaaaatttttttttgttttaattagccaggtatggtggggtcctgaaggctgaggcaggaggactgcttgaacccaggaggttgaggctgctgtgagctacaactgcaccaccgcaatcctgggtgatgttgcctgggatgtagcctgggtgacagagtgagaccctatttc

SEQ ID NO: 164511 - DNA, 139 bp, Homo sapiens
ctgtccctctgtttctgggtctctgtctccccatctctgtccctctgtcccagtctctgggtctgtcagtggctgagtgtctggcctgctgggacactgcggtggggccctgcacccgctcctggctctcccacttgtc

SEQ ID NO: 164512 - DNA, 477 bp, Homo sapiens
cactgctgcatgtaagacaccgagaatgaggccgtggagacaaacaccaactcagagtgggacctgtgcctgactcagggaactcagaacatgactcccttcactaagtgcagtcaagtaggtgctggagggcagagagaaggaggtggtggtggtggcaagctggtcaggaaatgctccctaaagcagctagtttaaatttgtactagatgagggcagcacatctagaagctccccagtttgggatcgagagctgtgcctaaagatagggagggacacactgcaacccgacctggcagcaggcaactgtttcaccccgagactgaccctccaatgaagattattaacagagccttcagtgcatccccagctccaggctgggccctgcagatgataccaagacaaaaccagcatggtcatccttgcagggctgacaccattggggtgggagccactcctgaacaccatagatgttcc

SEQ ID NO: 164513 - DNA, 473 bp, Homo sapiens
  misc_feature (20)..(20): n is a, c, g, or t
  misc_feature (117)..(117): n is a, c, g, or t
ctgagattttattaattttnccagttgcttggcattagaaccgactcatttttacttgacttaatctagcttggaagtaggcaaaatgaataagaaattcttaacagtggttccttnctactgtgagaaaaagacttttcattcagttcccttttgtgcatcgaattaccctccctttccttttttttttttaatatagagacaggggtctcactatgttgcccacacaacatagtcttgaacttctaatctcaaatgatcctcctgcctcggcctcccaaagtgctgggattacaggcgtgaggtaccacatccagagcccctccccctttttaaaaaaaaatcctgtctatgcatagccccttttcaggaaaaaaaaaacaaacaaaaacaaaacaagacagtcactgatcggtaagtggtttttgggaaccacagtgcagcagctctagcttcttggaatagtggtatga

SEQ ID NO: 164514 - DNA, 295 bp, Homo sapiens
aaatgacctaccttcattaaattaaaaaacttgcacagtcaagatgaaccaaaagggggttcttaaagagacaatccctttatggtaacaatttaggaaagttttatacatgttgaaggatgaccagtccaaacaagaggttcttcatataatgtctgggcctcagactgtcccatatagctaatactgctcccaatctcctctctcatctacctagtcccaggtggatgtgaaaaggtagaatgtgagaaggcaggacaggccagagatcagagaaggaacaatctctgagtag

SEQ ID NO: 164515 - DNA, 262 bp, Homo sapiens
agttggatcttctgacttggaaaacccttggggaacaaaaaacaaaaacaacgacaaaaaaaaagtgcaaaacttttctgacactggtttggccaaaatgtctccctgtctcctagataaaaataggaacataaaagccttgaggttctagatgtaaatcatcggtgcatacgataggccaggtgttgggggtagacacagtcagagaggcaaaagtcagagaaaactgccccctagaagcttttactgttaggcagaatca

SEQ ID NO: 164516 - DNA, 740 bp, Homo sapiens
aactgttaggcacaggtcagaacagcttgggagctagtagcttacagagtaaatatatttaaattggaaccatgtggttccttcccctggtgcttacacaatgtgaacagatgcattgtttagtgtcaaagcccttgtgttgactccacagttacagtctctttgaggtctccacatggtacaatgctgaggctgtcaggagtaagaaaaagggcagagaattggagttgtctcaacaagtgttccttaatgccagttgccctgcatttcagaaggagagtattggagaactgcaaagctcccatcagtgagggtctgagacctaaattaaatgcttgtcctttctgggtctttaaaaaagtaaattggtttgtgatatgctttggaagcttttagctccccccgcctccagactttatttctcactatacttttgagcagagggtagagaataggaatagatcccagtaaaaccctcagttgggtatcgtgaaactgagagaaaacaaaaaacaaaaaacaaaaacaacgacaaaaaaaaagtgcaaaacttttctgacactggtttggccaaaatgtctccctgtctcctagataaaaataggaacataaaagccttgaggttctagatgtaaatcatcggtgcatacgataggccaggtgttgggggtagacacagtcagagaggcaaaagtcagagaaaactgccccctagaagcttttactgttaggcagaatca

SEQ ID NO: 164517 - DNA, 115 bp, Homo sapiens
agattacccggcaggtggctacgcctctgggggagttggattcaggggtgggggagaaagagtgttgttagagagctcggtctaggactagaggaacgtgcccttatgtaaaata

SEQ ID NO: 164518 - DNA, 732 bp, Homo sapiens
ggcctactatgtgttagcacctgctggacactgtccagacctttctgatcttcagggagttcagatgcaccaggttccatcactttcttatatttcacactgactatttggtgaatagtcaatcactattcactattaaatagtggcttcagggcatcagagaatgaaggggctattctcatctgcgtaattaattagagaggatttcagaggagatttgagctggggtacaggtgagcagaggacattcggtagagatggataaaaggtaggaagcagaaatgaccatgactgtcaagcaatggaagtgatactttaaatcaagattataaaaatgcaataaccccaaactgaattttaaaaaattgtatttcttttcaaattatttccagataccaaaataactatggttttaatttttaaatgtatgagtttagagagaaaaatattatagttagagttatatagttttaaagatgacacgatactaaggaaagtttgttttccagtttgaatccatgactaaaataaggagagagagaaaaagggaagttatttgcataattcactatttcaatattctcatgagttagtggctaaaagtttatttatttctcatttaaaaataaatacgtctatcttttactttttttttgagatggattcttgctctgtcacccaggctggagtgtagtggcacgatctcggctcactacaacctccgcctcccgg

SEQ ID NO: 164519 - DNA, 314 bp, Homo sapiens
tgagtagctggaactacaggcacacaccaccatacccggcttaatttttttatttcttttagagatgaggttttgctgtgtttcccaggctggtatcaaactcctgagctcaagtgatcatcctgcctcggtctcccaaagtgctgggattacaggtgtgggccactgtgcccagcccatcctaaatccttgaataactttttcttatatcttctaatgcatatgtagaaagacatgctactaatctgaattctggcaagatattcttggtcacttggctgttaaaagatgctttgcaatgaagaatttttttt

SEQ ID NO: 164520 - DNA, 272 bp, Homo sapiens
cttgaattgagcaacattagatagcacttgaacaagatgcgtgggggccattttaaacaacaaaatcatcagtaaaaagcacaaaggtgtaaaatatgtggcactaagtagaccggaaaaacagttgtttacggcattagagctgaaacaagaagacagagtgacctcagcttggagtgtacatgtgatgcaactcaacattttttcctgctctgtagatgcatgcacatgaccatggaagggctgcaagtattgatttggggtgagggggt

SEQ ID NO: 164521 - DNA, 571 bp, Homo sapiens
ctggaagctgatgtggtaggatctcttgagccaacgaattcaaggttgcagtgagctatgatcacaccactgcacttcagcctaggtgacagagcaagaccctattgctaaacaaaaacaggcaaaaaaggatatttcttgatatacactcaaaacacatacactaattttccatccactttattcaaaaaacttatattttttcttttccaagtttacttgtgtgttgatcaaagtatatatattcattataaagtttgaaaaaatagagaaacaaaataagtcattcactgtagctttatacagctaacattgttacgaattttctttgagtcttactagtacatattcttaagcaaaactaaaatggtatgcatatatatgaattttgtgtcccatttttcagatccaacatgaaataaaagtataattttacaaatccatatatgagctaaatcataatttttcagatccaacatcatgaaataaaagtatgattttacaaatccatatatcagctaagtcataactttaaaaaattcatataaacaaatagtacaacagacatgcc

SEQ ID NO: 164522 - DNA, 477 bp, Homo sapiens
tcgaggttggcaggtcatttcctcacagccccgaggccccctcggagccagtggtaggagaaggagccacagggacaagcggtgaatctctggattcccaaccgccctccatgggggcccgcggccctctccctcctctctcccgctgcgcccccgccgcttgctccctgggtacggcctgaggctggacggagcgccgtccgggcgtccaggactcaggcctggccactccgagccccccaccccccgccccgcgccggcccgcgcaccctgcttcccgcaacttgcagcaaacgcagcggcctctggagagcctagcgacgggtagcaaactttgtccccttaagcgcaagagcaatcctcgcaaagtttgtgcggcggagcccactccctacctgagctggggaagctcccgcccgcgccgtgtggctgccggggccgcggggagcagctcgcagcccgggacgcaccggggag

SEQ ID NO: 164523 - DNA, 415 bp, Homo sapiens
gaaagtgaacaagacaaatccagtcctcatgtcctggagctcacagtccagcaagaggacaggagtaggagcaggatgctgaggacatttgggtgttagggagcagttccaggttcaggtggaaggatgatggttgagctcgcctagtggagcaggggagtggtgggcaagcagagagggacacctctatggatttggcatggaaaggattactttagtgaagcactgttccacggaaatataagcaagccacaaatgggagccacatgcatgattaaaaattgttatgtagccaaattttaaaatgtaaaaagaaacaggtgaaattaattttaataattttttttcttttttgagatagagtctccctctgtggcccaggctggagtgcagtggcgtgatcttggctcactgc

SEQ ID NO: 164524 - DNA, 330 bp, Homo sapiens
cctcagaatctcccagggggctctcaaggcacagatgcctgacgcccaccttggagagagctgacacgccaggcccaggctgccagtgagacacagatagcagccagggtgaaggcgccaggacaggtgtatgtgtggtgcagctagggaggccagcgtgcgtgtggcagagtatgaggctgaggtcagctgggaagagggcggattatacaggagtgtggatttcattccacttctgatgaaaggtagtggagggctttaagcaggagactgacaagacgtggtttgatctaaagcagcctctctggctgctgagcagaaggaggactt

SEQ ID NO: 164525 - DNA, 492 bp, Homo sapiens
gggtagagggagaagagagggattgcagaatattccttcagttgaatttttcctttttatttaaggcaatcatcaaatgcttagaagatcgagggtttttcattttacttacatcatcagccttactatcagaaccagattttggaggcaagcagatgggtctgcatgggttacatttatttcgttcacccctgtcaacaggggtgaaagatttgaaagttgaagatgacatctcaatgaaggtgatacctattttatctacccttaattgtgccctgctagaaacaaagaaatcacttcctgaagaaagaatccatccaaacacattagtaaagcgtcatttccaagaattgtacaaggcggacagaagcccttcattgagtgttgctcctcaggatagaatgaaagaccctacattcttggggaaactgcccagtggttttgacttgattcctccagctgaaaagtgcccttcagagtctttaactcagt

SEQ ID NO: 164526 - DNA, 164 bp, Homo sapiens
ttatttttttatttttaatttttttaccctgaagtatagattcaagctgtcctgaatatatacagattcatatttagaaaatatctcagattctgctatgcaccttaaaaatcatctaatgagccaggtgtggtggctcatgcctattatctcagcactttggg

SEQ ID NO: 164527 - DNA, 195 bp, Homo sapiens
gagtaaggccttagcagggactatgtgctatgatcattaagttgaatagaggtgtaagatccttctagctattatagaagagcagttcatggaagaccaagtttctgagaagaggaggatgaagatggtagataaatgaatattccaaaatgaaactacttgttgtctttgtccagtgttaaactattactatcc

SEQ ID NO: 164528 - DNA, 422 bp, Homo sapiens
gcagaacagtggttcaaacccatttgatccttagggcctttgcagctttaggtttccgtaactctttctggatgctcactgctcttatgtgaagtagtacttgtctttcatactcacttcccggccagggaggtggctcactcctgtaatctcagcactttgggaggccgaggcaggcgggtcacctgaggtcaggagtttaagaccagcctggctaacatggtgaaaccccgtctctactaataatacaaaaaaattagctgggtgtggtgatgaacacctgtaatcccagctactcaggaggctgaggcaggagaatctcttgaatccaggaggcggggttgcagtgaaccgagatcatgccattgcactccagcctcggccacaagagtgaaactccatctcaaaaaaaaaaaaaaaaa

SEQ ID NO: 164529 - DNA, 186 bp, Homo sapiens
ctactggacatttttgctgtggagagagaacaacacacaaaccttagcgaacaaaaaagacactgtggccaggcagtcaaaaaaaattacataatttttaaaattttaattgaaatggagtttcactcttgttgcttaggctggagtgcaatggtgccatcttggctcaacacaacctccacctcc

SEQ ID NO: 164530 - DNA, 228 bp, Homo sapiens
cttaaaatgcagattgttcaggaaaataatcctttgcaggctgtcatgttccctagctgtgtggaatcctcattagccagcaggaattactgcagagagatggctggaatgttcaaagtaaataagatggaggggggtgttgttggcaaagtataaacagggtttttttttgtgtgtgtgtgtccccttttcatgcccgtactctttgcaaccatctatcacctagga

SEQ ID NO: 164531 - DNA, 948 bp, Homo sapiens
aactttcccagaactgaactgctccagaatgacaggtatggtccccaacccttcataaccttcctggtctgctctccaaagctgacagactgaatctccttgccacaatgccaccttccctgcagagaggatctgatcggtaaacgtgatgtgtaaatcaatgtgtcataaatcaaattctaattcaaatgctctgggggccagctacttaaatatttaatggaggctttaaaaagttgagccccaaatcctttgtgcaatgtgaacaatcaaatcctaatcaaagacacgtcaaccatcccccgggttgaaataatgggtgttcggcagatgggggctgcctacaaatctgagcctgctgcctcatttcctctagtcaacatgggtagtaaggggattttagtaactccctgaagcttcccagggcttgaattcccccgctcaagcatttcccctccacccactcactccagctgtgtttgttttaattttttgctctcagcctgacacctcagacaacagcagttccttcttgccttctctgttggcaactgctcatgcaccctgttaccttctgaaattacatagtttattaacttgctaccctaacctacactacccttcataagaactcccttctctgctcatgaacatcctgccacgggctccctgggattaaactgcttctctaagaaatgaaaccattgcccagcccaacatcccctttcctgctattttatttgaggagtagggctctgtggttattgatcacttgagaggtagaaggaggatgtttgaagggaaaggaaacaccaagaaaacttacagagtggcagggaagcctgagagatctcataaactactggctttgaagccttcatgggaacttagatgctttgagaagctggaaagctctggacagttccccccgctccccccccccccaaa

SEQ ID NO: 164532 - DNA, 478 bp, Homo sapiens
tgtcggaatccactttcatagtccctgtagttaattatcgtaggctgcaggtctacagactactgaagtgaaccaggggcctgccttacagttgcttttttccctcttaaaatagcaaactgtttaattgtttgctttaattatatttttaggagcatttcaaaggattattatcttctttgtcatacctggctcatttcctggtacgaaactgaaaatagtatctgatcctattggttgcataacatactgagtcataatttcttcctcttgctgttgggaatagccattgctcgttggattcgcagttcctgtttcatttatttgtgcttatatacaactgtcattttgctattcttttagatctttgaaattcataatctacctttctaaaggtgtattttattgagttcctgctatgattattaacattttttttccttttttttgagacagagtctcactttgttgcccaggc

SEQ ID NO: 164533 - DNA, 481 bp, Homo sapiens
ctgcctggatatcttttcacagggggaccagcttgaccttccactccctgctgtatggagagttttgcctaccatcattttcagagctgcttctgccacttttgctactagggattaaaatttctctataatccaaaggcagaaaagagcattcattgcctgacccatgttctcttccatgtgactagcacataatggctgtacctcggctcttgtggaaatttagagtgtggaagccgtagaaggagcagttccaggaatagtgtgtgtgtgcctttgtttttggcagatccatcttgatactaccaacacccagtttgttctaaatctatggaataattctggagagaatgaaaatacccctatttactgagcgccatttagtggaaactaatggtaactactacacagtaaatgccatgtgctgagcaagtcacgttacctgatagctacctgaccttcacaaaagccctgggaaagt

SEQ ID NO: 164534 - DNA, 1108 bp, Homo sapiens
ccattttagtgaggagtttgataatatcattaaagttgaaaatacactattcctagttttatatcctaggaacgctatagctaggtttatatcctaaagaaactgacttatatgatcaaagagaattgaatccgaatgttcactgctacaccatgtagacattattattagcaataaagaataactgaaatgtagattagcaggggaacagagaaaaatacaggtatattcaaatgacagaatattataaagtaataaatatgaattagaactacaatataaatacacatatacacaaaaaacataaaattgagttaaaaaagaaacctgtagaatattacatatcacttacctaagttgtaaaatacgtacaaaatcatactgtatattgttcatggatatataaatgcattaaggataatggcctatacaacatgccttagaattcataattttaaaacaacgcacataaaaagaaactaactgctatatttactactagggtgtttactgaatgcattctttcccaaataataaaggcttctctttatgagaattcattcatatgccagagaagggagaaaggctaaaaatcaattatctagtttccatgtcaaaaactttggaaaagaaaaaacaaattaaactaaagaaaagtagaagaaaggaaataaagatataaaccaaaatcaataaaaacagaaaataagcacaatatagaaaaatcagcaaagcccaaatttggttcttggaaatgaagaaaaagagaggaaacaccaataaccagtattaggaatgaaaagcagacgtccctataagatgttaaaaagaggataatcctaaacaactttcaccaacaaatgacaagtttagatgaaatggacaaattttcaaaaaccaacacgaatatacatacaaattttaatatgccaatatctaaaaattaaaactgttattaaaaaccttctcataaagaaaactccaggtccagaaggctgaattctggcaaattcttttacatacctaaggaataagcacattagttgtacacaaattctttcaaaggacagaaaaataagaaacacttctcaactcattataaagccag

SEQ ID NO: 164535 - DNA, 780 bp, Homo sapiens
cgcccaggctggagtgcagtggcgtgatcttggctcactgcaaggtctgccttccaggctcacgccattctcctgcctcagcctccagcatagctgggactacaggcgcccgccaccatgcccgcctaattttttgtatttttagtagagacgaggttttaccgtgttagccaggaggtctccatctcctgacctggtgatccgcctgcctcggcctcccaaagtgctgggattacaggagtgagccaccacgcctggccttaattatatttttatgtaactttttgatactactcaagtattttttcctctacggtactcactatgctgaaagatttttctttcacatgttttctaaactatgtaatataagtgtcattggctatttttgtccacctgatggaggtaagaaatgatcaaagtacagtttaacagcagtattagcaagagttgagccttgctgaatatgtaagtttcaacggatttgctttgcaactacatgcagtagatgttttaagagggtaggtaggatatttaaacttaacctttttgtgccactgtgtgagagtgggcttctgaaaatggaggggggaagcatctctccttggttagtaggcattcaagtggaagatatgttataaaaacctagttgtatcttataggatgctaaaagcaaggtgactgaacttctaacagggcattctacattgagtatgtgcttttctctataattaggctaaaaaaaggttggtaagtaatatgaacttaaaatcaagatta

SEQ ID NO: 164536 - DNA, 592 bp, Homo sapiens
ctcggaccgctaatctcttctcacgtatatatcttgcccacttctaccctatagagcccaccacgcctggccttaattatatttttatgtaactttttgatactactcaagtattttttcctctacggtactcactatgctgaaagatttttctttcacatgttttctaaactatgtaatataagtgtcattggctatttttgtccacctgatggaggtaagaaatgatcaaagtacagtttaacagcagtattagcaagagttgagccttgctgaatatgtaagtttcaacggatttgctttgcaactacatgcagtagatgttttaagagggtaggtaggatatttaaacttaacctttttgtgccactgtgtgagagtgggcttctgaaaatggaggggggaagcatctctccttggttagtaggcattcaagtggaagatatgttataaaaacctagttgtatcttataggatgctaaaagcaaggtgactgaacttctaacagggcattctacattgagtatgtgcttttctctataattaggctaaaaaaaggttggtaagtaatatgaacttaaaatcaagatta

SEQ ID NO: 164537 - DNA, 286 bp, Homo sapiens
tgttggataaatggagttgaaaatcatgaatttgatggcgacagacccagagagttgggcaggtagaaacttcatttcaagtgatatgcagtaaataccccaaatttgagtcaaatggcctgtgtaaaaaggaagtgaaaatgtaacccgtatctccttgtaggtgaaaaggccatatctctaggtcttaggtatgaaaaggatgtgtgggcttctgggtgtttttgactgactaagaaacactgtgggatggatagcagctataaactgatctataggagtggtg

SEQ ID NO: 164538 - DNA, 493 bp, Homo sapiens
taggttttctttttttgagacagagtcttactctgtcgcccaggctggagtgcagtggcatgatctcggctcaccacaacctctgcctcctgggttcaagccattctcgtgcctcagcctctggagtagctgggattataggcacctgtcatcacacctggctatccacttaggttttcaaagggccccttggtcttggggtggagagtgaagggaagcagggggaagaagtttaggtcttgcaatcatccaggtgagacatgatattgtctttgatcagtggcaggggtggaggtcgggagaagcggccagagagcagatctgttttgcgggtggggctgacggtatttgctggtggactgccctggaaccagagggaagtacagagtcaggttgactacaaggtgtttggcttaagttcgtagaagaaaggagttgccatttgctggcatgaggaaaatgaagaagcagattttgggaggaaaatgaaggg

SEQ ID NO: 164539 - DNA, 400 bp, Homo sapiens
aggctgctccgaggattacgtccttcatcatacctactgggattataggcacctgtcatcacacctggctatccacttaggttttcaaagggccccttggtcttggggtggagagtgaagggaagcagggggaagaagtttaggtcttgcaatcatccaggtgagacatgatattgtctttgatcagtggcaggggtggaggtcgggagaagcggccagagagcagatctgttttgcgggtggggctgacggtatttgctggtggactgccctggaaccagagggaagtacagagtcaggttgactacaaggtgtttggcttaagttcgtagaagaaaggagttgccatttgctggcatgaggaaaatgaagaagcagattttgggaggaaaatgaaggg

SEQ ID NO: 164540 - DNA, 701 bp, Homo sapiens
gctgaaaattgatgtttcaaaccaggcgggcacaggcatcatttgtgagctctgctgtgaagccagactgggggcttccagcaagccgtgcccagagggaaatcactcagcctcagctggcttctcctgactgggacaagggtgtgagcgtgcgggccctcaggtggtcttaccgtgtcctgatgggaaggtgtcctgggtcccaaccctgagcgtggctggtgtgagggaccctcccctcaaccgtcccacttcctgcacagccaaacccaggtctgtaagtcaagggtgtacccccaagaaatggagagtctgagccaggcatggtgacccacccttgtggcagatgctcaagggaaacgcccctattggccaccccattctcctctttcagacgctgccatgcaggggcgtcttagagccagtcgaactgaccgtgggttctggacggactctctctagaagggccccatgacacttggtcctgcaggcacaggcctctggtcccttggtctctgcatggatgcacaaaatgcttacgtgtgtagatatgagggtgcacacaaacacgtggacaggtggatacacacacgtgaacacggatagcggacgcacacacacgcgcgtggggctgacgttaaccctgggatgtgccgtctgttttcagggcctctgtcttactgtgagtctgagcagctgca

SEQ ID NO: 164541 - DNA, 324 bp, Homo sapiens
gttactgtattatccatgggtttgcattgtttttgatgggaagtgtgtcattattctatcctttgcttccctatatgtgtaccctttggttgcttgaattttctttttgaaaattttcagcacaatttgattatatgccatatgtgatttctaaaacaaattcttaacttagtcatggtcccctgtatttatgacaggctgcattatccacccacctatgcccatacttggcaatgcttctaacagttgccattctctgccaactcaagaaaggctcatacatgactccttgaagtttaattcttttttttttttttaatcctt

SEQ ID NO: 164542 - DNA, 484 bp, Homo sapiens
ctggttgctattttatttactgagagcaacctgctcatatttcctattataatggtgcatttgtctgttctgccattcagtgctatcacatttttgtattctgagtctttgttattgagtgcttacacattcagaactgtcatatcttttgggcaaatataatttcgtatcattatggaaaccgccttttaatctgtaatcatctgtttcacattaaattctactatgtctgatattaccagcatgttttcagttagcacttccatggtatacatattttctatccttttattttcacccattctgtactcttgtattttacgaatctccttggttaaaagcatgtaattgtgggttcatttagttaatctctggtaaatcactcttaaaattatagcatgtagtacagcaaaatttaatgcaattactaaggcatctgggtttatatctactaccttagtatttcctatatgtcttgacttta

SEQ ID NO: 164543 - DNA, 256 bp, Homo sapiens
aaggactcgagtgtggtgtctcgccagtgggggtcatggctgtagagggtgtatgcctgtggcctcgaaggtctaggtagtttgggacccagtatatgctaatgagggcagagtggaggaaggacctgagggtatctaacggaggaaggactgtggaatacctgagcctggcctaaaggagatgagaattgcgtgtctgtctgggcccaggaaggagtggtggggaagtgtcttagcactggcgaggctagtggac

SEQ ID NO: 164544 - DNA, 233 bp, Homo sapiens
aaggactcgagtgtggtgtctcgccagtgggggtcatggctgtagagggtgtatgcctgtggcctcgaaggtctaggtagtttgggacccagtatatgctaatgagggcagagtggaggaaggacctgttgggtaccagggaatgaaggtagaaaaaggagccgtgggagaaggctccagggaccaaggctacaaggagaaaggcagcgtgcactggcagctagacagatctg

SEQ ID NO: 164545 - DNA, 526 bp, Homo sapiens
tcactaaccagttgcagaggagggttaaggccattccttttgaaagctaattattttggacaacacacctgtcattaagcaacataaggtactcaaaaagagctatttgtctcgcttgacttctcaccctgccacatgttgttgaaatgatggataatatggtagttcaaaaactaaaagagctttcaatccaaggatttagctttgggacatagggaaggttttatttattattattattgtggtaaatacacgtaacataaaatttaccatctgtattagtccattctcacactgctataaagaaatacctgagactgagtaatttgtaaagaaaagaggcttaattagttcacagttccacaggctgtaccggaagcacggctggggaagtctcaggaaacgtacaatcatggcggaaggtgaaggggaagcaggcacatcattacgtggccagaggaggaggaagagagggaaggaggaggtgctacacacttaaacaaccagatctagtgagatctcactc

SEQ ID NO: 164546 - DNA, 593 bp, Homo sapiens
ctttcaacacttgagggccagttcctgccttagggcctttgcttgtgatgttgcccctgcctggaacattcttccctccctcaaggaagtccctgaccaccccatgtaaaatagctctctgttcttttttctgcattattttctttataaggcttggcaccagtagactgtaagctcttcaaggacaggggcctttgtcttgttctagtgtcctagaacagtgcctggcatataatggtgctcaattagttaagtgaatgaatagatggatgaataaatgaatgataggatttggtcttcatgaaccctgaggtccttccaactctgagattctatgaaagtccttgataagagttacggaaaattcttcattcagaatttaattattggaactgataggagtttgacacagaccttcctgcaaggagtcaaatagggaagggaagatgtgaatcccagggactgccataccgcagagcagagagtggtctgggcctggggagctgtacgttaaggactcagagttcaccggaaggatagagggctcccagctcaaacctaggaagacttctggaggaggtggtgtttttgac

SEQ ID NO: 164547 - DNA, 110 bp, Homo sapiens
gcccaccccttcaatgactataccttctctcctctcatcagtgccttgattcagcccaccccttcaatgactataccttctctctcatcagtgcctcgattctgctttcc

SEQ ID NO: 164548 - DNA, 747 bp, Homo sapiens
gtttctgaaaacccacatctttaaggccaggttgcctcattctgttccgagttggggatgacattgcgaagcctgatggatgatgaagaagacaggttcaaagagaataattaatttccccaaactcatacaaacattggcagagatgaaaatacattatgtgattcccaaatctatggctttacatggtactagaggatcagttgaaaggcatggaaattagatggagtctgctttgttgccctggctggagtgcagtggcacgatctcggctcactgctacctccacctcctgggttcaagcaattcttctgcctcagcctcccgagtagctgggactacaggcaagtgccaccacatgtggctaatttttacatttttagtagagatggggtttcaccatattggccaggctggtctcaaactcttgacctcgtgatctgcccacctcggcctcccaaagtgctgggattacaggtgtgagccaccgcgcctggccaattctgttttatacaaaaaagattttggggtttgttaccagagtttacctagtttaccctggcttatgcgttgccacctttcttcttgactttccttaagctctttatgattctccaaagcacttaaactacctggcatatttgtttatggtctgtgtatacctcttagaggacaggagctttgtttttttcactattgtatctcagtatttagaaaagtacctggaatatagtagacactccatta

SEQ ID NO: 164549 - DNA, 365 bp, Homo sapiens
gtataacacgacgcctggtgattgcttgactctcgaacttcaacagcttaaaaagaaatgaccacacagaaccacagggtacgaaatgactgttctttctccactgtgaaggataagatggaatggaacaaataaatggaatttaattctaggctatgttcaaggctgttgtgtggaatatatgccatgagctctctctcttttaggctttacggtgccttctatttcctttgtaatgttccatagcatctaatagaaatgttccatctagaaagatgctctgtaaatgcagctagtctagcaaatccatacttatgtcagaatgttttccctcttccctggctatccagagaggtgctaatttg

SEQ ID NO: 164550 - DNA, 372 bp, Homo sapiens
tttctattcatttttatttcagctgtggtaatttatatatttttaagactttctaccttaaatataagttgtataatttgtggtcacaaagtgtttcatagtatttcccttataattcatatatttggatgggatgggggaggattggtagtagtaacctttgctcctgattttggtaatcaacacattatctcttttttctttcttttttttttttctttcttttttgagacagagttttgctgctgtcgcctaggctggagtgcaatagcaggatgtgggttcactgtaacctccgcctcctgggttcaagtaattctgcctcagcctcctgagtagctgggattacaagcacctgccaccatgcctggc

SEQ ID NO: 164551 - DNA, 465 bp, Homo sapiens
gaaacagccgactacagtagtgctcacactaaagactgtcccaagtgcaacatctgcattgagaagaatggaggctgcaatcacatgcaatgctccaaatgtaaacacgacttctgctggatgtgtctaggagattggaagactcatggcagtgaatactatgagtgcagtcgttacaaggagaatcctgacatcgtgaaccagagccaacaagcccaggcgagggaagccctcaagaagtacttattctactttgagaggtgggaaaaccacaataaaagcttgcagctagaggcacagacataccagcggattcacgagaagattcaggagagggtcatgaacaatctggggacatggatcgactggcagtacctacagaatgctgccaagctcttggccaagtgtcgatacaccctgcaatacaccaacccatatacatattacatggagtctggacccagg

SEQ ID NO: 164552 - DNA, 323 bp, Homo sapiens
aggtgcctagaggatcccgtagaggtgtggcaggtggcgggcgactgtagtcccagctactcaggaggctgaggcaggagaatggcgtgaacccgggaggtggagcatgtagtaagccaagattgtaccaccacacccagcctgggcaacagcaagacttcgtctcaaaacaaaacaaaacaaaacaaacatctaagtcttagcctggttaatttgataagtataacacagcctcaaaaatgtccagtattccagagctaaaagcagactgcccagattctaaccctagcacctccatttactagttgttcaacctgccacaa

SEQ ID NO: 164553 - DNA, 182 bp, Homo sapiens
agagtgagactctcaaaaagaaaagcaaagaaaagaaaaattaccccaaatgggccgggcgtggcggctcacgcctgtaatcccagcactttgccagggaggccagaacacgcgaagagccctgaataggtggggtctgtacctggagttgactgagcgtgtgaagccccctggcctttgtc

SEQ ID NO: 164554 - DNA, 571 bp, Homo sapiens
acgtccatctaatttttgaatttttagtaaagacagggtttcacaatgttggccaggctggtctcaaactcctgacttcaagtgatccacctggcccatttgctaaatttttatgctcttactacatggttgtaaaagtctccagtctaggtgacagagactccgtctcaaaaaaaaaaaaaattaaatgaggattacaggcttgagctcctgtgcccggccggcctgctatgggttatacttaacgttgagttgggttacttaaaattgataaaaggtagtatagcattgaaccgccaaatttagagaggtgctttccttggggaacttgtaaatggtgaaacattttggtacttgaaattaaatggtatacgcttatagctaacgagatattgggttacagagcccagccaaggcacagaaggctgaaagttcccttgatttacaaagaagcaattacagtttaccccatctccatctagtgtggtggtttactactctatttaagtgtgccttcaacttaattactttctggtggtgctggtaatgaaacttattgtgatcaatactc

SEQ ID NO: 164555 - DNA, 373 bp, Homo sapiens
aacctgggccttgttgctctcattgtcacaggtttcttttgagtggccctcctccccacaatatgaacagcgggttgtgtattttcgcttcctggctctacgaatattcccaggaccatcattcttatacccagaaccaccactggtagaaagagactgagccccagaattgttgggggaatcaataaccagcacttgatccagaggtctggctcttcctctgaagggaggggcacctgtaggtgtcagtgaagggtacagagacaccaccaggatcacatcctcatcagagtcatcaagggtatcatctatttctatcacgttgcagttacagtcagcactgctgattgctattggctgggcgccctgaaat

SEQ ID NO: 164556 - DNA, 344 bp, Homo sapiens
ttcactctgttgcccaggctggagtacaatggcacaatcctggctcactgcaacctccgcctcctgggttcaagtgattctctgacctcagctttttgagtagctgggattacaggcacctgccaccatgcctggctattttttgtatttttagtagagacgaggtttcaccaagttgtccaggctgatttcaaactgctgacctcaagtgatccgcccacctcggcctcccaatgtgctgggattacaggcatgagccactgcgccagccacttttatatttctttggtttccactaatgttctttctttagaggttacaagtttatttttttaatatgcttt

SEQ ID NO: 164557 - DNA, 521 bp, Homo sapiens
cagcaatcttcaaagggaattatcagtgaggttaagtcagataagaacttagtctatttgtaaggctttgattttaaaagaaagtgctgacagccactattcaagatcttttctatatataaatgactgagcaattttgtggcttataattagaacaatgcatgacaatttctagattgaggttccaaggttactcttctctttggtctatcagtgccaaaaagccaaaaggtcatcttctaaggctccagggatagcactcattaccctgataaatggctcactctagaagtcctggctttgatgttaccttttaaaagtggctggtttttgtctggccaaaggtggggccatttgggtggctcacagataatttgtggcaacactgagttaatatcagtttcaagacaaaacacattttattgttaagaaactatttgttaactcattacctcatgtcatagtattctctgccttgccatgtggctataaaaaaaaaaataaacattcaagtttcacat

SEQ ID NO: 164558 - DNA, 446 bp, Homo sapiens
gtgagcaagatatcactaatatctcaaagaaaggaaaggacataattcaaaatggaacatagaacatttcaaacctgagaaatacataaggaaatttgtagacagacactgctttctttaaaagaaagaaaacaggtgtctgcttatccctgtagccagaggatctacatcttctgggggagaaaaacaagggtggaaagtgtaattcaccaaatctcatctttcagcccccataaagacctcacaccctcctgctgctgtgggaatcaggaggattttgactaaggaaagtattttaatctcagtaacactgagacatccaacctgagaggaaagtgaggggcaatgaggcaggagttctcctttggtgtgggctcctgggagggctgttgccctgttgtgcaggagcagtagctcctcgggcaggagcttgtctctgaggaggg

SEQ ID NO: 164559 - DNA, 215 bp, Homo sapiens
aacttgacaacaccaaaagtgggacaagctgacatgatatgcacccgatatgatgcaaaccatttacatgtactttgtagattttttttatagtatttttgccaaaaaagtttagcctgaatataatcaggatgaaatacattcaaaatgttggacattttataagacagtgggtcgaaggccgggcgcagtggctcacgcctataatcccagca

SEQ ID NO: 164560 - DNA, 604 bp, Homo sapiens
tccaaacatttaggaaaggagttaaatgcagtcaaagcttagattttagaaaaattcccctggccaactccagggaagaggagcagctccacgaccagagcaaaccaggtatttcctgtgcaggcccagcaagaatcctgtgcaatgaagtcgtttataacagaggaatgctttggcgagaagggaaggccatggagtaggaaatcaacatatttgtgttccagtcctgaaggtacctcagcccttttcatatacaagcttaatgttttaagcccgagtagctgcctctatgaaatgcaatcataaaagctgccttactcaccttcctgtgctgttgtgatgaccaaaaggtaaagaggggtacaaaagcattttaaaaactataaggcactagagaccaatgttaggtatgtacaaaacaaaatacctgttgaggataactttgaagttttcaatcagaggaaaaagcaaatgtgatctttaggatgagatagataagaactttctagctctaccccctcatctgctagaggacttagggcaattcttctagccattcagaacctcagtttgctcactgcaaaatgaggttaacgctccctat

SEQ ID NO: 164561 - DNA, 365 bp, Homo sapiens
tctatccctaatgcagcccctgtatctgtgtcctttccccattggctggagtaagaccgcacaatataaactaccccgattggctaaaacttaagcttttctaaatatggtcactgcgtgatggggaagcaagggagaggagggggtcctcacgggaaaccaggagctaatgcattcccaaataagggaaggaatgtgagccacaaaccagctgagacttaggcatgccagaatatattagggaacaggtaggccaggctcagaaaaatggagaacaaagaataatgaaactagatttcttgaagaggaacttattgtgtcccacacttacctccccctcaacccctaacctgcatacccatgtg

SEQ ID NO: 164562 - DNA, 640 bp, Homo sapiens
taatgtgtgtgctatgaatgtaaaacaccatattataatgaaaaattgcattggctcctgttattgttaatattaggtttgggacagaggaagaatggaagttcaaatggtgggaatgttgctttagaagcgatctatggcaaggaaacaggtcaggaaatgcagctggagaaagccatatgccttttgtctctttaggacagcaggaaagctgtagagaaaaggaagactgagtgagatgtgcaagtgcctcaagcttcaaggaaagggacaaaatggaagcaacattacaaacacaacatcctcagattaattcaggtttatgcacttatttcctgtaactgatgtaataaacaaaccttagtctgattcagaaagtgacatcacagagattatttccaatatccccaaaaatgtggggtatttccatggtttataaatttctaaaggtaaaatcaaactaaataaagcctgcattaagaaaaaagaaagaaaaagaaacatattcagatattatttatcctgaaaagaaaacaggtattaatttatatttccttatttactttccccctccccccaacagagaaacaaattatataacaccttgtgtttatataaacgtgtgtctccaagtaggagg

SEQ ID NO: 164563 - DNA, 564 bp, Homo sapiens
tataaagcgaacatgtgtcaacgatttatttaactccttaatgagggagccagaaaaatggtaaagctgccttcaaagagcatttgaaaggcagagatttacagtcagctgggaaaagaaacgctaaaataactttgctaagttagatgcagaactagttaatatcctataggacaataatcctgtgacctctgggtttagtttaggattttttttttccctgccagaagaaacacacctttgtcatacaggtgcatctttgcatctctataacaaaaataattggcaatttatcaatgtataagttaatttctaactttgcagaagctgtgctctaatcacacaggggtaaacagtaagtcaaacaaaggtacatttccttagagaactgaatagtctacaggtgggcctgttagtgctccggtgtgacatcaagagaacttgcaggcagcctttggccttacttctcacatctggaattctttaacaatatcctggctgggtgcagtggctcacacttgtaattccagcactttgggaggccaaggcgggaggattacttga

SEQ ID NO: 164564 - DNA, 417 bp, Homo sapiens
tctattgccatccattccctcccttatggacccaggaaagaaagaaaggtgtcctgggtcaagtcttaaacacactgacagaccttctgtcaaacacacatattaatacattaatagcatttgctaggagagagtccttatctgtggattgcttttagcagtacgtaccttgctatggtttggatctgtgtccccacccaagtctcatatccacttgtaatccccagtgttggaggtagggcctggtaggaggtgattaggtcacaggggtggattcttcataaatggtttagcaccatccgtttcatgctgttctcatgatagagttctctcgagatctggtcatttaaaagtgggtggcacctccccccattctttctgctgctcccaccatgtgagacgtgtctgtttctgttt

SEQ ID NO: 164565 - DNA, 683 bp, Homo sapiens
atctgtaaacaaaaagaacgtggtgtcagttctcatggaacttatattctttagggcagatagataataaataaaatatataaaactgttcaggtaatgatgaagtttatgagaaaaatgaaaagataattgtaaagtgtgtatgttggaagatgtagtgcattcttctgtaaatggtgtcaggtgcttttctctacggaggtcattttgcactggtatctgaagaagctagcaatgagatctgacagaatcatgttccaggctgacagaataacaagtgcaaaagtccagatattttagaggcttatttgagagtaagaataatagggctcatttgactagaaaatagtaacgataggaaaagaagtgagagataaaattgaataaactctagcaatgtgctctcgtggtcctatggttttgtcaattttgcaaaggtcaaaactgttgtactctttttcttaaagagggaaccccaaattatataaactttgggctccacaaggcctggatctcccccttatttcatttttagggcatagagagaattaaatgcgataatttaaagtccttacctcattgcctggacacatagccaacatttattcagtgcttgtaactattattattaggcagagttcttcaaaatcatgccaattctcttcataattaagaaatactgt

SEQ ID NO: 164566 - DNA, 582 bp, Homo sapiens
atctttaactaccaagcccagggtgcggcgccaggctgtctgcctgtggatttcatttctgccttttagtttttacttctttctttggaggcaaaaattgggcataagacgatatgaggggtggtctcctcccttactagaagaaggaagaaactcacatttgtcttccccgttggaagcaagctcaaactccataaaggagttacctgcatttcatcgtcatcaaagcaggaaaaacttgcctttcttgcgttggaagatagtaaaactccaaaaaaaaggagttgtactgcaaaataaactttagatcttgaccaagttttgaaagatcagtgattctctggagggggtgcttccaggcctgtctcggcaaattgttctattggtttgagccataaagatagttcaagctggtaccgagcactgataggagatttgtcaaaggtcaggggagcctccacccagaatcccttcatggttgccaaaatgtgagccttgaatatctgagaagggtctcagttaatttaggaagtttattttgccaaggttgaggaggcacacctgtgacacagcctcaggagg

SEQ ID NO: 164567 - DNA, 577 bp, Homo sapiens
gttggagagattatgttcttttggccaaggggaaggagccactagaaagcagaggttgaagaaacaggagaaagaacattgatagattaactggccctcaccttttctctgcctcaaggaaagcagtcaaagttggtatagacagaatttcggcagtgtatggtggattgggggtaggggtagaggaaattaaagcctgtgtttttttgtttatttgtttgttttttctgaggactgagtcattagctgaaagcatagggcattatagagcatagtggggacttggggaacctgccactggagaggacttaggaccttttaatggcagaaatgatgactgtgttggcagcagttcatcagtgcccagtactcaagggtccccctgagaagccagtggttgcactgatctaggtagaatcaggcacagaataagtcaggtgatgtgcctttctagcactggcctcaggctgagttataagggaagttacacagcgagagggacaggcaaagatggaaaagagagagtgagaaacagtgtcttcttcctggctggagagcccgtgtcatgaaaatgggg

SEQ ID NO: 164568 - DNA, 543 bp, Homo sapiens
gttggagagattatgttcttttggccaaggggaaggagccactagaaagcagaggttgaagaaacaggagaaagaacattgatagattaactggccctcaccttttctctgcctcaaggaaagcagtcaaagttggtatagacagaatttcggcagtgtatggtggattgggggtaggggtagaggaaattaaagcctgtgtttttttgtttatttgtttgttttttctgaggactgagtcattagctgaaagcatagggcattatagagcatagtggggacttggggaacctgccactggagaggacttaggaccttttaatggcagaaatgatgactgtgttggcagcagttcatcagtgcccagtactcaagggtccccctgagaagccagtggttgcactgatctaggtagaatcaggcacagaataagtcaggtgatgtgcctttctagcactggcctcaggctgagttataagggaagttacactggcgaggctaggaccactggcgaggctaggaccactggcgaggctagggcac

SEQ ID NO: 164569 - DNA, 318 bp, Homo sapiens
ttagcacgaaatcaccacccaatgcaaagagatcaattttcaaattataaagctgattcaaagctcagcctcctggctgccagctgaaaggatgccaccatttaagtctgctctggctctgtctgactgggctgtttccacggatgctcccacccctgaacaaggccctgagcagctgcctcgcagatcaggccacacaccaacaggtaggtgcccccagcagtgacctcatccccagtcataagaaaatgcctcccacctgtcaaatggcccagctcccctgaagacagcatctgcgtcctcctcctgcacccaggt

SEQ ID NO: 164570 - DNA, 315 bp, Homo sapiens
ctgatttctgcttccagtgttattttcgtccttctacttaacagaggttttattttgctcttttctagtttcttaaggtagaaagtcaattatgggtttgcaacctatcgtcttgtctactgtcagcatttagtgccataaatttctctatcagcactgctttagctacctcccacatatattgatacggtatggtctcattttcattaagtctatgcatttctactattgaatttgaggccccttcttcactccagactttatttagaagtctgatgtttaatttctaaatgattagatattttcctattgtca

SEQ ID NO: 164571 - DNA, 607 bp, Homo sapiens
acgtgggtttgcttctatcaaataaccaccccctaaatttaaacatgtgacctatggggaggaaggggcaccgtggagaaggcaggcttctttgaatatacctttttatagatgtgatattagaaccacacaaatattttatatatttaggacacagaattaaatgagatcggaaatgcaatgcctagaagtcaaaagcaaaatgaaacaatggcgggaacctgcatggagctcacagcatgaccactgagaggaccctgagcagctctaaacaccacggtgtgacttaaaatcctctgagtgaggggcccggtgcgatggctcatgctgtaatcccagcactttgggaggccggggcaggtggattgcctgaggtcaggagttcgagatcagcctggccaacatagtgaaaccccatctctaccaaaaatataaaaaagtagctgggcgtggtgctgcatgcctgtaatctcagctactcgggaagctgaggcaggagaattgctagaacccaggaggcgaagattgcagtgagccaagatcccgccatcacacgccatccagcctgggcaacaagagcgaaactccatctcaaaaaaaaaaaaaa

SEQ ID NO: 164572 - DNA, 149 bp, Homo sapiens
agatatttcaatattccaggagattggtgatgatgacttggttccaggtggtaaaagtcaaaaagtataaaacggtaactaaatatatagtttgaggtagagctaaaaggatgtgctgacaaattagatgtgtggtataaaaaaagaca

SEQ ID NO: 164573 - DNA, 191 bp, Homo sapiens
attcagtgaatacatatggcatttatggtacattttaaggacataaaattgcagtgatattattgggagtagattttattgccatggctttacaacacagacaaacaaaaataataactccattagttgttgaattgaactggcaggaagcagcacatcaaaagcgcttgtgagcaggcaggaggatgggg

SEQ ID NO: 164574 - DNA, 520 bp, Homo sapiens
tgctctgtgatcgatctagaggaccccggctcatttcatttaaaataagagtagactgggcctgggcactgtggctcactcctgtaatcccagcaggtggggggctcattatctgtttgtttcaagcagaagggtaagtctggtgcctgcatttattgaaggccttgtgtaattcgatgtgtggaatacccaactgattagaaagtaaatgttagccgggcgcggtgactcacacctctaatcacagcagtttgggaggcttaggtggcagatcacctgaggtcaggagttcgagaccagcctggccaacgtggtgaaaccccgtctctactcaaaatacaaaaatcagccaggcgaggtggcatccatctgtaatcccagctactcgggaggctgaggcacaagaattgcttgaacccgggaggtggaagttgcagtgagccaagatcgcatcactgcactacagcctgggcgacagtgcaagactctgtctcaaaagaaaagaaaataatgttaatta

SEQ ID NO: 164575 - DNA, 354 bp, Homo sapiens
ttacaggaggcggagctcaggtggtaatgcaagcagtggggagcagctgtaaacacagatgaagcttttgagcccctcctgctgtgaggccaggttcctaacaggctatggaattggcttgtagcctaggggttggggacccctgctgtataggagttgtgaaaggaaattaaatcttggggccctcaatccctaaactaaaggaaaaagtcaagtggggaactgcttagggctaacctgccttccattctattcaaaatcatccctctgctcactgagatagatacatatctgattgcctcccttggaaaggctaatcagaaatgcagccattggtctctcacctaactttaa

SEQ ID NO: 164576 - DNA, 492 bp, Homo sapiens
tttcaggatgaagccagctctccctcttctcaagcacctgtccttgtcacaaccttaccttcttctgttgctttcacaccgcaatggcacagtacctcctctcctgtttctatgtcctcagttcttacttcttcactggtaaagaccgcaggcaaggtggatacaagcttagaaacagtgaccagttcacctcaaagtatgagcaacactttggatgacatatcggtcacttcagcagccaccacagatatagagacaacgcatccttccataaacacagtagttaccaatgtggggaccaccggttcagcatttgaatcacattctactgtctcagcttacccagagccatctaaagtcacatctaccaaatgttaccacctccaccatggaagacaccacaatttccagatcaatacctaaatcctctaagactacaagaactgagactgagacaacttcctcccctgactcctaaactgagggagacca

SEQ ID NO: 164577 - DNA, 476 bp, Homo sapiens
acctggaaatgtggaagcagctttggaaccaggtaatggatggaggttggaagaatttggagggctcaaaagaagacagatagatgagaaaacttttggaccatcctagagactggttcaatggttgtgacaaaaatcctgacagaaacatggacagtgaaggccaggctgaagaggtctcagagagaagtaagaagctttctggaaaatgtcttccttttggatatggaaagcttacacaatgcctgtaccatcattgtaccttagaagcagtgaacttgctttttatttcagagactcataggcaaagagactgtagccttgacccagatgacactttggaccttgtaactttgagttaatgctgaagtgagttaagactttgggagactgctggcaaggcatgattgtattttgcaatgtgagaaggatatgagattcgtggggtcagggacagaataatatggtttttctct

SEQ ID NO: 164578 - DNA, 415 bp, Homo sapiens
tcgtatgtgtgtgtaccaaacctacagtaatcggaataaatatatagaaatattaatataaagaagagtcaagatagcaagcaattacacatttattaagtacatccaccttttgccagactctatgctgagcactttaaatgtcatcttatttatgtctcacaatgtacagtaaactgggtagggagagcttcaggaagtttgctaacatgctcaaagctgcaggcttgaatcacgtgtatttaactccaaaacctgcatgtgtttttcatcaccccaaactaattaagtaatatgaacataaacagaatgattatgcaaatttattttaaaagaagctcaagccttctaggtttatctgtgagaaaatggcaggtcccatccgaagcagttgccgcatccgaagcagttgccg

SEQ ID NO: 164579 - DNA, 182 bp, Homo sapiens
agctctggattcatcatttattggttatataaccttgaacaagtccctaacttcctgagcctcagtttcctcatgtcttaaatgaggattgtctctactttgggcccctcattagtttgtaataaaggtcaaataatatgaaagatgtgaaagccctgtgtaagcttttcacttgggcaagg

SEQ ID NO: 164580 - DNA, 238 bp, Homo sapiens
agaaagatcttaagttgtgcctcagagtattttcatcagacaaacgatgtgtctcagaaaatctctgaataacatcacaggtttttaaaaagtttaagggtattttcatcagcaaaagcttgaggcagagtttatgtgggacgagatgtgtggttgttgcttttgtctgatggagtgaactcaaaattcacaagtgagccacaaagtttttaagagaagtctattagcagaaacatgg

SEQ ID NO: 164581 - DNA, 388 bp, Homo sapiens
ctacaggactgcccgacagcaaaggaaatgaaatgaatggaagagatcatgactttgtagagctgtaagtccacatgaacacatgatctctcttcaaagataccagtgtccagtccaaagaagcagtacagaattccaacccttcagacggttccaatgtagggtctgaatctttccattataccacaaaattagtcccactctctttttttttttttttcttgagacggagtctcactccgttgctcaggctggagggcaagggtgcaatctcgcttactgcaatctctgcctcctgggttcaagcgattctcctgcctcagcctcccgagtagctgggattacaagtgcctgccaccacacggggcgcagtcggtgagggggtacc

SEQ ID NO: 164582 - DNA, 129 bp, Homo sapiens
ttttacatttcaaataatccttgtctgtcttaggccaggctctaagtgcttttgtcaataaactagaaacctttgtgggttttgaaatacccaaagatttttagatttgactccaaaattggctgggtg

SEQ ID NO: 164583 - DNA, 330 bp, Homo sapiens
ggggtggctgtgtggagtctctagcaccagccttcaggacagaaccgtcctgtcctctcccctccccagttagatttctgtcaattctgtgggttggctttcagagagcatttggtcaatctggttgttgtctctttccttccataactacttccctgcccctaggacttttgtagccaggaatacccctgatagaggggcagaagggctggttttcaatcacatctccctggctgttttagttgcgtgactctggggaaaatgctttctcttccctgctcccctgtttttccaatagcagagtaggaattggggaggaggtcactggac

SEQ ID NO: 164584 - DNA, 527 bp, Homo sapiens
tgtgcccagctcttctagttcatttttaagtgttgagtccctgctgttttaagagatgttttggtgaaaatctacattcagagagaaacagattaatcttccacatttttaataaaatacatatagtacttgggattttaagaaaagaatgccatgtattaaaaggtgctattttcaactgtttattattttaaaacaggaatgcttatcaatacttttgaatttaagataaatgtcttggttaaattttctaggcagttcaaagatggccatttgctggtgaattttccaaaataggtaacagataaaatgattatgtaagaacttggcacaacatatccttttgcctttagttgttcaagaaatgataccaaactcaaagtcattcacttgaaacaactgagaagaccattcttaggtgtttagatccttgcttttagaaatattcttagttatatttgtgtttttaagagttattgagtggattttttttcatgaatttttaaacattagacttagctgaattg

SEQ ID NO: 164585 - DNA, 248 bp, Homo sapiens
tttagcatttgccatccatggatgactaagtgttaaaccagcttagtggagagtcagggtgatagcccttttcaccctgccctcttggtacccgggttcttgtccagcatccaggaagaaatcaggtcccatggccttgaaggatggtgaatgtggagatttgattgagcagtagaagtggctttcagtgggatggggagctggaaaggagatggagtgggaagatagtcttcccctggagtttggcc

SEQ ID NO: 164586 - DNA, 320 bp, Homo sapiens
aaatacgtaagaattgtttgcatccatttcctggcagtatttcctatttttaggagtgaggtgaatgatgttgtagagctggagataccagtgggctgactacaattttcaaagcaccttgagatgtaaaaaaatgtttctgtaggagggaaggggtacggttctgataaatctctcagcaggatgaaaaagaaaagggaggtctagacagtcttgtttcatctaatagaattttcccacagaagatgggcaaacatcagataagaacatttatcagacctcacacattttacagccatatccctttgggaacattgcgc

SEQ ID NO: 164587 - DNA, 566 bp, Homo sapiens
tacactgcacggcagtagtatcaaatgatctcccacaatattctgagcacctaggattcattttcccattaacagtaggaggtttaactggcattatactagctaattcatcattagacattattttacaagacatatattatggtgtggcccatttccactatgttctatcaataggagcggtatttgccatcacaggaggctttgtccactgattccccctattttcaggttatatacttaatcagacgtatgctaaaatccacttcatcattatatttataggtgttaatttaaccttttccccacagcacttcctcggcctgttggtgtgcgtcgacgttactctgattaacctgatacatacaccacatgaaatgttatctcatcagtaggctcatttatctcattaacagcagtcatattaataattttcataatctgagaagcctttgcttcaaaacgaaaagttctaacaattgaacaagcatctactaattaacagtgactttacagctgtccaccaccttaccacacattcgaagagccaatctatgtgaaaacct

SEQ ID NO: 164588 - DNA, 226 bp, Homo sapiens
aaggtacagcactgtacaaactgctgccgggcgttcttttgaggaagcaacgtcttctgccttgggtgcttgggaagattccacagaggaagtgacatttgagccagtttgtatgaatagttagagttgtggataggagttggaagaagggggacattttaagaagatgactagaaatgtaattgaatagtttagtgagtcttttatcctccttaaacctttaggt

SEQ ID NO: 164589 - DNA, 203 bp, Homo sapiens
tgtgaaagtccacttgggcaggcagggggagctacttgcaaatagcattaggaagcaagttccaaacagtaggtctaatgttactcttcaggtaactctcagcaagcaggagatttggagttggtttggcaactggatcaagatagacttggcaacctagtttatattacttcagcaaacacaggttgtataatgttttaaaa

SEQ ID NO: 164590 - DNA, 411 bp, Homo sapiens
acttaccacctccatagcatttgcattttaggccctggtgccaggcactttatattttatcttatttagtcacaacaaaatcataacagaattgtaggcgttactcactttgcttcatacatgagaaaactggggtccagaaagattaaataacttgctcaaattcatatagccagcaatggcatgactcaaaatcaggtctttcaagtgccaaagcccgtcctctttttcttctaaatcatactggtcataggaaactaaatagagtttttataacgtaggctttcacatattggagagcaaaaaagagaaacttgatatttgaagtgcccttttcagcagtatggattctgaaaccacaacataaaggcggccacctttctcatacacacataagaccaaccttcccac

SEQ ID NO: 164591 - DNA, 360 bp, Homo sapiens
tggttactgtagctttataataagtcttgacatcagatagtgtaaatcctctagttttgatctttttcacaatattgaatcttctggcccatgaacacaatattgttccatttccctgggacttaatttctttcagcgatgttttataattcttagtttatagctcctgcacatcttttgtcaaatttatcaccagttacttcgtatttattaaagttatcttaaataaccaggttttacaggctttgttattaatgctgtattagctcacatcaaaaaaagtaattgaagagcattttctctgtctttgtactctgtttgttgaagatttagaggaattaacgaatggagcttttgtac

SEQ ID NO: 164592 - DNA, 476 bp, Homo sapiens
ctcacacatttatacacatctgtacttatttatacaattatccatctgtacgtatactaaaaacaatgatttcatgaaacttttgatcccaatccaacactagataaagactatataggcccatttatttgcaaatcagcacataaacatagaagaattattaacaatataagctgtagcttatgctaaatgttggttggaacagacaataagttatggagaacttcagaggacactaaggttggatgggattttggaagttgtacaggtcaatgccactccatctattggctgagtttcactaggttaatacatgaacaacaacaaaaataacctagatcagaagttaaaggtcattttattgactatctgccgtgtctgtgccattgcagtgtactaggtgcacttacgagtcctctacttacaaactgcttttcacaaaatatgaaactccaggcaaaggttcagacatatga

SEQ ID NO: 164593 - DNA, 621 bp, Homo sapiens
aggatctccttcacttcagtttccaataacatcttcctcatttccttcaaagcactcacaagcagcagcacctttaatgttcacatttccaccaacagtctctttatgatgatttaggtattctctaagacgatacacattttctctactgtgctcctcacttccttctggggcatcaccagcagagcctttaacatctgtatttctaccatctgtacattcaagataatctaggttttctccattatgttcctcaaaattctaccagcttctgccaataccccaatttcaaagccactttcacctttttaggtatttgttacagcggcattccacttacaggcaaaatctatatgggctgtggtaagaaattactataaacttggtgtaaagcaacacaaatttattatctcatggccttagctcatggccccttcccttcatcttcaaagcacatcattccaacctctgctgcagtcattcatctcttctgccctgattggttttgcctccttcttacaaggactctctgattacactgggctcacctggacaatcctggctaatctcctcatttcaaaatctttaacttaatcacatatgcaaagtttgtggagccat

SEQ ID NO: 164594 - DNA, 259 bp, Homo sapiens
agctggggaagcagcaggtagcacacttgaaagcaggcacttcgcaggaggaaaaaaggtcaggctgagccagctgagcatgtgcggtttgccaactaagtgaatccatccctccacttgccctggggcgatgttagtaaaaggacatagagaggatagtaggatgcatagggaaaattcttcctcatccaaaccacgagtggggaaatggtgcttccctctgaggtgcctcaagattttacactttttgagggtcatg

SEQ ID NO: 164595 - DNA, 461 bp, Homo sapiens
agcctgaatcaaggttaactatacaaggaggttatttatgaagtcaaaacaattgaaacactaaagagagagttgggtgaataaacatatagagtatacctgagttaagtggaaattttaagaaataggccagattatctcatctatcttattgaattcaactaatctgtaatgccctgcaaatcgcaaaccatccaaaaagatgggtcactgtaactctcactgcacaaacaatgagcctgggtgacagagcaagactcttgtctcaaaaaaaaaaaaaaaaaaaggaaatgcagaaatcacctgtcttctgcattgcttacactgggagctgtaggctggagctgttcctagtcggccatcttagaacctcccctagtttagcttattataattagaaggtgccattttttaataaattttttgtttgctgtgtcagtttttattgggagcaaattacc

SEQ ID NO: 164596 - DNA, 248 bp, Homo sapiens
agctgggtgcagtggtgcgtgcctgtagtcccgtgcctgcggcatgggaatgggttgagcctgggaggcggaggttgcagtgagttgatgacttaggatttttcttctcggtcactttgcaagccggggacccctggccagtgatgccccacctgggccctgcttggccacactggcgtgccccaactcacctgtgttatagcttgtactgtgttcggccattcccgagctcatgtaccgcactcaag

SEQ ID NO: 164597 - DNA, 737 bp, Homo sapiens
  misc_feature (12)..(12): n is a, c, g, or t
  misc_feature (36)..(36): n is a, c, g, or t
  misc_feature (61)..(61): n is a, c, g, or t
  misc_feature (603)..(603): n is a, c, g, or t
ccagacagtatnggtctgacacggtgtgcagaccantattgccctggtattgctttgtgtncctggatttggagaatttctgggaacacaggaaaaggaaaggtaggtaggtgttgggggaggaaagtcaagggaagaaggtatgcaggatattattctccattgcttgaagtctcaagtttctatcccctgtcttagaagcaacttaggggagtcatggacaggttcagcttctatggagcactattagggggacatttcctctatacagcttgttccagagatcatcttatccattttcttgcttccaagtacacaaatcccctacagcccctgacccctatggaattttaccatgtcttataagatctacagggaaggaaatgcattatttaccccacctccttaaccaagaagcaaatcccccaatcaagactaaatgctgagctttttttttgaaatcttaccacatatttccctgctgcaatataataagccactggagaaacttatgccaacaaatgtgttaaggagtagtcttatacgtcttgtcccatggcaaagcctagaacagagatagaatttaaattcaaggccctgaanggctgaattagaaatgctcctgaattcatgtggtgccatggccttagagctcttagacccctctgactcttgtagtgttgatgtacactggagaaaggggcaagtttccagctgtacccatccccaaccccttg

SEQ ID NO: 164598 - DNA, 375 bp, Homo sapiens
  misc_feature (43)..(43): n is a, c, g, or t
gaggggaaatcatttgaatcctgtcctggtattgctttgtgtncctggatttggagaatttctgggaacacaggaaaaggaaaggtaggtaggtgttgggggaggaaagtcaagggaagaaggtatgcaggatattattctccattgcttgaagtctcaagtttctatcccctgtcttagaagcaacttaggggagtcatggacaggttcagcttctatggagcactattagggggacatttcctctatacagcttgttccagagatcatcttatccattttcttgcttccaagtacacaaatcccctacagcccctgcgagttgcacaggcctctgaagttggtctgggtcagagtgcgtgccgtttatcctcg

SEQ ID NO: 164599 - DNA, 309 bp, Homo sapiens
tagaatgcctctctgcaagtttgtttaatgtgaaagagaaacaagcatcattttgaataagccattgttctttgcagtctctgtagctggcaactaattttaactaatccacaactcatccaaagtgatggcacagagttcagaatcaggcctgtcagtctatgaagtttgttctcttaggtaaaaccttgaagaactcttgcttgtaatttgcaagagattttgaaaagagaaaagtttcaaaatgctgaaaaggaatttgacagaagaaaataaggaaagtttgaatatgctcttaaatctgctacc

SEQ ID NO: 164600 - DNA, 632 bp, Homo sapiens
atcaaacccaaaattagtaggaggaaaactataataaggatcacagcagaagtaaataaaattgagactaaaaaacaggagatcaaaaaatgaaaagctggttatgtttaaaagataaaaataatcaacagaccattaaccagactaactatgaaacaagaaaaaaggcacaagtaaataaaaccaaaaatgaaatagtagacatcacaactgatatcacacaaacacaaaatatcattagagactgctacaaataactataagctaacaaattagaaaaccaaccagaaaatatgtaaattattggacacataaaatttaccaagattgaacccaaaagaaacagaactcctgaattgagcaattgcaagtaatgagattgaatctctaataaaatatctcccatcaaagaaaaaacccagactccactgacttccttccagaattctacaaaatatttaagtagaactgataccagttcttctcagagtcttccaagaaattgaaaagaatggaattctttcaaactcactctgcaaaaccagtatatcctgatagaaaaaccagacaaggacacacgcatacagaaaaaaaaaaaaaactataggccaatatccataataaacatagat

SEQ ID NO: 164601 - DNA, 300 bp, Homo sapiens
tgtggaaatggcagtgtgtgactgctgaggccaggtcacaaaatatagtgtgactttctcttgctctttcttggatcattcattctggggaaatcagcttccatgttgtgaggatgttctggcagcctacggggaggtttatgtggtgagactgaagcctcctgcccataaccatgtgtgtgaaccatatggaaactgatcatccacccccagtcaagccttcagatgactgctgccccagccaactaagctgctaagctgtaagataataaatgtttaatgttttaagctacttagttt

SEQ ID NO: 164602 - DNA, 431 bp, Homo sapiens
ttctgaactgaaataatctgctacttaaggacaatgggccttatttaccgtgaggaactttgctgctgagatgaatatttttacaactaccctcataaacccctcccgctgtctgctgcccagggagggggcggagctcccagaggtgagctgaggtgcttgcactgtctcagaagccccattaagttgttaaggcatttagtagtccagacagtgccgactgcaagggcagttcaaatccccacacaaatggggatggggtcatgaaagagggggctttgatttcttgcctgggcagggcacagaatccaccttggtcaggggcagtggttggggaggaagtagtaaactacccagaatgggagactctcacccttaccccacctctttggccatgatctcccaaagcctcagtgtcatttagaggggaa

SEQ ID NO: 164603 - DNA, 337 bp, Homo sapiens
aagggaagatgtagagctgacagccaaatcaggatctcctgtgcagagagggtggggctgtgggtgtggaggaagacctttaccacttttcatgctctagggcacagagggattcaggagcttgcaagagctgcaggtgaaagtgacgtaaagtgtggctatgaactcaggcactctggggaccccggaaattgcccatagccccaaactggctctaccagacacagctgctctctttgcacaggtttagacttccttgccaaggaagatctaaagtgagtcatcactgttgattcaccgggcttatgtatttagctaattcaactaaaattaaaaa

SEQ ID NO: 164604 - DNA, 487 bp, Homo sapiens
ttccaggcagcagctatgaatccgttcccagagccaggctagacaatacaacacccatttcccagctgcttgcagctcttgcattagctgggaagcagctttaccttaagggaatttaccacccttagaatttttttttttttagaaaaatatacattttttctttccttttaaaaaagccttcaggctcttgctaacttcacaactggagccctatcagaaaaaggcaagttgtcaaatggcaaatatgaagtccgtgttgttgaatcgtgagcgccgggggagaatagagggggctgtggagctgtctcggggtcagagccctgcggagacgccagggctgggcgggcctgagacctccgcctgcagtcagcaaggcccccttggctgatggacctgagaatttctgtgttacttctttttatttctgcatgcttcacgtcacagaattttcgaaaagtggcaatagaaccaaatgataaaagca

SEQ ID NO: 164605 - DNA, 302 bp, Homo sapiens
aaaatattaattgccgctttgtaaaaatctaagcaaagggtaacaaaaagtcatgattaggttaggcacgcctggttttagtttcaaacatcaattatttgagattaaaagtattacttcaaccccacatgacagttttctgctgtaaaacttgagattctcaaacctgttttcttctaaatggcaaagcattcttctaagtcatcccttcaacctcctacatgtcaccataaaaatactataataattctggaaggaatggtaatatgaattataaaggcagaaatacttcaattaaatat

SEQ ID NO: 164606 - DNA, 182 bp, Homo sapiens
ttcacgtatctttcatctttatattattcatatctttaactgcaaaataaatgtttctttttttaaatttatgctgggtgtggtggttcatgcctgtaatctcaaaggaggctaaggcaagagatcacttaagtcaagagttggagaccagcctgggaagtatatgacactcagtatctacc

SEQ ID NO: 164607 - DNA, 477 bp, Homo sapiens
agatgtctctgttttagggacctacggtcattttcagtgcagccacgtttcccctggttgactcatctggttgtttatccagtttttaaatctgaaattcataccattttgagtcacaattgcactgtggacaatcacaattaaaatgcttaagtgaaaagcaaatactgtctttccagagagtgtctactgatgcgctgagtaagaagttgctattggttacttgttcactggaacatactttaagtgtggatgtgcattgtgttataattgcttgtggaaatggcctttctgttttcagatttttgtgtagccttctattgctgctgttgtaatagcactgtttttcttttcatataaaaagtgagttagaagcagataaaaagagaagcatttgattgccctcaatcaggcactggcttgcggttgtcattaaatcagaggcttatttgaaatccgttattggcagtaacccat

SEQ ID NO: 164608 - DNA, 1312 bp, Homo sapiens
aaaaaatggaattctggtctaataggcaagaagcatctgtctgatatatcagggagacttaagcatttgacaaacttctaaaggatttaaaagatgttttgaaattaaaatgtccacagcatggtggcttgtgcctgtaattccagcaacttgggagaccaaggtagaaggatcacttgaggcctggagtttgagaccagcctgggcaacatatcaagactctgcctctaaaaataaaaaaaataataataattagctgggcctgatggcatatacctgtagtcctagctactcaggaggatcacttgaacccagaagtttgagactacagtgagctacaatggggccattgcaccccagcctgggtaacaaagggagacccgcctctttataaattaattaattaattccagggcatagagttcactgtgtaaaccatttctagactgaattggtcattaaaagtagatctaaggattctttcattcaactacaagataacaaattaaatagactgaagaaaatgttctcaagtctctgctaaatgcaggtatattcagaggttgataagatacatgtcctgtcttccagaattcagttttaagcagtgtttttcaaacttatctttcattatcgctcccctaatgagctaattaaactttttttttttcaaatcgctccattaccacccactacccccgccaagaaattttaataccaaagataaactatgtatctgttgatgtactgcgtccctttgaaaggctgcaagtcattacaacagctaagatttcactccccccaagaatcaatgttcactcccctggaggcaacatggccccactgagaaatcctggtgtagagaaaatgttcgtagaacctgtcaggcctctgagcccaagctaagccatcgtatcccctgtgacctgcacgtatatgtccacatggcctgaagcaagtaaagaatcacaaaagaagtgaaaatggccggttcctgccttcactgatgacattccaccactgtggatttgttcctgccccaccttaactgagcaaataaacctggttaaattccttctcctggctcagaagctcccccactgagcaccttgtgggccgcccctgcccgtaagagaaaaaccccctttgattgtaattttccactacccacccaaatcctataaaacagccccaccctaggtcccttcgctgactctcttttcggactcagcccacctgcacccaggtgaaataaacagccttgttgctcacacaaagcctgtttggtggtctcttcacatggacgcgcgtg

SEQ ID NO: 164609 - DNA, 142 bp, Homo sapiens
gacgccaccaaatccacctgtccaggcttgacctctgccccgcccagcgccccctcgctctctggcccccgaggcgggaatctggctcctgggctgcggtcctctccacagcctccctgcccagtcgtaccttaggccctgg

SEQ ID NO: 164610 - DNA, 221 bp, Homo sapiens
attgagtgactacttatttaagtatctttgttttcttagctctttgcacatgaacttgggtacaaatcagaaatttgctgtaattctaaagtgacagattagagggatcaggttagaagggcacagggagggaatatctaggaattatgaatgtcatgaccccaaataatgttctaatgctaaattgttttcttaagtggatagaaatgaaaattttataa

SEQ ID NO: 164611 - DNA, 322 bp, Homo sapiens
cccagcccccgtccttgcacttctgttccctgtccctgagctgccgccaactcgtagcttcagtgttcccctgatccatcgtgccttctccacacacggttttacactccctccatatttgttagttgaaagtttccaagacagagacagtctgaatctctcagctcatccctttctcagggcatggcctgggctgctgctgcttagcctggatgaggcaccccctcctacctccatcggctatgactagagcccctcagagaccagttcatttggtgcaaaccctgcctgccctggccacatgagcaggaaccatgagtcc

SEQ ID NO: 164612 - DNA, 144 bp, Homo sapiens
atcctctccctttcccctacatccctctggtctcccttcctctggggtttcacactcaatccattctccaccctgcagctgggatgattctcctaaaatgctaatcccagtttgtcagtgttctacttagaaggtccagcagtg

SEQ ID NO: 164613 - DNA, 305 bp, Homo sapiens
gtgcaggttgcactgggggggcctggttgagatcatgactggagtccctggcccccagagtgggagtcatcagtggggctcgctacctctgcacaatttttttttttctttgagacggagtcttgctctgtcgccaggtggtacagtggtacgatcttggctcactgcaacctccgcctcctgggttcaagcaattctcctgcctcagcctctcgagtagctgggactacaggtgtgcaccaccgtgtccagctaatttttgtatttgtagtagagacggggtttcaccatgttggccaggatgg

SEQ ID NO: 164614 - DNA, 117 bp, Homo sapiens
ctgagagaggaacggacggggagggagcaatggttggcagagagagatgaatgcgcttagcgtgcctgtgtgtgaggccagtgagtgggtcacctgagaacaggaccgggctgtgca

SEQ ID NO: 164615 - DNA, 281 bp, Homo sapiens
tgctgggattacaggtgtgaaccactgcgcctggcctaataatttttatattgatagagaatttgggctctgaaggccttcagatatctacttggtatatatgatagctgctttgccaggatccttaagtagctgaacattgtgtaattagcaatgctttataaggattgagccctttattttaatctttgaagttttagctaaaggcagaacctacaccagaggcccctagaacattgtccttaagttccattcattgtaacatttattttttgagaaag

SEQ ID NO: 164616 - DNA, 506 bp, Homo sapiens
atttcccgacggctgctggcaaggagcacctgccacgccctgattggctgtctgcatcctcttcagggaagagcccccccacgtcttgcccattctcacatcggcttgttttttcatggttgagttttaagagttctctatacagtctggaccccagggctctagtcgggcgtgtgtgtttgtgaatattttccccgctctgcagtttctctttccatcctcatcaaagagcctttcccagagcgcacgcttttcacctgagatggggaggccaccctggatgaccaggtatccttacatgagcgagacggtggggggggggcagggtttgcccccaaagacgaagagaccacatgaggataaaggcagacatgggagcgatgtggccacaagcccaggaatacctggagtgcccaggagctgggagaggctggaagggcccagagcctctggaaggagtatggctagagggacccagagcccccagagggagtacggctggaagg

SEQ ID NO: 164617 - DNA, 527 bp, Homo sapiens
ggtggtgcttggtgctgtaactgaaggagggtaaaggggagagaagcactttgaaaagtctagccttgtagaggcttgcatctcctcgcctgttcttgccaagagctgaaagccatgcctcacttgaaaggtctaaaactgtagtcttcctgttttttacattatttcattttcccatgagttggctaaaagtcaatcctttaccaaacagctgccgatgtgtgagacatacaactgtgttacaaagtctactgaaccttgtaagaagccagaacatagccaaaattgcatggtccattgctaaaaaagtaatagatgagggatcatcaaacaattcatgaaaattcatattatgaaaaacttaagcatggatttcaaatttctttgtgccaaacaaacttttactaacttgttaaaacatgtctgaataggatctagtttgaggcactaagaaggataggacatcagttggaaaaaagcccccatcaaaacaacatgaattctgcagcaattgaagcaatagcata

SEQ ID NO: 164618 - DNA, 498 bp, Homo sapiens
ggatatataagttatttgttgcagcataacaaatgatccccgcaaattttgtggcttcaaacacgaaatgtttattctctaacaatttctacagatcaggaattcaagaacagcttatctctgtagttacactgcaggatctctcatgcctttacttacaatcaagatgtcagccaaagctatagtcatctaacatctttactgatgaacagtccacttccaagatgacttattcacacgcccggcctgggagggatttttttaagctgagagaattaacagcataaccgtattttcagaaacactgaagagatttcttcaggcttcaggaaaatgattccatagagacatacataattccaggaattaagatcaacaggaaacataagatgcaagtaaatataaatcagtactgactgtataaaacaaccctgtatagttttacaacttttatgtatatctaaactttccaaaataaaatgcttttaaaaacacatt

SEQ ID NO: 164619 - DNA, 2155 bp, Homo sapiens
ttttgtaccttgatttttttttcacttaaatttattggagataatctctctgaatacctagaaatcttttcaggggttctttgttttggttttggtttggggtttttttttcctggctacatgtttctttgttatttattaagttgctgcaaaagtaattgcaggttttgccatcgaaagtaatggcaaaaaccgcaatcacttttgcaccaaccttaaagctatcacatagtttattcacccaatcccctactgatggtcacttgtggtgttttcaatcctctgcgattatatgaagtgccacagcgaatcatcttacacgtgtctttcagtatttgtgtacctttgagatagatttctagaagtgggttctaggaaagaacaaatgttttttgcagctttgcttgacatcagcacgtttccttccctaggggttacccccagcagtgtgtgagaatgaagagtgtgggccactgtgtctctgttgacctgccagataggaaatagcgccagagttgctgcaatccacgtctccctggaattcaggagcagcttggctggaaggctctggctggaaacttgcagaaggctgtcagctgggtctgcatcatctgaaggctcaacgggtaccgggggccactccatggcctgcgagtcagagctggccgtcggtgggaggcctcagttcctctccacataggcctctccacagggccacttgagcatcttcccaccatggcaactggtgtcctctagagcaacatccaggagaccaaggcggaagcagctgtagtgccttctaggacctggtcctgaaagtcacccctgcacccacccccgctgtctcctcagccatattctgctggtcacacagagcgctgcgggataaaggaggagcgtcctgcttcccggctgccctgttgctgtcggagtcacaggatggcggctgtcatcctgccctcgactgctgctccgtcttccctgttcccagcctctcagcaaaaaggacacacacagggcggagagctggttaatgagctcctgacaagctggctacggggcttggtaaccttcgaggatgtggccgtggagttcacccaggaggagtgggcgttgctggaccctgcccaaaggacactgtacagggatgtgatgctggagaactgcaggaacctggcctcactagggtgtcgtgttaataaacccagtctgatatcccagttggaacaagacaagaaggtggtgacagaggaaagaggaattctaccaagcacctgtccagatttggagactctacttaaagccaaatggttaactcctaagaagaatgttttcagaaaagaacagtctaaaggtgtaaaaacggaaagaagtcatcgtggagtgaaactcaatgaatgtaatcagtgttttaaagtcttcagcacgaaatctaacctaactcagcacaagagaattcatactggagaaaaaccctatgactgtagtcaatgtgggaagtccttcagtagcagatcttaccttactattcataagagaatccataatggggagaaaccctatgaatgcaatcactgtgggaaagcatttagtgatccctcatcccttagactgcatttgagaattcacactggagaaaaaccctatgaatgtaaccagtgttttcacgttttccgcaccagttgtaacctcaaaagccacaagaggattcacacgggggagaatcaccatgaatgtaatcagtgtggaaaagctttcagcacaaggtcctctctcactgggcacaatagcattcatacaggggagaaaccttatgaatgtcacgattgtgggaaaaccttcaggaagagctcctatctgacacagcacgtaagaactcatactggagaaaaaccctatgaatgtaacgagtgtgggaaatccttcagcagtagcttttctcttactgtgcacaagagaatacataccggagagaaaccctacgagtgcagtgactgtggaaaagcctttaataatctctcagctgtgaagaaacacttaagaactcacactggagaaaaaccctatgaatgtaatcattgtgggaaatccttcacaagtaactcctatctttctgtgcacaagagaatacataatagatggatatgaattactg

SEQ ID NO: 164620 - DNA, 2164 bp, Homo sapiens
cgcggggcggtaccgtgggaggggccgcgcgtggggcagcggggagcgagtccctccgtccccgcgagtcggcgcttttggccccgcgggaggggccgggctcggtgagcgactggcgggggctcgggtccgagtccagggggcgacgtgggccgcggacaccgccagccacgggccctgcgtccctccagggagccgtgtttcggttcatgaggcctcgggctgtgagcttagatgagaaaagcatcattcaagctcagattcgtattgaagcctgccacaaggtccacctgttgttgtgggtttttgggtgaccagaccaagtctcactctgttggccaggttggagtgcagtggcgcgatcttggctcatgtcaacctccacctcccagactcaagcaaatctcctgcctcagtttcctgagtagctgggactacaggggttacccccagcagtgtgtgagaatgaagagtgtgggccactgtgtctctgttgacctgccagataggaaatagcgccagagttgctgcaatccacgtctccctggaattcaggagcagcttggctggaaggctctggctggaaacttgcagaaggctgtcagctgggtctgcatcatctgaaggctcaacgggtaccgggggccactccatggcctgcgagtcagagctggccgtcggtgggaggcctcagttcctctccacataggcctctccacagggccacttgagcatcttcccaccatggcaactggtgtcctctagagcaacatccaggagaccaaggcggaagcagctgtagtgccttctaggacctggtcctgaaagtcacccctgcacccacccccgctgtctcctcagccatattctgctggtcacacagagcgctgcgggataaaggaggagcgtcctgcttcccggctgccctgttgctgtcggagtcacaggatggcggctgtcatcctgccctcgactgctgctccgtcttccctgttcccagcctctcagcaaaaaggacacacacagggcggagagctggttaatgagctcctgacaagctggctacggggcttggtaaccttcgaggatgtggccgtggagttcacccaggaggagtgggcgttgctggaccctgcccaaaggacactgtacagggatgtgatgctggagaactgcaggaacctggcctcactagggtgtcgtgttaataaacccagtctgatatcccagttggaacaagacaagaaggtggtgacagaggaaagaggaattctaccaagcacctgtccagatttggagactctacttaaagccaaatggttaactcctaagaagaatgttttcagaaaagaacagtctaaaggtgtaaaaacggaaagaagtcatcgtggagtgaaactcaatgaatgtaatcagtgttttaaagtcttcagcacgaaatctaacctaactcagcacaagagaattcatactggagaaaaaccctatgactgtagtcaatgtgggaagtccttcagtagcagatcttaccttactattcataagagaatccataatggggagaaaccctatgaatgcaatcactgtgggaaagcatttagtgatccctcatcccttagactgcatttgagaattcacactggagaaaaaccctatgaatgtaaccagtgttttcacgttttccgcaccagttgtaacctcaaaagccacaagaggattcacacgggggagaatcaccatgaatgtaatcagtgtggaaaagctttcagcacaaggtcctctctcactgggcacaatagcattcatacaggggagaaaccttatgaatgtcacgattgtgggaaaaccttcaggaagagctcctatctgacacagcacgtaagaactcatactggagaaaaaccctatgaatgtaacgagtgtgggaaatccttcagcagtagcttttctcttactgtgcacaagagaatacataccggagagaaaccctacgagtgcagtgactgtggaaaagcctttaataatctctcagctgtgaagaaacacttaagaactcacactggagaaaaaccctatgaatgtaatcattgtgggaaatccttcacaagtaactcctatctttctgtgcacaagagaatacataatagatggatatgaattactg

SEQ ID NO: 164621 - DNA, 1352 bp, Homo sapiens
tcattcacttaccaagtatttctctgctttctgccatgtcacgggcccatgatcccctggagattgagggaaataagatcacaggagctcccagtctgagtgagaaaaggcagctgctctgtggtactgtgcactggacctgggaatggcctaaggagacaagcattgagggctgagctcagaagccagggagaagagctcagaaccccaggagaggagctcagaaccctgggagaggagctcagaaccctgggagggcttggtaaccttcgaggatgtggccgtggagttcacccaggaggagtgggcgttgctggaccctgcccaaaggacactgtacagggatgtgatgctggagaactgcaggaacctggcctcactagggtgtcgtgttaataaacccagtctgatatcccagttggaacaagacaagaaggtggtgacagaggaaagaggaattctaccaagcacctgtccagatttggagactctacttaaagccaaatggttaactcctaagaagaatgttttcagaaaagaacagtctaaaggtgtaaaaacggaaagaagtcatcgtggagtgaaactcaatgaatgtaatcagtgttttaaagtcttcagcacgaaatctaacctaactcagcacaagagaattcatactggagaaaaaccctatgactgtagtcaatgtgggaagtccttcagtagcagatcttaccttactattcataagagaatccataatggggagaaaccctatgaatgcaatcactgtgggaaagcatttagtgatccctcatcccttagactgcatttgagaattcacactggagaaaaaccctatgaatgtaaccagtgttttcacgttttccgcaccagttgtaacctcaaaagccacaagaggattcacacgggggagaatcaccatgaatgtaatcagtgtggaaaagctttcagcacaaggtcctctctcactgggcacaatagcattcatacaggggagaaaccttatgaatgtcacgattgtgggaaaaccttcaggaagagctcctatctgacacagcacgtaagaactcatactggagaaaaaccctatgaatgtaacgagtgtgggaaatccttcagcagtagcttttctcttactgtgcacaagagaatacataccggagagaaaccctacgagtgcagtgactgtggaaaagcctttaataatctctcagctgtgaagaaacacttaagaactcacactggagaaaaaccctatgaatgtaatcattgtgggaaatccttcacaagtaactcctatctttctgtgcacaagagaatacataatagatggatatgaattactg

SEQ ID NO: 164622 - DNA, 758 bp, Homo sapiens
gcacgtaagaactcatactggagaaaaaccctatgaatgtaacgagtgtgggaaatccttcagcagtagcttttctcttactgtgcacaagagaatacataccggagagaaaccctacgagtgcagtgactgtggaaaagcctttaataatctctcagctgtgaagaaacacttaagaactcacactggagaaaaaccctatgaatgtaatcattgtgggaaatccttcacaagtaactcctatctttctgtgcacaagagaatacataatagatggatatgaattactgcaggaacttctggaggaaagcactcattgatcttcatccctaagatagtttgagagagctcacactggatatataagttatttgttgcagcataacaaatgatccccgcaaattttgtggcttcaaacacgaaatgtttattctctaacaatttctacagatcaggaattcaagaacagcttatctctgtagttacactgcaggatctctcatgcctttacttacaatcaagatgtcagccaaagctatagtcatctaacatctttactgatgaacagtccacttccaagatgacttattcacatgcctggaaagttgatgttggttgttgtcaggggaccttcagtcattaccatgtaggcctctttacaaggcccagctccttgacaatttggcaataagttctcgccaaggttagtgatccaagagaggaccaatacagaggccaaaatggcttttatggcctat

SEQ ID NO: 164623 - DNA, 740 bp, Homo sapiens
ttaaagctatcacatagtttattcacccaatcccctactgatggtcacttgtggtgttttcaatcctctgcgattatatgaagtgccacagcgaatcatcttacacgtgtctttcagtatttgtgtacctttgagatagatttctagaagtgggttctaggaaagaacaaatgttttttgcagctttgcttgacatcagcacgtttccttccctaggggttacccccagcagtgtgtgagaatgaagagtgtgggccactgtgtctctgttgacctgccagataggaaatagcgccagagttgctgcaatccacgtctccctggtgagtaaggtcattgtcgattccatcaagggtattgtccttgggatgatagcagggaagccagattgcaccgtgtgaggactcaggaaaggggacagagtgaagagctgtggctgggatgggggatacagacggggcagtaaccggaaagaaagctgtaccccaaggatgggctcatcgcactacagaagatgccacatcaggcttgaggggcatgaggaagggtctagcagcacgggagagctagaagggaaagggcggaggagagagcttcgagcacagacagctcctcaaaagcaggagggtggaccccaggccagaactgcccagcaagccctgcggagaaggcaggcagctccttgtctgcgatgggaggaggcagaagggtggggcacaggttgcagtgctggcagcaac

SEQ ID NO: 164624 - DNA, 1912 bp, Homo sapiens
cgcggggcggtaccgtgggaggggccgcgcgtggggcagcggggagcgagtccctccgtccccgcgagtcggcgcttttggccccgcgggaggggccgggctcgatgagaaaagcatcattcaagctcagattcgtattgaagcctgccacaaggtccacctgttgttgtgggtttttgggtgaccaggggttacccccagcagtgtgtgagaatgaagagtgtgggccactgtgtctctgttgacctgccagataggaaatagcgccagagttgctgcaatccacgtctccctggaattcaggagcagcttggctggaaggctctggctggaaacttgcagaaggctgtcagctgggtctgcatcatctgaaggctcaacgggtaccgggggccactccatggcctgcgagtcagagctggccgtcggtgggaggcctcagttcctctccacataggcctctccacagggccacttgagcatcttcccaccatggcaactggtgtcctctagagcaacatccaggagaccaaggcggaagcagctgtagtgccttctaggacctggtcctgaaagtcacccctgcacccacccccgctgtctcctcagccatattctgctggtcacacagagcgctgcgggataaaggaggagcgtcctgcttcccggctgccctgttgctgtcggagtcacaggatggcggctgtcatcctgccctcgactgctgctccgtcttccctgttcccagcctctcagcaaaaaggacacacacagggcggagagctggttaatgagctcctgacaagctggctacggggcttggtaaccttcgaggatgtggccgtggagttcacccaggaggagtgggcgttgctggaccctgcccaaaggacactgtacagggatgtgatgctggagaactgcaggaacctggcctcactagggtgtcgtgttaataaacccagtctgatatcccagttggaacaagacaagaaggtggtgacagaggaaagaggaattctaccaagcacctgtccagatttggagactctacttaaagccaaatggttaactcctaagaagaatgttttcagaaaagaacagtctaaaggtgtaaaaacggaaagaagtcatcgtggagtgaaactcaatgaatgtaatcagtgttttaaagtcttcagcacgaaatctaacctaactcagcacaagagaattcatactggagaaaaaccctatgactgtagtcaatgtgggaagtccttcagtagcagatcttaccttactattcataagagaatccataatggggagaaaccctatgaatgcaatcactgtgggaaagcatttagtgatccctcatcccttagactgcatttgagaattcacactggagaaaaaccctatgaatgtaaccagtgttttcacgttttccgcaccagttgtaacctcaaaagccacaagaggattcacacgggggagaatcaccatgaatgtaatcagtgtggaaaagctttcagcacaaggtcctctctcactgggcacaatagcattcatacaggggagaaaccttatgaatgtcacgattgtgggaaaaccttcaggaagagctcctatctgacacagcacgtaagaactcatactggagaaaaaccctatgaatgtaacgagtgtgggaaatccttcagcagtagcttttctcttactgtgcacaagagaatacataccggagagaaaccctacgagtgcagtgactgtggaaaagcctttaataatctctcagctgtgaagaaacacttaagaactcacactggagaaaaaccctatgaatgtaatcattgtgggaaatccttcacaagtaactcctatctttctgtgcacaagagaatacataatagatggatatgaattactg

SEQ ID NO: 164625 - DNA, 2042 bp, Homo sapiens
cgcggggcggtaccgtgggaggggccgcgcgtggggcagcggggagcgagtccctccgtccccgcgagtcggcgcttttggccccgcgggaggggccgggctcggtgagcgactggcgggggctcgggtccgagtccagggggcgacgtgggccgcggacaccgccagccacgggccctgcgtccctccagggagccgtgtttcggttcatgaggcctcgggctgtgagcttagatgagaaaagcatcattcaagctcagattcgtattgaagcctgccacaaggtccacctgttgttgtgggtttttgggtgaccaggggttacccccagcagtgtgtgagaatgaagagtgtgggccactgtgtctctgttgacctgccagataggaaatagcgccagagttgctgcaatccacgtctccctggaattcaggagcagcttggctggaaggctctggctggaaacttgcagaaggctgtcagctgggtctgcatcatctgaaggctcaacgggtaccgggggccactccatggcctgcgagtcagagctggccgtcggtgggaggcctcagttcctctccacataggcctctccacagggccacttgagcatcttcccaccatggcaactggtgtcctctagagcaacatccaggagaccaaggcggaagcagctgtagtgccttctaggacctggtcctgaaagtcacccctgcacccacccccgctgtctcctcagccatattctgctggtcacacagagcgctgcgggataaaggaggagcgtcctgcttcccggctgccctgttgctgtcggagtcacaggatggcggctgtcatcctgccctcgactgctgctccgtcttccctgttcccagcctctcagcaaaaaggacacacacagggcggagagctggttaatgagctcctgacaagctggctacggggcttggtaaccttcgaggatgtggccgtggagttcacccaggaggagtgggcgttgctggaccctgcccaaaggacactgtacagggatgtgatgctggagaactgcaggaacctggcctcactagggtgtcgtgttaataaacccagtctgatatcccagttggaacaagacaagaaggtggtgacagaggaaagaggaattctaccaagcacctgtccagatttggagactctacttaaagccaaatggttaactcctaagaagaatgttttcagaaaagaacagtctaaaggtgtaaaaacggaaagaagtcatcgtggagtgaaactcaatgaatgtaatcagtgttttaaagtcttcagcacgaaatctaacctaactcagcacaagagaattcatactggagaaaaaccctatgactgtagtcaatgtgggaagtccttcagtagcagatcttaccttactattcataagagaatccataatggggagaaaccctatgaatgcaatcactgtgggaaagcatttagtgatccctcatcccttagactgcatttgagaattcacactggagaaaaaccctatgaatgtaaccagtgttttcacgttttccgcaccagttgtaacctcaaaagccacaagaggattcacacgggggagaatcaccatgaatgtaatcagtgtggaaaagctttcagcacaaggtcctctctcactgggcacaatagcattcatacaggggagaaaccttatgaatgtcacgattgtgggaaaaccttcaggaagagctcctatctgacacagcacgtaagaactcatactggagaaaaaccctatgaatgtaacgagtgtgggaaatccttcagcagtagcttttctcttactgtgcacaagagaatacataccggagagaaaccctacgagtgcagtgactgtggaaaagcctttaataatctctcagctgtgaagaaacacttaagaactcacactggagaaaaaccctatgaatgtaatcattgtgggaaatccttcacaagtaactcctatctttctgtgcacaagagaatacataatagatggatatgaattactg

SEQ ID NO: 164626 - DNA, 775 bp, Homo sapiens
gcactaatgagagcacttaagttacatcaaggctgttgattagacagctcatctatcaactgaagcatgagaatttgtgtttggggtaccttttatacattttaaatgtatatgcatctccattactttataccttttcccgagtgctttaattggtctctggcatgacagtggttgctgtgcagtagaagtgtaactgaaagagagttatgtattatttgtgtcattaaagtttgtatttgaaaatcagtaaattttaaatttctgctttggcatgaaaattcaggcacttattttcataatattaaaaatttagtgtacataaaatattcttttataagatacatttgattcttttctattttaataggaactatcatttcccagcatttttaaaggatacaatctcctaattaaatttaaatgatataatatcctaattaaacagttattataaaaagtatagtgtgctccctaacttttgacatttcaaatttttaaaagaaatttaaaacatcaccactagcctgcactaggagcagcctgtaataacagtttttaaaagctttctgaactatttgacaagatttcttagtgctgaggccatatgctgtagcctttaagctatttcttcctatcagtttcattatcacctgcctctgagtctccaatatcatcagtaagcacatgcagaatcataattatgccatgtacaagttctttgataacatgtacagttttcttcttaattctttatcaaatgcattgatcgtgg

SEQ ID NO: 164627 - DNA, 104 bp, Homo sapiens
aaaaaaaaaattttgcccatctaataataggttaaaaattagatacagtcaaccacactgggtcttactatgtaaaaaaaaaaaagagtgcttttagacagtga

SEQ ID NO: 164628 - DNA, 492 bp, Homo sapiens
attgcataagctccttctctccaaatttctgtctcctttataattaacttaagggagttgtagtgaggcttatattaaagtacagttcatagtgagcaaaatgtttagtctggtgcctagtgtttagtctgtgttctattcatgcttcctgtcattgctctctttcacctaggaaacatatattgttttaagaaaaggaggaacaaaggaatatctccctatgagtgtgttgaatcagagataaaaaatggaaatggctgttagagttggggctcgattgatttaatggacagaagtttatcaacaaaggcgtcagaagagggacatcatgagactggcagaggagaaggaagatatgtgtggggggtaaaggtacaaaaacacatgagctgtgcttgcaggggcattgctgcaggacaccatgaaacctttcacgatttgggtgcagtgtggcttaatgaaaatgggagctcagtctggcggagatttgtt

SEQ ID NO: 164629 - DNA, 176 bp, Homo sapiens
ctccctttgcgcagccctaccttaaggaaagttggacttgagaaagatctaagcagctggtcttttctcctactcttgggtgaaggtgcatctttccctgccctcccctgtccccctctcgccgcccgcccgccaccaccactctcactccacccagagtagagccaggtgcttag

SEQ ID NO: 164630 - DNA, 894 bp, Homo sapiens
gccttttgatcccattagtcacagcaggcattacatctgggaaaagcctgtgggtttaacttcacattttatttatattcttggaaaaccaaagcgaacctttaaggtttccagagaggccttttattttagcagtgcagcaagtttttcctttgtaaagcatcactgtggtacgaatgatgctctgtagcaatagaggaggagtcctgtggtatgtagaaccaaggaaagcagacttcttgcaggaaaaatgagtgcattgaggatagtaacctgactttctgacctgtgattaaattatgatagtagtcagtcattttactctcccagggtttgaggaagtggccggtgaggacttggagcctagtgaggagttagtagagctgcccagggtggaggaggccacagaggacagccctggtgaagagaacagtgaggccttggatgtgttgatatccagcaaggacctggcactgtctagtgaggacgaggcctgcacaggatgtaactggggcctgggcgagcccttcagcgaggagctggggctcatatccagcgaggacggggccagccctggggacgtagaggagctcggcgaggagtgcgaggagccgctgagtgaggaggagcacagcgggccagagctggggcgctgccggcaccaccataaagtgtcaaggagctgcccgagtgggactgacttaaaacagtgtatctagaataaaatggtttcctctagtgccttgatactgtccttggtcagacgacctcagctgccttggagatagaactgaagaagcaagagagggaggtggcagccctgaagcacaggccgggcgtctcgtaggctctttccctagaagccagagcacagaccctgaagacagccttgag

SEQ ID NO: 164631 - DNA, 689 bp, Homo sapiens
gcagatatcaggcaagtactgctctgcatataaggaaggaaatgaccttcaaagcatctgcaccagccagacacaaggccagggtaactggcctgcctactggaagcagcagggcgtgacaggtatcaggaatctttggttttggtcttagctctgctaataattctcaatgtgacttgaccaattggtctttttatttttctggcctggtttcctcatttatatagtaagattaaaggtttccaacaggactcaaaagataattattaggaccaatgctaacagatcactttctgtacatgtaaactaaagcatgtttcttttacatatgattagagttctgcccattgaatatgataatcataaaacagcaatccgcccaagccaaaaattggtcatcctcaacacctcttccatctaatgagaaactgagtactaccccttctgtgtccctctactatatccactgtcacactttccccagcctttgtcatctcttagctaaactattctaacagcttcctagcttatctccctttctgtggtctcttccacactgctaccaaagtgaactttctagcacacacaaattggcccactcttctttaggggaagcagtttcctaagtaatgagaggtttcattgtcttccacatgctcaacatttactctttgacctcagtccaattc

SEQ ID NO: 164632 - DNA, 378 bp, Homo sapiens
ggaaacaaacccctgatgagttggccgatcgctgtgctgtaaatcctccccatatggctgattttaagccacccatggcctaacaagagtgtcataatgggagctggtacgtgccagctttagtccccaggcattcagcgggtgcttaatagatgatggttgaatgaggaggaaaggatgcagagagtgttggtcagctagatttgggagctgcgggcgatactgtaggtgagaagggctttcagggggaggcatgggagggctggaggtgaggggccaccctgcaccagccctggggtgaggcttgagggaacggagagcttctggtgtcctccccgtcctgagaccctttgcacccctgaccctgacgcacacttg

SEQ ID NO: 164633 - DNA, 426 bp, Homo sapiens
aagatgacaaagaaaagaaggaacaatggtcgtgccaaaaagggccgcggccacgtgcagcctattcgctgcactaactgtgcccgatgcgtgcccaaggacaaggccattaagaaattcgtcattcgaaacatagtggaggccgcagcagtcagggacatttctgaagtgagcgtcttcgatgcctatgtgcttcccaagctgtatgtgaagctacattactgtgtgagttgtgcaattcacagcaaagtagtcaggaatcgatctcgtgaagcccgcaaggaccgaacacccccaccccgatttagacctgcgggtgctgccccacgtcccccaccaaagcccatgtgaggagctgagttcttaaagactgaagacaggctgttctctggagaaaaataaaatggaaattgtacttaaaaaaaa

SEQ ID NO: 164634 - DNA, 465 bp, Homo sapiens
ggggttggagtgcagataggactgatctctgtgatttcatggtccacaccaaatcagtcttcttagactcagagctattgttattgtttctgtctaatacatagtgagcttttattgtatgccaagtaatccacagagcactcctttatgtttttctagctcttaaagagcatctgtacaagtcttttggcatagataataggctctactggaaccagcttaagaaaaaacgacaaaagtagttaggggaccagggtgtatgactcagaatctgaggatgggcgtgcacgtaaaccttagccagggattggaactgggagattgaaatcattcaggacgtacaggaccttctacttttctctgcttcttggggtatgtctatttcattctgtagactgtcctgatactcagaccacttgatagaaggatcatgtcacacagctccatcattcaagagaacagccc

SEQ ID NO: 164635 - DNA, 520 bp, Homo sapiens
gcggtagtcagaaactaggaagcattgacaagcagtccctagacaaagttgtgaaataagccaagtttattattagtgactctggttgacagtttagctattggtggatgatagcctaaagcagtggttattagccaagaaatgcacatcggcatctcccataaggcttaaaaaaataatgtgccaagtgcccatccccagaggaaaggaattcagtagatttgagataggccttggtcatttcattttttttttaaagttcttcaggtgaatcttatacataattctgattaggaaccacatgcttaatgtataagaataatgtatgtacctggcatctagtagtactcagtaaataacttaaaaaattcacaaaactttagagttaactgcatttttaagtagaactcctaaaataaatctgcacactagaggaaaaaaaaaaaaccctgggtgatcaccaatatatttaacaatggatttgtatcatatgcatatttatgaattcaactatgttttg

SEQ ID NO: 164636 - DNA, 433 bp, Homo sapiens
ctgtgaaggtgtgcattacttaggctcttacaagtcataagggaaaaagtgctgtcatgggtgatgggtgcttattataatcatatgtgggaactgaggaagcataatgaaccttctaggcagctgcaaagtacctctgagtctcagaggttcccaatctgaaatgtttatcaagtaactggagaagttggagatgacacattgtcattcatgaaacaaggacaagtttacttgccatattttcttaacttccacatgaaaacatttttactatcttttatgtatatgcatatgttctccaaagataaaattttaatgtactagttagtatccaatgtggagatactcagtattgtctctcatcatactataattatgtaaatgccatccatatctattggatgccacaaactccacattaaactggcaaaga

SEQ ID NO: 164637 - DNA, 468 bp, Homo sapiens
taattaaactatcccattacacgttcttgaatatctgtggggtagctctgtgagatagctcattggatactgcattgctgccttgcgaagcttgggctttgaagattgccattctgcccacggatgtgtacccaatttccattccctttcatggtgacaaatgcaaagagcacattggtcaggccagttctcaagtgtcagtctctcgattgcaagcacgggagccaggctgagcttgagagggagtgctgctcgcccaaggtcttcaggaaatctcatcaaatgtttggaattttcattggttgtctttccacactgttagaatcctagatccctgaaatgtggtgtgggggtacaaaagcaagcccagctttgaaatctcagctgcttttcttgttaaacaattatttgaaaattctttttcatagcgagctaaatatactcctttctaccactgcaaagccctaa

SEQ ID NO: 164638 - DNA, 549 bp, Homo sapiens
attactcttaggttcaataactgacttttcagtgccacctgttttactaatattttctcttttctagtttaggcatcactcttttaagatgcctcacctcagacctctaaaacaactgaccggttcaactagttttatagtaacaatgccaataagaaccattgagactatttctttaaccctgcctcaccccatctaggatgcttattattgcttctgagttgttgaatgttgagtgaagaatgacattcatttgtcttgaacaaaaggaaaagactgacaatgttggagtttatctgagctctgtgttcccagaaaagagccataagaagaaaagccgcaaaggaccaccctgttccaccatatttgaagttaacgcccacctccatccttcttcgtatcatctgtcctataacacccataggattccagggtgaacaccttatgtatctgcctccataaaacacaagcttccttccttttctttgagactatcctcattaatggatgctcttcatgttgtagtaggctaaataaaataatttcctc

SEQ ID NO: 164639 - DNA, 405 bp, Homo sapiens
agagcattcacaaagatcctcatgaatcttcagtggtcctcagagctctattctttcttgattcacttgatgttttctgatgatgtaaaaaaaatcctttcttgagaagcagaaagctgtctctgttatattgccaatggtccaggacaggaccagagggccaagagccaaaagggtaccccaaataatttatcctttaggaatgcagttttggcaagcagtgtgtctgaatgtgcccttatgctattttgcttctagggtcaatagaagtatataaagtgaactttcttcaaaacatgtgccatgaaattgacttaataggaaaaaggaataacaacagtagcaagtaagttacaaagcaaaattaggctgggacacatctgttaaaggggcagttgatataaa

SEQ ID NO: 164640 - DNA, 182 bp, Homo sapiens
ttgaccttaaggattctttatatgttgagtgaaaagtaataaaataggtgtcaataacatgagtatggggaaaaaaactcaaacattgaattcattaacagtcattaagttttatttatttttctttttatttatttatttttaaatagagatggggcaacacagcaagaccttgtttctac

SEQ ID NO: 164641 - DNA, 585 bp, Homo sapiens
tataaatcccagaacagtacaaaattcaaagaaatttagaaatggaatttagaggttgccttttccaggtaacctaatttaaagacgtgaagactgagctccaaagtcattaaggtcaagaccacatttcagttcctatgacttccccactacaatcctctcctcttaccacctacagagatgcaagtgtcaataccaaaatataattaagagataaattctttctggtaacctgccatttttaacaccaaccaacatttgtccaggagaggaataatttaagagttatatatatttcacttcacaatggaagcagaaacaactgaaattctttaggtctcccttcttgcagtgagaactttccagaacacaggattaggaatagtcaaagggctgacatgtcttttattggcattcctatctttccacttcccatgtgaacaaaatccaccccgataaccctgtaacctcctttacatacaatttgatcaataaccacctttcttcatctgagaaagaaatgacaatgaaaaactatagccaccaacacgaatcactttcctacttcagactcctatcttttcc

SEQ ID NO: 164642 - DNA, 455 bp, Homo sapiens
cacatctgagattccaggtaaacatgaattttggagggtggggcactcttccaccctctatatcctctccattgccttttctgtgaaatgagggcctggacctgcgggatgggagcaggtcctctatagcaaggggtttcgggtgctgataagattgagaaatgctgctttgaacaaaatcggcctgatttctttatcactggcccttgctgagactttatttcataaagaagtactgcgaatcttcaagaggaagatactgctctgttttttcagggcttatttgattatagaaacccctgtctggttttttttggcatgcctaggaacacctctcaatacagggttccctggaaccccgtttcagaaacactggactagatcagtgatctccaagttctcaatttccaataatctgtggttctatagatcattagttctccaacttcctttta

SEQ ID NO: 164643 - DNA, 568 bp, Homo sapiens
ggagcctcacctacctagaagaatacagcataaggacaaatggtgtctagtatagagctagactatactttatcactttagaacaaagccatcaagcgtgttctagagacagactcatgtccaaatagctttagtatcctataagaatcattaggctggccgggcgcggtggctcacccctgtaatcccagcactttgggaggccgaggcggggggatcccgaggtcaggagttcgagatcagcctgaccaacacagtgaaaccccgtctctactaaaaatacaaaaattaaccaggcgtggtggtgcatgcctgtagtcccagctactcaggaggctgaggcagaagaatcacttgaacccgggaggcggaggttgcagtgggccaagatcacaccactgcactccagcctgggcaacagagtgagactttgtctccaaaaaaaaaaaaaaaaaagggttgggaccttaattaaatttacccttggtgaccttggggcatttggccgtaaaaggcctggtgtcttggcacgagcattagactaattgccctttaccgtgtggtctta

SEQ ID NO: 164644 - DNA, 357 bp, Homo sapiens
ccattttataaatggggatacagaggctcagagagctgacgtgacttgtccaaggtgacacagtatgggaatccagacttgacactggacctgtcccacctccagttggctcagacaagagccagcttcatttttctctgtacttcagtgcccagtacagggtctggccccagatccaggggtgcaggtgctgggcgagaggctgaaatcaaagaccgtgagagtccacggggcctccgtcattccagcctgagaacctgggaaagcgtaaaggcggttgaggcctgaccccactgccagaaggtgatgtctggtatgagctccccggtggcctggcgtccctgagatggctgggaa

SEQ ID NO: 164645 - DNA, 268 bp, Homo sapiens
aattctagagctgttggttaccataaataaatactgagaacaggaaatatgtttattctttatatttgaggaaacaaggtgcagcaagtttgtagcagactgtagagaaaacaaatcttgggtaagtactttgagataggttgttgagggccttaaaggtgtattttatgctatcagcaattgagaaggcagtaaaggttttcgaaacacaattgataggtacaaaaatacaccttaagaaggcaaaactgagtatattatgtaggac

SEQ ID NO: 164646 - DNA, 232 bp, Homo sapiens
agttatgggttcctaatatccaggtgcctataaaggggacattcataggagagtcccatgaagacaaatagtctggggtgggagtccagacctctttggacagctgccctggttctctccttccctttgctgccccttctcagggttgttcctctcaaaatatgtttcttgatgcatgaatgacattgcatttaatttaagaggcaattctctgataagaaagtcctgcctt

SEQ ID NO: 164647 - DNA, 496 bp, Homo sapiens
atacagagtacagaatcataaatcacccttttttgtctccccaggagtttcactcaagtatctcaagtcaataaatcctccttttctcttttaaatggtaaactcattattgacctcttggaattttcttgttttctcttctctcgcagtaaaacacgggtaagctgcgatgccaaccataaacccctccacagtatctctcaaactacttctcaaaaaaaaaagggtccaaagacctaggttcaagtgcctaatctgccacttaatagctgattgaagcaaatcacctaacttgtctgtcacaaaagttttcactgaaaaatcaggataatgctaatacatgcattacttacctctcagcgtatcagttctatgtgcctcatggttgtgcagtgcttagtattttcttttatgtgccatgcttcctccaaatattccctgttttattttctatctaatcatttgtatttcagaggaattggcagatttttttgtt

SEQ ID NO: 164648 - DNA, 738 bp, Homo sapiens
cccaggcctttgtctgtgaccccctagtggccagtcccaggtagctatatttcacactcatcctctccaaacttgaatgcagcttctcccgctctagccagctctttcctttgacttctcagctcccttgaagcacacaattgtcctaggaacttgggggtgaccttggggccactttcggtttctcttcctcctttgaccccatatacagtaattctccctgtcttgtagagtccttctgcagcatctatgtcctttgtgccttcctttacttcagcactgctggtggctggttttgggttccatcacatcctgcctggattcttgtaagagcctcctcctgctctcttctgtgccaggtttgttctgcacacaccaccagcccttcactcttttgtgttctatttattgagtaaatattatgtacaaggcactgtattgcatgctagagagcatacgaaatgaagatggagtgttcccactccagggtgcacactgggcagtggtaaaaggaaaatggggccgggcgcagtggttcacgcgtgtaatcctagcactttgggaggccgaggcaggtggatcatctgaggtcaggagtttgagaccagcctgaccaacatggtgaaacctcgtctctactaaaaatacaaaatcagccaagcatggtggcacatgcctgtaatcccaactacgccagaggcggaggcaggagaatcacgtgaacccgggaggcggagg

SEQ ID NO: 164649 - DNA, 126 bp, Homo sapiens
ctcaaaaaaaaaaaaaaaagtagtgtagtctgttatttggttagattatttttattccagaagaatgtatgctctgtgagagcagtgatgtcactttcgttcactgctgagatcccaggactcgca

SEQ ID NO: 164650 - DNA, 344 bp, Homo sapiens
acagtgacagtgggtagaacatcaggaggtcattctgatggctcgtggcccagccatcttcccatgccatggctaagtgtgcatctcaagggaaggtgatgtttttcttcttccagtgtcaaggcctaggctgttgtcagtggggggactcgaccccctgacatggggctgcctggtgcaggccgtgtgactgtggggctgcctggccgctggctctcacatggtggttcctgctgcactgatggcccaggggtctctggtatccaggatggagctctcgcttcctcagcagttgtgacttccacccaggacccaggacgctgccctccgtgtgcactagcctg

SEQ ID NO: 164651 - DNA, 225 bp, Homo sapiens
ccgccgggaggcatgagctgggctgggccaaaagaggccactgggaggcaggaggagctgggcctggagaggctgccgaaaggcaggagcttcgcctgaggatgccacagtgagacaccatctgggtctggagggtccactgtgaggcagaggctgactcttgaagcccaaaacttcctcaaaccaggcttttgcccaacttctgtctactgtcggactctacag

SEQ ID NO: 164652 - DNA, 227 bp, Homo sapiens
attcatgatgttatttcaattgagcattcttgtgtgacaagaactggtaattattgaaaatttcatctgcataaaaatactagatcttacccacaagtccatttcctcttgtctctcagtgttagactcaccctcagcatcatttttggccgttaaataaaagacaatggagggttttttgtttgtttgtttttactataactgctgggccactgccaaaaatgatg

SEQ ID NO: 164653 - DNA, 350 bp, Homo sapiens
tgttagggatgccctggaggaagggttttctggcagacatccagacgtacaaatccagcgtactagaagagtgggcagcatccagccactgtaaccataggatgtgtaggggagatgtttgggagcctgctgtacagtccaagaatacctctgtggtctcctagaatagggcctaattaattccacaagggggttttccgtaccatttgttttcattactgaacatcattctcagtacaggctcatctgagtagagttttatttgttcaagacaattgtttgggcttgttttttaaaaccagttttgcatttgggggaggatattagatgccttacactgggagtcttca

SEQ ID NO: 164654 - DNA, 273 bp, Homo sapiens
tactagacagagagccttatttcctgaccattgtcaattctacaaacggtggagcaaagtgccagatactgagacagtcattggctctctgaagctaaataagatactgttcctgcttttgaggagtttaggttgtaatgatatcttttctaaaatgaatagaattagctgaggtggttctccctgtattgagtttgggttggcaggcaaggaaatggagttatgcacaattggctcaacgttcaatgggcacaaaatcttagatgaaaatga

SEQ ID NO: 164655 - DNA, 142 bp, Homo sapiens
gctcaagtgatcccccttcccaaagtgctgggattgcaggcatgaaccacccaccatgcctggcttagggccattttcttatgagccctttgccttcaagtggatgacaaagatgttttttgtggaaaaaagtcaactcctg

SEQ ID NO: 164656 - DNA, 312 bp, Homo sapiens
tttactctcccaaatacctaccaccgaaacattctgttcctaacatttccattgcccttcacactctcccttttccttcctttctctgagttaaacatattgctgatttttttcatctcccaaaagattcctagagctgaccttcttgtctctcaaatcatatttgtttttctctaagtagagaatcttctcctagattatacaacctccctcgtaaaaacctggggagcaggagggaggtgttgaaacttcactagagcaggtgcattctttattgctttattccttgtcctgcactggcatgaatgcagt

SEQ ID NO: 164657 - DNA, 660 bp, Homo sapiens
ctgtagctggtgggaaacaagaggccaggtgtggggctggacagtccaaggagccacatccggggacaaaacaagtgcaggggacatccatgcaggtcttgatgccagggagttagggaattggggtcctggcagggaagcagggctgggagctggctgcaagaatgaaaggaagactcagggggaggggcaggaaatagaaagggacatgtagggggagtgctgccgcccacttgcagcctgggggcaaatctgccagagccaggccgttctgggctcagcaaagctggtttctgggagccttcttcagtagggtggggtgggaagaccgaggtgcaggctgctttgggaaaagagtttcccatactcctaacgggagttagggcaggccaggtgcagtgcctcacacctgtaatcccagaactttggcaggccaaggcaggtagatcacttgaggtcaggcgttccagaccagcctggccaacatggtgaaacctcgtctctattaaaaatacaaaaattagctgggcatggtagcgggtgcctgtattcccagctatttgagatgctgaggcaggagaatcacatgaacccaggaggtggaggttgcattgagctgagatccactccagccggggcagaggaatgagactgtgtctc

SEQ ID NO: 164658 - DNA, 149 bp, Homo sapiens
gcactaaggcccagtggggcctgccagggcaacagtcatggagcctccaggacaaaggggggccctccccaccaagacctctcccatacggaggccacagagaagctcctttgcagtctgccctcattctccccatgcaccccctcatc

SEQ ID NO: 164659 - DNA, 108 bp, Homo sapiens
tctaaaaacagtaactgcagttgattgtagcacattgaatatgtagaagttcatgtgttcctaatgatattagaaaagagagagaaagccagaaatttcatggatata

SEQ ID NO: 164660 - DNA, 278 bp, Homo sapiens
aggtgaagagagatgggctcagagagacggctgggatgttgactcgtacttctgtcagtaaccagcagggtggctgcttaaagatgaccgtgtggaagcaggtaggtgtaaaccgtcacagcactgtactgcaagcaacacacacagaaactcagggttcaaggccaggccatacccttggacgtacatttcacttaaccttcctgagttctgatctgtgcagtgggtctggtgcctggctcgtcagggctgctgggttctcctgtgacgcccttggc

SEQ ID NO: 164661 - DNA, 474 bp, Homo sapiens
tctatcgtatctaaggatcccgtggcgtgaggctaactgcagagtggctgatggagcaaacccagcacaagcgtggtcctctatctaccacaggggatgagaggaaatctccaggcactggtgtcagaagaagcaatgggagggggcctcccaattattaataatatctccttgcttggtgtcatggctgtcttgcctgcccaggggcacctatgggctgtgaattagactgcttctgggcatagggagcagaaaccaggggacaatttacatggagaacttctctgctggacaccaggagagccagagctcaggaaaatatagcatcatgatccagagggtttgctttttagtattcctccttctgtctcaatggccttgctgataggggtaaacacactactatcaagacgctaggaggccagggaaagggaacatttacatctagcacctaagtgctcagcattctgccag

SEQ ID NO: 164662 - DNA, 618 bp, Homo sapiens
ctcttgagaggaaaggcaagtctctcttttctgccataagccaaaacaaattccagctgaattacagaaaaatctgaggtagacacaggaaacatagaaacttaaaatgacataaccaaataaaaaattactttttccctatgttcaaaggacttaaaaagaccacagagttggaaaagtcacttaagatgcaagtagagttaacttcaattcaccaacagctcatgagaactgagagaggcccaaccatgtgctgtgtgccggctgtgtgcagcagagaaaatccaaatggctaagccccagggaggggaactcagagggaccagtagtcacgatggtggcaatttacacacccaaagatcggcaatgtcagcagtgacaggtgacacctattgcttgctggcaaggaggtagaagaaagcaagcccacattgctgaaatgttattccccttggggaaagcaacctggcaccctgacttacaataagatacaccctccgatttaacaatctaacttcttaagggctagctctaaaaataaaagcataaagacaacagggacagtagtgatggaagagaaaaactcagacagtgatgccaggcaacagggaacaggtg

SEQ ID NO: 164663 - DNA, 160 bp, Homo sapiens
tattttaggatgtttttgtggttatctctaaattcaaaatggatcccccatctgaggaaaccaaactgacttacgagcaaaataggaaaaataaatttgccttattacccaaatattctatgctcttctaaaaacttacaatctgtactaatacctttac

SEQ ID NO: 164664 - DNA, 374 bp, Homo sapiens
tcataatttggagatatgctgcacaacactgaacactgtatttgcagtaacatcatggagagattactctccaaaataaggtaagtatcattgtattcactgccttttggatatgtgccatcaagctgtgtaacagagtttactaagtcctatgaaatgacgacatttcagattaaaccctacatgtttcttctttcttccttttgtcttggtattatagctttctgccatttcctcttcttcatttattttacttccagaaacctaagtccctttccaccaacctattctctgtctctctactcaatatcttaaagtctgtatcttcttttatcttcgcactagtgatctcacttcctttatgataggtagaa

SEQ ID NO: 164665 - DNA, 227 bp, Homo sapiens
ctcggggaaggagaatctgatttttaaaaagcctcatttaagactcgttggactagaacactgacctcgttttcatgtctgactcaaagcagcacctgtgggtccccccatccttacaagtggtttgggaagactcccattttacctctaacaggcatgggcttgctgcggtttctctctgcctgtggtttgccctttaacccagcaggctacaaagatgaaaagca

SEQ ID NO: 164666 - DNA, 347 bp, Homo sapiens
agctgttcagcccaggaaaacaaagtgactaagaaagtaacaaagggccctgaatgggagctggggcctggcagcagaactctgctaaagctcccacccactcccctgagttttatgcccctctcccagctctccacccccagtctcctctcttactgcaagaagagctgtccaaatctgccatgcctaagggggcagcatggaagatgtgtctaaggtgccaggcatggtggcgtgtgcctgtagtcccagctactccggaggctaaggccagaggatcacttgagcccccaggagttccaggccagcctgggcaacatagagagacctccccgcgaccaatctca

SEQ ID NO: 164667 - DNA, 238 bp, Homo sapiens
ttggctgtgtccccatccaaaattcacctcgatttgtaatccaaatcgtaatctcacatgttgagggaagggcctggtgggaggtaattggattattgaggcagtttcccccatgttgatctcatgatagtgtgtgagttctcatgatatctggttgtttgataaatatctggtgcttctccctctcctctctgtctgtctctctctctcttgcctgctgccatgtaagatgtgcctt

SEQ ID NO: 164668 - DNA, 537 bp, Homo sapiens
acattgcatgcctatatcaaaacatatcatgtatcccataaatatatacacctactatgtgcacataaaaattaaataattgtttttaaaaatggctataacacctaccttatggtgaaataatgtctaaaagctctggcacacaagaggcctttattgatgtttaatttccttccattccttcttccatagttgttaattcggaaccaggcaagtttggtggctcataccaggttttttttcccttccaccttgtcagaggtatcctacaatgcagcactgagctgtagatgctggttccctgttcaaacctggggaagagtgctgtttaaatatctgcagacacactgtaggaacttctccaaagtgactttcctctcccaggcgaccctctggtcagtgagcggcatcttggagtcatcaggagaaggctggaccatgtggggagggtcgaggagcaagcagagcagaaccttctgtggctgcgatttgtccttcctcagggaaggcctccatcttctgctctggtggagcagc

SEQ ID NO: 164669 - DNA, 152 bp, Homo sapiens
aaggtttatgtagttgcctaccctaccccgtgccaaccccaaaagactagagacacaatcactttcaactctcttgtgtttgtgtagatgactaggttcttaaatatgaacttcggatattttctaaccaattactatgccataacgtaact

SEQ ID NO: 164670 - DNA, 308 bp, Homo sapiens
acactgtaccccataaatatgtacaattattatgtgtcaattaaaaataaaaacaggccaggttcaatgactcatggctgtaatcccagcactttgagaggccaaggcaggaagatcacttgaggccaagagttctagacgagcctggacaacattgtgagaccaccatcactacaaaaaataaaaaaaaaacctcagctgaggccaggtcccatggctcaggcctgtaatccaaacattttgggaggcaaagacgggaagactgcttgaggatgagagtttgagacaagcctgggcaacatagcaag

SEQ ID NO: 164671 - DNA, 516 bp, Homo sapiens
aatttctgtaaatcagaatattcagatgttgaaaaagtctttgccttcagatttaaaagatacctttgaaatgtagcatatcccaaaatgcaacccagaggctggcaatgtcaacatttttctgttttaaaaaacctcttatgaaaactattgccatactaaattttttacttgctgatgacttacagctggaaaggattctgtacatataagacatcaaatattgaggatactggaacttttaaattaatggcaaagaaagtcaacaaaggaagttcatatgaaatcaaactagtaatatgattacaaaaaaaaaagtttaaaatttttcttggccccagtcttatcatttctgagccaaatacaattctatcgaaatcacctgaaactgaaatcaccattctaggctggttttcccataaagatggactgctccaaaaagaggaatcaagaaagaatttggctcacagtgaattattcactttgtcttagttaactaaaaataaaatctgactg

SEQ ID NO: 164672 - DNA, 208 bp, Homo sapiens
gccacactgctctgcctgctgcaacaaagtttaaggggagtgttgtgtaggtggaatgaggaggtcagctatacacagaagaggaggcagtgcaagaagcggtagagtttgatcttcagaatcatttcactttccaaacaatcaggaggatgttgtgaggggttgggtaaaacttcctctaggcacagagctattaaatcacagcttc

SEQ ID NO: 164673 - DNA, 586 bp, Homo sapiens
aattggataaatcactgatcaaacaactctcagtttagcaataatgagggtattgctccaaagcaaccatggaatgtcatttttctggtttcctaatgtcatttgctccctgtgatgaagtctgagaatgagatgagctgaaactgtaaacccatttaaagaaaaacccaactaagcttatttccgctctttttaagccctgtaccttttactggtgattagacttcccttgggggatgatcctaaagacaaggttatcttcacgttattctttgtgggttttatggggaaaggttttttgctgagctgagaatgtgggaacgggataaagaaaccaacaaatgcttagttcaccaaaactttacaaaagcaagtagacaggagttaaataccaaatcagcaagaagaaaggaaaggttcttaataaacatatttcaacactggagtctgtgcccccaccaatgactagattgccactcctggtcttgaaggatggggctgtccttgtgaaaataaaaccacatggtattgtggagaccaaactaagtgataaaattgagttaatggtaaattataggataacatt

SEQ ID NO: 164674 - DNA, 497 bp, Homo sapiens
tgagtcaccgtgcccagctgaatacaaaataaagagacacttccacaggcaaatgcaaatctgttgcagcatattagtcaagaaatccccaagttaccaaaagttctgttctaagaaggaactctttttccatagaaacatgttacaaatggtagctgtgttctcaggccagcccatgaggtcccagcatagtatttcaaggggtacgtgaattgtacttaagacttaaaccatagcccagaacaggaaatgaattcagagttccaactcaggacccgggaacagatctttgctctccaagcaccatgggcagcagacacgggggctccctagtcttcaagctctgggtgagggcttgaatcaagaagacttgagccaggtgcggtggctcactcctgtaatcccagcactttgggagaccgaggcaggtggatcacgaggtcaggagatcgagaccatcctggctaacacggtgaaatcctgtctctactaaaaaa

SEQ ID NO: 164675 - DNA, 231 bp, Homo sapiens
tgcatctctagtagaggtaaggtttcactgtgttggccaggctggcctcaagctcctggcctcaagtgatccacccgcctcaacttcccaaagtgctggtattacaggcataagccacggcgctcggcctataccttctttcttaatttgcccagcaccatttgtttcctccactagtacatattccacggcttgccgtaatctgctttgatgcctatgctgaccactggg

SEQ ID NO: 164676 - DNA, 304 bp, Homo sapiens
ggtagtttgttttctggaaggccagtgaaatacagctccttaatttataatgaaatttactttctaacaaattaagtctttctaatgagaccaacattgagaattcagcccttacctcgggatggtctgagaaaaccaaaaggccaactgttttattgctttagatcagttaggtgatgataactatgagcatttataataatattttaaattggccctgagaggcttgaagacatagaactgaatgtactgccagatatttttgcaggagtcacagatgtaaaagagaattctgcacacacat

SEQ ID NO: 164677 - DNA, 278 bp, Homo sapiens
aaaagatcatcaaaaatgaatacatgtattatgaatttccaaaaggagatatggtttacacagcatcttccaacctcaggactctgcatttgcagagcagctcaggggtgcagcttcaggttctgctcccggtaaagcagatgggaggaggagtggggagtgtttgctggcacctctttaaggaagcagacccagagtgggaggagagttgtccttaattaataaagtggccattgcgttgatggctcttatgttgaactcaggcacaattgcattaa

SEQ ID NO: 164678 - DNA, 187 bp, Homo sapiens
tcccccctctccctttctctccccccctttttgagcacatgtgccaaggaaaggctatgtgaagacacaaagtgccacctacaaaccagggagagagccctcactagacactaacccagatggcaccttgatcttggacctcgagcctccaggactgtgagagaataaaattctgttgtttaaacca

SEQ ID NO: 164679 - DNA, 407 bp, Homo sapiens
tatcagagagagaaacagaagcatagttgtttctaaatattaaatatcaatctccaaattgtggctttttactctgaaatcttcaaagctagccaggacactgaaatgtacaaaacatcaaataatataatgaaagcatttcttttcaaagtcctaataagcgcttgggcaaagtaatgcattcctcctgcaatgcacctggtcccactggagcctgacccatccagaggcaagtgtctacgttacacatcttaccccagcaattaacacagggagtggcctgaagttgagcctctatgaacgttttggcacagattcattaacacggtaaatacttttcacataactggaactcttttctctgcccaatttaatcatcagattgaacaactgaagattacatgata

SEQ ID NO: 164680 - DNA, 172 bp, Homo sapiens
gctgaacagagtactgtacacaaaaagtcctgatgatgtaatcaatatcctccagcttctgctgggcagtttggactggaaaagtctcccattaagtgcccatgacaaatgttttctgagaggtagctttagattttctgagccttttatatattattcatagcttcatggt

SEQ ID NO: 164681 - DNA, 189 bp, Homo sapiens
aagatagaagtgtgtgcaggagattactaataaaagattactagtaggctgggtgcggtgatctgcccacctcaacctcccggattacaggtgtgagccaccaggcctgacctgaaattatttaaaaatgtcacagagaataaaaataatttagaatgaaatgatgatcaaacttcaaagacatctctt

SEQ ID NO: 164682 - DNA, 360 bp, Homo sapiens
ccattttccctatttttcaccatttggaaccaattctatgaactagaataatctctccagttatcactttatctgtatcacatgaatgacatacactttcttaagattatttcactttcctgagaaatagcctctaagatctttaaagatttttctctcttcagtgggcttttgccaaccgagcacttctgtatggatataatcttatattaaatatgttcaagaaagaactgtctttcctcaacaccaatctgtcgagattccctgcagttttgtcccagtcacacacaggtttactgttagagtgatcttgacctatgtctaccatatcctgtccccgagtttcttaaaagttactga

SEQ ID NO: 164683 - DNA, 303 bp, Homo sapiens
ctggcttcccatatgtctctacctatagaaagaatgtaaatgatgctctttgagtgttctactctgtatggtggcaatttcttattgtaaattataaagtactcattctggtttgaaacattaatctgtggattttgtctcatgttcctctaagcctaaagatgaagcatcccatgactatgaacagaattaagtttcttaaaatttaatgttgaaaattagaccttggatatgtaatcatcaaaagtctggactttggcaccaaatatccagagtatgaattccagatttttcattgaataa

SEQ ID NO: 164684 - DNA, 177 bp, Homo sapiens
taacttagaacaagctcagagagcaaggggactgacttagtacaacctcatgatctgtgggcatattttaactgtaatcttcaggaatgacttttctcctgaaagtaggaattctctttctgctgttaagtgacagcatgtgctggagacattggagaaattacccagtcatgctaa

SEQ ID NO: 164685 - DNA, 267 bp, Homo sapiens
cttcatagtttaagaaaaaatttcaactcgctaacctttcagaagccttaaaatgataacgttttaatctacaaatccataaccactccttttcttaggatatcaaaccagtataaacaaaagtcttttctggaaaagggcttttgacttctgtggcctttttatgagtatttctgagctgtacagggacagacaactttttcctgcctggtgtatagaagagatcttcaaagattaaatgccatcttttcacaagtagagtgttga

SEQ ID NO: 164686 - DNA, 481 bp, Homo sapiens
ttatgaagtgaaagggcttagcagcttcagacacctcactacattgcctgctccttccttgcaggtatgggatggaaggcttgctgtgggggaaggtggcttagtaatgaagggagcccatctcaactggggctcgtgggagagtaaattaggccctctaggaaaaagttcaagggagtctttgtgaattctcccaaggatggaacattctagataggagggatagaagcaaatcattctatacgttggaagcattggggcttcgtattcttgtggaaccttgttgagaagggcaggtgtcatccaggaaagaagggaccacagtactttgctgtgcagcatggggaaaagggagcatttatggacatcaaccaggatgaagctttcctcctgattttcagaggcttcacttttgtgctttttatccaagtcaggttagtgcccaaaacaaagcaaacaaataaaggcctttattttaagc

SEQ ID NO: 164687 - DNA, 396 bp, Homo sapiens
ctcctaagaaatccaactttaaaatataacaagcaagttttttgcaatgaaattggcagagtaagagttttataaccaaagggatctgtgtttaaattatgcactctctgccactttgtatctatgtgactgtaagaaactcactccatctctaagagtcagacaaactcataaaaatagcttatttggattagaaatgatacttgtttggatttcaaaggacagacacatattgaagcattagtatattcatttcaaaagtgacattcaacaccaacatttcgcaataataaaaacacagcttaatatgagactaatcattaacactatgaattctaattctgcaaaaaagttaaaatttaaaaaatttcaaattcagccgggtgcagtggctca

SEQ ID NO: 164688 - DNA, 346 bp, Homo sapiens
tgaggggatctgactccctgtcccttctacaatgggaaaaggctgcttcaatgctgcttttcgcaagtagagggtctgcaggggtcaaagggatcaccatcccaccttggaatccagaaagttcgtgggggcaggctcagagaccagcctgcaggacctgagaaagaggcgccgccttccctggatgaactccaagaacccacactgtgcgaggaagatgaaccatcttccaccagcttgggaatatcagtcctgcccaacccagaagagacctggaaaatggttctaagctagaaggcaccacggatgcccctccatcagaaagagtgggacgtgtcacccatgg

SEQ ID NO: 164689 - DNA, 437 bp, Homo sapiens
gacccttgaacttttggtgtgcatacttgaacaatacagcctaaagttcgtatctttttgccaatcaatacatagatattaagatgcttttattctgttttccctgtttttgtcttctgtgttattctaatatgtgacctccactcaattagtcatcattattttttatggtagattttttttattgtagtaaaaaacataaaattttccatttcaccctttgtaaatataagttcagttgtgttaagtatatgcacattgttgtggaacagagccccagaactttttcattttcaaagctgaaactctgtacccattaaatgactacctgttccccagtcccggcacccaccattctccttgcacccaccattctccttttggtttctatgaatgggactactctggatacctaatagaagtggaattagacaaca

SEQ ID NO: 164690 - DNA, 517 bp, Homo sapiens
cagtctctctcacacgatactaggtgtcaaatgcctcccatatgttttctgctcacatcctgaaccagctatccaaatgaatagatttaatgagttacgcttggttatgacagaaaactaagtaaaacataataaaaaaaaactcctcatccaaggattaaaatgatcagaataattttgtgtaattctgaattataaatatttttctggaagcatgaagttttactaacacagctacttagtaaaactggaataaatattatgtattaaatactcatagatcattttttatacaactgaataacaatatcctgtcgtttttagataagtttcaaagtgaaaatgtacttttagggtttggttttacaacgcttttttcttgtgttaattttaaatattcaccctttgaacctatgtgtttattcaacttacaagaattggtgaaaaattcaggagatgttcctacctaatcatgtacaaatgtttttttacaaaaattaaagctttcaaaatattt

SEQ ID NO: 164691 - DNA, 371 bp, Homo sapiens
gagatatagttgaaataatagtgaagtggaaaacttcactcttaaaaaattttgggagaggatcatttttagttctccattggttttccagtgaataaagattttttgttttctggtcttgatggatctggtttcattttgcttttgagttttttacgctaggttatattctcactttgtagttactaattggtcaactgcattttttttcaaacctttgccatcaaatattgttttgggctccataaaaagtggtttttaaaatgtgaataggaagggttatactcctttcttttggattgtacattctaagaaaaagattgcattatggccattgtgttatttaaatataaacctttcagaagaactaa

SEQ ID NO: 164692 - DNA, 210 bp, Homo sapiens
gacacactttgggaaacagcaaacctctattattcacatggctgtaaagttctatgcttttattcctagggtacccttggatctgaaataggggaagatattagtatttatctgactcccaaagatgtgccggatactaagctacgctctttgtagtccatatctcaattaacattcacggcaaccaggagctaagtgttataatattat

SEQ ID NO: 164693 - DNA, 270 bp, Homo sapiens
ccaggcacagccacatcccacactaaatatatatatatacacacacatatatgtatgtgtatatatatatatatgtatatactttccctttagaaaaagtagacaagattttgataattgtcatctttaaaattatttattacacaaatactgcatgttctcacttataagtggcagctaaataatgagaacacatggacacgaagaggggaacaacagacactggagcctacgtgagggtggaaagtgggagaagagagagatcagaaa

SEQ ID NO: 164694 - DNA, 544 bp, Homo sapiens
tcttaggtttctgactatattttgtcttatatgacatactgcttttatgcttccttctaaattttaattatgagaagagtagagcctatgatttacccatctgtaaatcttcccccaaaccacgacctccacctagttcagggctttgaacatgataggaactcagtaaacattgttgaaatgaatggaatatctttcaaatgtgtgaggaatcatactatgtttaaggcatattgaaactctgctatggtatgatttcttcctcgcaaccaccagcacaatagaaccaaactggtttgtccacacttcctgcccaggtaactggaggtgaaacttttgctcaccttaaaatatttgtcatattgccttaatgtctttgcccacagaattaatggaaatacttgggtttactgataattgataattgggcttaaaaatatttgtgtagtaaacatagccagactatgtcctatgtgcccaaaacatctctcagtgattaaaagtattctgttttgaaaataaataagcatgatgatgcatgctg

SEQ ID NO: 164695 - DNA, 483 bp, Homo sapiens
aggctgccccccaccccctgcccatgaatccagcactcttagagaagaggcagcagcacagggagtcagggaacccagatgctgggaagccgggtgacctgatggccacctcggaaaatgacagcctggcagatttgtgtgtaagagctcttccacccttgctggttggtacttgggaactctgatggcactatgcatggcatctctggcatactcacaccaagccctgtaaagctgtcagaggtggggtttatgggcctcatgctgcctcctagagcaactgtggccatagctagctgccctttatgagtttacaaagggctgtccccctcctcctccagggagcatgtttgagctggcgggcagcgggccaggggccaaggctggcgtgcaatgtttgggctgcctaacttttgccccacactcctatccaagctactgtggactcttctgccataaatgacagtttgtctccaagtgaca

SEQ ID NO: 164696 - DNA, 336 bp, Homo sapiens
gaatcttgtgggtataattggctaaaattggcctcatgggctctgagacatgacaagaccagggatcaaaacctggtgacttcaccaaagtttatgtttactgattgtggacctggtgtcaagcatgtactaaggactcatctactatggttgcttgtatattgaggtgaacagtgtcccccaaaattcatgtccacctggaacttcagaatatgacttttagaaatcggatatttgcagatgtaattagttaagttaaattaggtcatggccaggcatgagggctcacgcctgtaatcctagcactttggaaggccaaggcaggtggatgacaga

SEQ ID NO: 164697 - DNA, 622 bp, Homo sapiens
atcgtcatagcttgattcctatgatgtacaacctcgtcgagctggagcggttctcgtactctgccaacaatcctctcaaatcctactcttggcaactcatttatattgtgaggttcatttaactggctctcttcatttttcccagggtcttgaattctaacctactctgtactggaagaatgaaagacttagaaggtagggggcatataatgtcaaaaggtttagattcagtgtcaggaaatctgcttctcatcccagttctgctcctgtttaacccctcatagtcccttcccctgtctggacctcagtttctccatctgtaaaatgaaagcgcagaacataagaccacatgatctatcccatcccctcattctatgccttcatcccacccaagcacagggcagaacactgagaacagactttggcactggagagaccctgctcccagttctggctttgccacgtactagctgtgtaatttggggaaattacctaacttctctgagactcagttttctctcccataaaatggaaaataaaataaaaatcccagccagatgtggtggctcacacctgtaatcccagcactttgggaggtcaaggcaagaggatcacttgaggc

SEQ ID NO: 164698 - DNA, 612 bp, Homo sapiens
cttttttttctttagtgtctcttcatggcaaaactcctcaagagttgtctatgttgatgtatttcaattcctagtcccccaattctctcctaagccctctttttaagcagactttcacccactactccaaggaagccactctcaagagatcaccagtgacctccactgcatccatgtggacccacacgattcacatgtgcccactcagacacattctcatggctttcttggcagctgctgacactactcctcatttcctcacttggacacacttccttccttcacgcggctaccaggactccttcctctcacactttcccctttcctcagggttgctctttaggttgctttgctggttgttgctctgctccccaacctcttgacactgcagcagcccaagactcggccctcagtcctcgcctcttctctatgatgctcattttcccttggtgattctacgctggctcaagacatcatatagcacttctatcccacagtcttcaatgaatctctctcccaaattccatacgtgcatatctgactgcttactcagcatcttcagctgggtatctgaatgacatctcaaactcagtacgtccaaaactgaactcc

SEQ ID NO: 164699 - DNA, 464 bp, Homo sapiens
cttttttttctttagtgtctcttcatggcaaaactcctcaagagttgtctatgttgatgtatttcaattcctagtcccccaattctctcctaagccctctttttaagcagactttcacccactactccaaggaagccactctctggatgcaaagtgtcctctggatgcaaagtgtctcttcatggcaaaactcctcaagagttgtctatgttgatgtatttcaattccttcccccaattctctcctaagccctctttttaagcagactttcacccactactccaaggaagccactctctggatgcaaagtgtcctctggatgcaaagtgtctcttcatggcaaaactcctcaagagttgtctatgttgatgtatttcaattccttccccaggtatggagcacactcttcaccctaccctctaaccacaggacactttgcatccagacgggtatcctctagaaca

SEQ ID NO: 164700 - DNA, 3310 bp, Homo sapiens
gtttttgggcccaacgggcagaagtgcccctcccttttacactcacacttcccactttctaagggtgccaggcccccgcgccgccctcctgcgttctttccggacggtccaacgtcttttccaccagtcccagcccatgtcgattacgtaaattctgtccaagaggattcccatacgtgcccctccgtccagaactcgcccagcccggaccagttccgagatttaccaccagcccagagctgggcgggggcgtggaaaacgcgaggagccttcccgcccctctccttctccctccctccctcccaagccactgccggctcccagccgagctccgcccccgcggtggccccgcctccccgccgcccggaaagcgggctgcggccccctcccaaaacccggggaagtggattctactctacgctccgctccgctccgctccgcaccaccaaccccgggccgcagtcctgacgagcgggtcagggcttgtcgggcggaagcctggcctggagcctggaagggggagacggcccgagcgggagcgggagcggacgcggcctcagtcctgcgcggaatattgaaggatgtttgttccaagatctctaaaaatcaagaggaatgctaatgatgatggcaaaagttgtgtggctaagataattaaaccagacccagaagaccttcagttggacaaaagcagagatgttcccgttgatgctgtagctacagaagcagccacaatagacaggcacatcagcgaatcatgccctttccccagcccaggtggccagttggcagaggttcattcagtaagtcccgagcagggtgcgaaggacagccatccttctgaagagcccgttaagtcattttccaaaacacagcgctgggcagaaccaggggaacccatctgtgttgtctgtggtcgttatggagagtatatctgtgataagacagatgaagatgtgtgtagtttggagtgtaaagcgaaacatcttctacaagttaaggaaaaggaagagaaatcaaaactcagcaatccacagaaggctgattctgagccagagtctccactgaatgcttcctatgtctacaaagagcacccctttattttgaaccttcaggaagaccagattgaaaatcttaaacagcagctgggaattttagttcaagggcaagaagtcaccaggcccattattgactttgaacattgtagtctccctgaggtcttaaatcacaacttgaagaaatcaggctatgaggtgccaactcccattcaaatgcagatgattcctgtgggacttctgggaagagacattctggccagtgcagatactggctcaggaaaaacagctgcttttcttcttcctgttatcatgcgagctttattcgagagcaaaactccatctgcgctcattcttacaccaaccagagagttagccattcagatagagagacaagctaaagaattgatgagtggcctgccacgcatgaaaactgtgcttcttgtagggggcttacccttacccccacagctttatcgtctgcaacaacatgttaaggttatcatagcaacccctgggcgacttctggatataataaagcagagctctgtagaactctgtggtgtaaagattgtggtagtagatgaagctgataccatgttaaagatgggttttcaacaacaagtgcttgacattttggaaaacattcctaatgattgtcagaccattttggtttcagccacaattccaactagcatagaacagctagcaagccagcttctgcataatcctgtgagaattatcactggagaaaagaacctaccttgtgccaatgtacgtcagattattttgtgggtagaagacccagccaaaaagaaaaaattatttgaaattttaaatgataagaaactctttaagcctccagtgttagtatttgtggactgcaaactaggagcagatcttttgagtgaagccgttcagaaaatcacagggctgaaaagcatatctatacattcggagaagtcgcaaatagaaaggaaaaacatattgaagggattacttgaaggagactatgaagttgtagtgagcacaggagtcttgggacgaggcctagacttgatcagtgtcaggctggttgtcaattttgatatgccttcaagtatggatgagtatgtccatcaggaaaatacctacaagtctacttggaggaatccccagcattttcaacaggatgtcagaatgaccttgggctatgttggcaaagcacaatgggaagaagacaaccaattgaaggtcaaactaggccttaaaaaaaattgttcttcctaaatgaaactttatgtaagacccaagcttcctttatgtaaaaataggatactcactaggctttggggctgacaatggtttttaaatcttgctaatcttccctggaatgaaaccagcatgactcaaagagaaaaagagagtctataatattttctaatccctgagttcttttctttatatattaaaaaggattattaggctgggtgtggtggctcacgcctgtaatcccagcactttgggaggccgaggggagtggatcacctgagttcgagaccagcctaaccaacatggagaaaccctgtctctactaaaaatacaaaattagccaggcgtggtggcgcatgcctgtaatcccagctactcaggaggctacagcaggagaattgcttgaactcgggaggcagagccaagatcgcaccactgcactccagcctgggcaacaagagtgaaactctgtctcaaaataatattaatgataataataataataataatagggattacttgcataattgttcttttaaaattattggcagtattgctgaatgtatttagattttttcaccaagtgacaacaactgaattcataaagattcatcaacaagacctgataaaaaaaaatgtaagcatattatagtggatacttccaagactcttggtctaacatgtattagaaagcagaaggagcccaggcacaggggctcccgccggtaatcccaaagctttgggaagccaaggcaggtggatcgcttgagctcaggagttagagaccagcctgggcaacatggtgaaatcccgtcaccacaaaaaaatgcaaaaattaactgggcgtggtggcatgcacctgtagtcccagctactctggaggctgaggtgaggggaatcacctgagccgggggaatcacctgagcccagggaagttgaggctgctgtgagccatggtcatgacactgccctccagcctggacaacagattgagaccctgtctc

SEQ ID NO: 164701 - DNA, 2661 bp, Homo sapiens
gtttttgggcccaacgggcagaagtgcccctcccttttacactcacacttcccactttctaagggtgccaggcccccgcgccgccctcctgcgttctttccggacggtccaacgtcttttccaccagtcccagcccatgtcgattacgtaaattctgtccaagaggattcccatacgtgcccctccgtccagaactcgcccagcccggaccagttccgagatttaccaccagcccagagctgggcgggggcgtggaaaacgcgaggagccttcccgcccctctccttctccctccctccctcccaagccactgccggctcccagccgagctccgcccccgcggtggccccgcctccccgccgcccggaaagcgggctgcggccccctcccaaaacccggggaagtggattctactctacgctccgctccgctccgctccgcaccaccaaccccgggccgcagtcctgacgagcgggtcagggcttgtcgggcggaagcctggcctggagcctggaagggggagacggcccgagcgggagcgggagcggacgcggcctcagtcctgcgcggaatattgaaggatgtttgttccaagatctctaaaaatcaagaggaatgctaatgatgatggcaaaagttgtgtggctaagataattaaaccagacccagaagaccttcagttggacaaaagcagagatgttcccgttgatgctgtagctacagaagcagccacaatagacaggcacatcagcgaatcatgccctttccccagcccaggtggccagttggcagaggttcattcagtaagtcccgagcagggtgcgaaggacagccatccttctgaagagcccgttaagtcattttccaaaacacagcgctgggcagaaccaggggaacccatctgtgttgtctgtggtcgttatggagagtatatctgtgataagacagatgaagatgtgtgtagtttggagtgtaaagcgaaacatcttctacaagttaaggaaaaggaagagaaatcaaaactcagcaatccacagaaggctgattctgagccagagtctccactgaatgcttcctatgtctacaaagagcacccctttattttgaaccttcaggaagaccagattgaaaatcttaaacagcagctgggaattttagttcaagggcaagaagtcaccaggcccattattgactttgaacattgtagtctccctgaggtcttaaatcacaacttgaagaaatcaggctatgaggtgccaactcccattcaaatgcagatgattcctgtgggacttctgggaagagacattctggccagtgcagatactggctcaggaaaaacagctgcttttcttcttcctgttatcatgcgagctttattcgagagcaaaactccatctgcgctcattcttacaccaaccagagagttagccattcagatagagagacaagctaaagaattgatgagtggcctgccacgcatgaaaactgtgcttcttgtagggggcttacccttacccccacagctttatcgtctgcaacaacatgttaaggttatcatagcaacccctgggcgacttctggatataataaagcagagctctgtagaactctgtggtgtaaagattgtggtagtagatgaagctgataccatgttaaagatgggttttcaacaacaagtgcttgacattttggaaaacattcctaatgattgtcagaccattttggtttcagccacaattccaactagcatagaacagctagcaagccagcttctgcataatcctgtgagaattatcactggagaaaagaacctaccttgtgccaatgtacgtcagattattttgtgggtagaagacccagccaaaaagaaaaaattatttgaaattttaaatgataagaaactctttaagcctccagtgttagtatttgtggactgcaaactaggagcagatcttttgagtgaagccgttcagaaaatcacagggctgaaaagcatatctatacattcggagaagtcgcaaatagaaaggaaaaacatattgaagggattacttgaaggagactatgaagttgtagtgagcacaggagtcttgggacgaggcctagacttgatcagtgtcaggctggttgtcaattttgatatgccttcaagtatggatgagtatgtccatcagattggaagagtaggaagattaggtcaaaatggaacagcgattactttcatcaataataattcaaaaagactcttctgggatattgcaaaacgagtaaagcccacaggatccattcttccccctcagttattaaattccccataccttcatgaccagaagagaaaggaacaacagaaagataaacagacacagaatgatctggttacaggagctaatcttatggatattatcagaaaacatgataaaagtaattctcagaaatgattttctctgccacttgaatatttttttttattgtatatagtcagcaaaaaattatggtttgcataaatggaaatgtacatgaattttaaaaattttaagatatttttaatttaataaaatttatataactatattgtatttatttcccttaattcttataaattaaaaacatcagaaaatgaattattaaataaaagacagtgttttcttttttggaaaa

SEQ ID NO: 164702 - DNA, 2634 bp, Homo sapiens
gtttttgggcccaacgggcagaagtgcccctcccttttacactcacacttcccactttctaagggtgccaggcccccgcgccgccctcctgcgttctttccggacggtccaacgtcttttccaccagtcccagcccatgtcgattacgtaaattctgtccaagaggattcccatacgtgcccctccgtccagaactcgcccagcccggaccagttccgagatttaccaccagcccagagctgggcgggggcgtggaaaacgcgaggagccttcccgcccctctccttctccctccctccctcccaagccactgccggctcccagccgagctccgcccccgcggtggccccgcctccccgccgcccggaaagcgggctgcggccccctcccaaaacccggggaagtggattctactctacgctccgctccgctccgctccgcaccaccaaccccgggccgcagtcctgacgagcgggtcagggcttgtcgggcggaagcctggcctggagcctggaagggggagacggcccgagcgggagcgggagcggacgcggcctcagtcctgcgcggaatattgaaggatgtttgttccaagatctctaaaaatcaagaggaatgctaatgatgatggcaaaagttgtgtggctaagataattaaaccagacccagaagaccttcagttggacaaaagcagagatgttcccgttgatgctgtagctacagaagcagccacaatagacaggcacatcagcgaatcatgccctttccccagcccaggtggccagttggcagaggttcattcagtaagtcccgagcagggtgcgaaggacagccatccttctgaagagcccgttaagtcattttccaaaacacagcgctgggcagaaccaggggaacccatctgtgttgtctgtggtcgttatggagagtatatctgtgataagacagatgaagatgtgtgtagtttggagtgtaaagcgaaacatcttctacaagttaaggaaaaggaagagaaatcaaaactcagcaatccacagaaggctgattctgagccagagtctccactgaatgcttcctatgtctacaaagagcacccctttattttgaaccttcaggaagaccagattgaaaatcttaaacagcagctgggaattttagttcaagggcaagaagtcaccaggcccattattgactttgaacattgtagtctccctgaggtcttaaatcacaacttgaagaaatcaggctatgaggtgccaactcccattcaaatgcagatgattcctgtgggacttctgggaagagacattctggccagtgcagatactggctcaggaaaaacagctgcttttcttcttcctgttatcatgcgagctttattcgagagcaaaactccatctgcgctcattcttacaccaaccagagagttagccattcagatagagagacaagctaaagaattgatgagtggcctgccacgcatgaaaactgtgcttcttgtagggggcttacccttacccccacagctttatcgtctgcaacaacatgttaaggttatcatagcaacccctgggcgacttctggatataataaagcagagctctgtagaactctgtggtgtaaagattgtggtagtagatgaagctgataccatgttaaagatgggttttcaacaacaagtgcttgacattttggaaaacattcctaatgattgtcagaccattttggtttcagccacaattccaactagcatagaacagctagcaagccagcttctgcataatcctgtgagaattatcactggagaaaagaacctaccttgtgccaatgtacgtcagattattttgtgggtagaagacccagccaaaaagaaaaaattatttgaaattttaaatgataagaaactctttaagcctccagtgttagtatttgtggactgcaaactaggagcagatcttttgagtgaagccgttcagaaaatcacagggctgaaaagcatatctatacattcggagaagtcgcaaatagaaaggaaaaacatattgaagggattacttgaaggagactatgaagttgtagtgagcacaggagtcttgggacgaggcctagacttgatcagtgtcaggctggttgtcaattttgatatgccttcaagtatggatgagtatgtccatcagctgaatattatttgggttgtgcccttctctggaattaatatcaacgcatctcttattgccttgttatacagtctactcaccacaatcaatatgaagtttactccataaacagaggtatggtacaagaggtaacgtgtcatccaaggtgactttcctggcagccaccagtaaactgactccggacagataggactcttttgttgccgccaaggcatacttacaatgacctcagaggctctagggccacagtgtgaaaaccaaccaatggataattaagtaaacacagttctcttgttctactgttagtgtgagaacctattttatattttataatgtgttgcacgtgtgatgatataggacaaaattacaaataaagcataagacgagtgtttatttttgtaatgtttacaaatagtaacttacaaataaattttagctttgaaaaatttgcacatca

SEQ ID NO: 164703 - DNA, 2608 bp, Homo sapiens
gtttttgggcccaacgggcagaagtgcccctcccttttacactcacacttcccactttctaagggtgccaggcccccgcgccgccctcctgcgttctttccggacggtccaacgtcttttccaccagtcccagcccatgtcgattacgtaaattctgtccaagaggattcccatacgtgcccctccgtccagaactcgcccagcccggaccagttccgagatttaccaccagcccagagctgggcgggggcgtggaaaacgcgaggagccttcccgcccctctccttctccctccctccctcccaagccactgccggctcccagccgagctccgcccccgcggtggccccgcctccccgccgcccggaaagcgggctgcggccccctcccaaaacccggggaagtggattctactctacgctccgctccgctccgctccgcaccaccaaccccgggccgcagtcctgacgagcgggtcagggcttgtcgggcggaagcctggcctggagcctggaagggggagacggcccgagcgggagcgggagcggacgcggcctcagtcctgcgcggaatattgaaggatgtttgttccaagatctctaaaaatcaagaggaatgctaatgatgatggcaaaagttgtgtggctaagataattaaaccagacccagaagaccttcagttggacaaaagcagagatgttcccgttgatgctgtagctacagaagcagccacaatagacaggcacatcagcgaatcatgccctttccccagcccaggtggccagttggcagaggttcattcagtaagtcccgagcagggtgcgaaggacagccatccttctgaagagcccgttaagtcattttccaaaacacagcgctgggcagaaccaggggaacccatctgtgttgtctgtggtcgttatggagagtatatctgtgataagacagatgaagatgtgtgtagtttggagtgtaaagcgaaacatcttctacaagttaaggaaaaggaagagaaatcaaaactcagcaatccacagaaggctgattctgagccagagtctccactgaatgcttcctatgtctacaaagagcacccctttattttgaaccttcaggaagaccagattgcccattattgactttgaacattgtagtctccctgaggtcttaaatcacaacttgaagaaatcaggctatgaggtgccaactcccattcaaatgcagatgattcctgtgggacttctgggaagagacattctggccagtgcagatactggctcaggaaaaacagctgcttttcttcttcctgttatcatgcgagctttattcgagagcaaaactccatctgcgctcattcttacaccaaccagagagttagccattcagatagagagacaagctaaagaattgatgagtggcctgccacgcatgaaaactgtgcttcttgtagggggcttacccttacccccacagctttatcgtctgcaacaacatgttaaggttatcatagcaacccctgggcgacttctggatataataaagcagagctctgtagaactctgtggtgtaaagattgtggtagtagatgaagctgataccatgttaaagatgggttttcaacaacaagtgcttgacattttggaaaacattcctaatgattgtcagaccattttggtttcagccacaattccaactagcatagaacagctagcaagccagcttctgcataatcctgtgagaattatcactggagaaaagaacctaccttgtgccaatgtacgtcagattattttgtgggtagaagacccagccaaaaagaaaaaattatttgaaattttaaatgataagaaactctttaagcctccagtgttagtatttgtggactgcaaactaggagcagatcttttgagtgaagccgttcagaaaatcacagggctgaaaagcatatctatacattcggagaagtcgcaaatagaaaggaaaaacatattgaagggattacttgaaggagactatgaagttgtagtgagcacaggagtcttgggacgaggcctagacttgatcagtgtcaggctggttgtcaattttgatatgccttcaagtatggatgagtatgtccatcagattggaagagtaggaagattaggtcaaaatggaacagcgattactttcatcaataataattcaaaaagactcttctgggatattgcaaaacgagtaaagcccacaggatccattcttccccctcagttattaaattccccataccttcatgaccagaagagaaaggaacaacagaaagataaacagacacagaatgatctggttacaggagctaatcttatggatattatcagaaaacatgataaaagtaattctcagaaatgattttctctgccacttgaatatttttttttattgtatatagtcagcaaaaaattatggtttgcataaatggaaatgtacatgaattttaaaaattttaagatatttttaatttaataaaatttatataactatattgtatttatttcccttaattcttataaattaaaaacatcagaaaatgaattattaaataaaagacagtgttttcttttttggaaaa

SEQ ID NO: 164704 - DNA, 162 bp, Homo sapiens
taatttagtataaacatatttttccagttctcttgacattgtggtatagttttctatttaggaatttttaatttttatattgttaattatatcagtcttttttgggggtggttctgggttttaatgtcaaacaagactaactttaatacaattttattttag

SEQ ID NO: 164705 - DNA, 698 bp, Homo sapiens
gtttttgggcccaacgggcagaagtgcccctcccttttacactcacacttcccactttctaagggtgccaggcccccgcgccgccctcctgcgttctttccggacggtccaacgtcttttccaccagtcccagcccatgtcgattacgtaaattctgtccaagaggattcccatacgtgcccctccgtccagaactcgcccagcccggaccagttccgagatttaccaccagcccagagctgggcgggggcgtggaaaacgcgaggagccttcccgcccctctccttctccctccctccctcccaagccactgccggctcccagccgagctccgcccccgcggtggccccgcctccccgccgcccggaaagcgggctgcggccccctcccaaaacccggggaagtggattctactctacgctccgctccgctccgctccgcaccaccaaccccgggccgcagtcctgacgagcgggtcagggcttgtcgggcggaagcctggcctggagcctggaagggggagacggcccgagcgggagcgggagcggacgcggcctcagtcctgcgcgggtgagcgtgccccggaagcttgggcccctggccgccctggtgccccttctccgggacctggggcgctaggccgcggcggcagaactggtgcccctgcgcggccttcctcccatccttacagttccccg

SEQ ID NO: 164706 - DNA, 2743 bp, Homo sapiens
gtttttgggcccaacgggcagaagtgcccctcccttttacactcacacttcccactttctaagggtgccaggcccccgcgccgccctcctgcgttctttccggacggtccaacgtcttttccaccagtcccagcccatgtcgattacgtaaattctgtccaagaggattcccatacgtgcccctccgtccagaactcgcccagcccggaccagttccgagatttaccaccagcccagagctgggcgggggcgtggaaaacgcgaggagccttcccgcccctctccttctccctccctccctcccaagccactgccggctcccagccgagctccgcccccgcggtggccccgcctccccgccgcccggaaagcgggctgcggccccctcccaaaacccggggaagtggattctactctacgctccgctccgctccgctccgcaccaccaaccccgggccgcagtcctgacgagcgggtcagggcttgtcgggcggaagcctggcctggagcctggaagggggagacggcccgagcgggagcgggagcggacgcggcctcagtcctgcgcggaatattgaaggatgtttgttccaagatctctaaaaatcaagaggaatgctaatgatgatggcaaaagttgtgtggctaagataattaaaccagacccagaagaccttcagttggacaaaagcagagatgttcccgttgatgctgtagctacagaagcagccacaatagacaggcacatcagcgaatcatgccctttccccagcccaggtggccagttggcagaggttcattcagtaagtcccgagcagggtgcgaaggacagccatccttctgaagagcccgttaagtcattttccaaaacacagcgctgggcagaaccaggggaacccatctgtgttgtctgtggtcgttatggagagtatatctgtgataagacagatgaagatgtgtgtagtttggagtgtaaagcgaaacatcttctacaagttaaggaaaaggaagagaaatcaaaactcagcaatccacagaaggctgattctgagccagagtctccactgaatgcttcctatgtctacaaagagcacccctttattttgaaccttcaggaagaccagattgaaaatcttaaacagcagctgggaattttagttcaagggcaagaagtcaccaggcccattattgactttgaacattgtagtctccctgaggtcttaaatcacaacttgaagaaatcaggctatgaggtgccaactcccattcaaatgcagatgattcctgtgggacttctgggaagagacattctggccagtgcagatactggctcaggaaaaacagctgcttttcttcttcctgttatcatgcgagctttattcgagagcaaaactccatctgcgctcattcttacaccaaccagagagttagccattcagatagagagacaagctaaagaattgatgagtggcctgccacgcatgaaaactgtgcttcttgtagggggcttacccttacccccacagctttatcgtctgcaacaacatgttaaggttatcatagcaacccctgggcgacttctggatataataaagcagagctctgtagaactctgtggtgtaaagattgtggtagtagatgaagctgataccatgttaaagatgggttttcaacaacaagtgcttgacattttggaaaacattcctaatgattgtcagaccattttggtttcagccacaattccaactagcatagaacagctagcaagccagcttctgcataatcctgtgagaattatcactggagaaaagaacctaccttgtgccaatgtacgtcagattattttgtgggtagaagacccagccaaaaagaaaaaattatttgaaattttaaatgataagaaactctttaagcctccagtgttagtatttgtggactgcaaactaggagcagatcttttgagtgaagccgttcagaaaatcacagggctgaaaagcatatctatacattcggagaagtcgcaaatagaaaggaaaaacatattgaagggattacttgaaggagactatgaagttgtagtgagcacaggagtcttgggacgaggcctagacttgatcagtgtcaggctggttgtcaattttgatatgccttcaagtatggatgagtatgtccatcagattggaagagtaggaagattaggtcaaaatggaacagcgattactttcatcaataataattcaaaaagactcttctgggatattgcaaaacgagtaaagcccacaggatccattcttccccctcagttattaaattccccataccttcatgaccagaagagaaaggaacaacagaaagataaacagacacagaatgatctggttacaggagctaatcttatggatattatcagaaaacatgataaaagtaattctcagaaatgattttctctgccacttgaatatttttttttattgtatatagtcagcaaaaaattatggtttgcataaatggaaatgtacatgaattttaaaaattttaagatatttttaatttaataaaatttatataactatattgtatttattccttatctataattaactcgaacgagaaaaaaaaaaaaaaatgtgggggcggcggaagttaaacatggtgggggggccgaggtatgaaaggcaggtgcgagaacgcgggaaggggggtgtcaaaagggggggggtgaaacagggggggagtaaggggg

SEQ ID NO: 164707 - DNA, 1747 bp, Homo sapiens
gtttttgggcccaacgggcagaagtgcccctcccttttacactcacacttcccactttctaagggtgccaggcccccgcgccgccctcctgcgttctttccggacggtccaacgtcttttccaccagtcccagcccatgtcgattacgtaaattctgtccaagaggattcccatacgtgcccctccgtccagaactcgcccagcccggaccagttccgagatttaccaccagcccagagctgggcgggggcgtggaaaacgcgaggagccttcccgcccctctccttctccctccctccctcccaagccactgccggctcccagccgagctccgcccccgcggtggccccgcctccccgccgcccggaaagcgggctgcggccccctcccaaaacccggggaagtggattctactctacgctccgctccgctccgctccgcaccaccaaccccgggccgcagtcctgacgagcgggtcagggcttgtcgggcggaagcctggcctggagcctggaagggggagacggcccgagcgggagcgggagcggacgcggcctcagtcctgcgcggaatattgaaggatgtttgttccaagatctctaaaaatcaagaggaatgctaatgatgatggcaaaagttgtgtggctaagataattaaaccagacccagaagaccttcagttggacaaaagcagagatgttcccgttgatgctgtagctacagaagcagccacaatagacaggcacatcagcgaatcatgccctttccccagcccaggtggccagttggcagaggttcattcagtaagtcccgagcagggtgcgaaggacagccatccttctgaagagcccgttaagtcattttccaaaacacagcgctgggcagaaccaggggaacccatctgtgttgtctgtggtcgttatggagagtatatctgtgataagacagatgaagatgtgtgtagtttggagtgtaaagcgaaacatcttctacaagttaaggaaaaggaagagaaatcaaaactcagcaatccacagaaggctgattctgagccagagtctccactgaatgcttcctatgtctacaaagagcacccctttattttgaaccttcaggaagaccagattgaaaatcttaaacagcagctgggaattttagttcaagggcaagaagtcaccaggcccattattgactttgaacattgtagtctccctgaggtcttaaatcacaacttgaagaaatcaggctatgaggtgccaactcccattcaaatgcagatgattcctgtgggacttctgggaagagacattctggccagtgcagatactggctcaggaaaaacagctgcttttcttcttcctgttatcatgcgagctttattcgagagcaaaactccatctgcgctcattcttacaccaaccagagagttagccattcagatagagagacaagctaaagaattgatgagtggcctgccacgcatgaaaactgtgcttcttgtagggggcttacccttacccccacagctttatcgtctgcaacaacatgttaaggttatcatagcaacccctgggcgacttctggatataataaagcagagctctgtagaactctgtggtgtaaagattgtggtagtagatgaagtaagtaaggggtctaaaaccggtccgtatttctccattctgcgagcgacctcataaccacgcgtggcaaccgtcttcccccggggtagccggagcgccggctc

SEQ ID NO: 164708 - DNA, 521 bp, Homo sapiens
ttcacttatgaggccaaccctgaccactctacttaatactgccatctgtccccattcccaccatgctcatttctttctttctttttgaaacaaggtcttgctttattgcccaggctggagtacactggtgcaatcacagctcacagcaacttcaacctcccaggcttaaacaatcctcccgcctcagccaccctaggaactgagactacagctgcatgccacaacacatggcttttttttttttttttttttgagacggagtctcggtcgcccaggctgaagtgtaagggtgcaatcttggctcactgcaatgtctgccttttgggttcaagtgattctctgcctcccgagtagctgggattacaggcacccaccaccacacctggctaatgtttgtatttttagtagaaatggggtttcaccatcttggctaggctggtcttgaacttctgacctcgtgatccaccctcctcggcctcccaaagtgctgggattacaggcatgagccactgcgtctggcc

SEQ ID NO: 164709 - DNA, 587 bp, Homo sapiens
tagcctcattttacagaaaaggaaataggttcagagaggttgtcttctgccccaagtcacacagacactgggcagcacataaggagttccatctgagcagctccttggagaggggtggggtcctggcaggggaggcacagagaaaggtcttgattacccccagatcttggaccccacatctgctgagctcacctggtcttggagagctcctctgaggtggcctgacctctctgcagcccagagatggccaggggacagacacccgaacaaggaagggggttggagagacttgagggcatttctcttttatctgatggtggagagcaaatgggaggaaaacgctcggtgttatcgtggggccaatgagagccttaagatacaggcagtgaatttcagccagggccctggtgatttaagatgcatcacttcccttagtaaccatgccaagcagatgtcagggacatcttgatgagggatgaagccatcggtgccaataaaacatttttctattagccacgctcaggtcagccgcctgctgagccacaggggttgctctgacaggaccttcatccttcggaggtcgggcc

SEQ ID NO: 164710 - DNA, 184 bp, Homo sapiens
tttgggaacctcagggcaaattcacccacatggaacagtttcttttgctctgcagaaacttgagagacctaaatctttaggaagggtgggagcagagcccagatatggttcacagaaaggaagtattcagctgtgtctgctaatactaaatgaccagtcctgctcatcctgaggagacaaggaa

SEQ ID NO: 164711 - DNA, 353 bp, Homo sapiens
tttgctgtatcccataggttttggtatgttgtgtttctgttttcatttgtttcaagaaatttttaaatttccttcttaattttttcattgacctattggttgttccagagcatattatttaatttctgtgtatttgcacagtttccaaagtccttcctgttactgatttctagttttattctgctgtggtctgaaaaaatatttgatgttattttgatctttaaaaatttgttgagacttgttttgtagcctaacatatggtttatcctgaagaacacttcaagataagaaaaacgtgtattttgcagctgttggatgtgatgttctgtaaatgtctgctagatccatttgat

SEQ ID NO: 164712 - DNA, 240 bp, Homo sapiens
taagcaatgtttctgtagatccattcttagaaattataagtgttttatcaaaatatatgtgcactataaatatatacaagtgtcactaaattactctgcaacaacataaagataaatgagaaaatgtaaagagtggttaagttctaggcttatgatcttgtaagtatctgatcaactctgtaaagaatcagaaaatcttagctataattctagcttacaacactaaacaccaatgcaaca

SEQ ID NO: 164713 - DNA, 708 bp, Homo sapiens
  misc_feature (1)..(3): n is a, c, g, or t
nnnaggttttaatttgctagacaaagagaactcaagcagtgctgtctaggagtgttatgtaagctagattggactttagagtcaggagaccatgcgggaagatactgtgtgataagggcctgaaacatgttggttacagtgagactagaaatgggataaatccagagctgtttcaccagtagacttgcctgaatatcctgtctgactgattatggatcagaaagaaaagaaggggtgatgggaaacaagcctagattgactagagaaacctagaaatagaaaaatcgggaaggcaaagtgatttggatgataatgccatatattcagttgtccctggtggccagatattatagtatagatattatacaggcaaagaagaacagagggatagagtgtgaaggtacagattttgagtttaagcacattagggggcttagtgttctggatgaagaaaacatataaaagttattgtatgttaggtattgtttgcaaaagagtagaaaatggagaaataacccagtgggttaaagaagaaacagactaaataaacaaacctgagtaagttgttcctaaattttattttagaggcaattcctcattttgctttagttttctcaattattgcctcacttttctgtttctttctctgtcagcatacatggaaaaaggagttaattttagattcaaaacaaaaactggaaaaaaaaa

SEQ ID NO: 164714 - DNA, 550 bp, Homo sapiens
tggtaaagaacattttcaggaatacgccgtagggttacataattggaggggaagttacgtggagggatgtggcagcaaaggaggggctgtgtattttgacccaggccagtgagagcaatgggtgccatcaaggggctgctccctgcgtcccccagtgatggacgtaactcagtgtgaagctctctctactgctcccagcagcccccgccaaccaattcatgttggccccaaagctgaaatgtgcatccctgctctactgcaatggagagccactgaagggctgtgcatgaggatggccaagacggtaactgtagttttagaagatcacagacttagggagactcgacacagggtggcttggaaaggacgagagcggacacgccttgccagctgaggcgcatggatttcccacaaggctgagagcaggaccctggcctcctggaagccaagcagcgatggggttgagtgagacaggcactgccccctcactcagacgcgcactgaatcgtcctctggctgcacatgacaactgcggccacttccccttgtt

SEQ ID NO: 164715 - DNA, 227 bp, Homo sapiens
ttgtacttttcagtagggatgcaaccaaaccaatcccaattacacagtgtcactctgtaaaataatttaagtaaatgactctatagtcgccttacaaaacatagcagaatgtatccagcagaggatagtggttaagaacacagatcttggaactagactatctggtttcagatcccagtcctaccacttagtagatgtgtaaacacaggcaccttactttagaggag

SEQ ID NO: 164716 - DNA, 213 bp, Homo sapiens
aggtaattcctagcacagaagagctgtgccaggagagggtgccttccgtgatgtctgttaggctagtcggagagcagtggctttattatactttgtgttcccagagccaggatcaatgcctagcaccttgcattcagtagtttcatgacactgaggagattctagagggattagtaggagttgggaaagggggaagatggttttgacacaccc

SEQ ID NO: 164717 - DNA, 1366 bp, Homo sapiens
ctaagaatagacgtccaaagccacacaaaggaaggtgttatagaaaaacagaggctgggcacagtggctcaagcctctaatcccagcactttgggaggccgaggtgggtggatcacgaggtcaggagatcgagaccatcctggctaacacggtgaaaccccgtttctactaaaaatacaaaaaattagccaggcgcagtggtgggcacctgtagtcccagctactggggaggctgaggcaggagaatggcgtgaacctgggaggcggagcttgcagtgagccgagatggagccaccgcactctagcctgggcgacagagagaaactctgtctcaacaaaaaaagaaaagaaaaacagagcaactgggtgattgtattgaaaggaagggtctttggaaccttgattgacaagttctaccagttgcagcgaaggaggctttccattgagttatgtgctcatgacattcttagtcatggactgacttaactttcttgatcttaaataagtaaatcctttctttcttttctccctgttgtgttttcttccccactcatttgcccttcctctctctttcttataggtttgatgggatggaaattttatattaccagagtacaaaagtgggcttatatcttttcacaaatagaaggcctatctcaatggtaaagctactggttggaggtagtgatacatggcgtactctattctgttaaggtctagaagtcttcataggaaggataagtccacatgaggttaatcgcatacttcagattcaatattgagcttggttccatgcagtagaagaaggctgatgtagtgaaaagagaacagggtttagggtcaagccagcctgagttcacaaatcatctctgtcattctttaattgtgtgactgaaatcacataattagccagtacaagataagccttagtttcttcatttgccaactgagatactaatacagaccttgtgaggattaagagcaggcatgggatgcaggtgagcacttactcattctacagacatttattgagtactgctctgttccaggcatatttcaggacaggacgttaaaatcaaatatgggctggacacagtggctcaagcctgtaatcccagcactttgggaggctgaggcaggaggatcacttgaggccaggaatttgagaccagcctgggcagcatggtaaaacctcgtctctattaaaaaatacaaaaattagccatgtgttttggctcatgcttgtaatcccatctactcaggaggctgagatatgagaactgcttgaacccaggaggtggagtttgcagtgagctgagattgctccactgtactccagcctgggtgacagaatgggactctgtct

SEQ ID NO: 164718 - DNA, 116 bp, Homo sapiens
aggttgaaagatcttctaagcacacatgaaagaaacagcagggccaagactactttgaacttactgcatacgattcctttcatataagatgtgcttgacaaacattaattaagtct

SEQ ID NO: 164719 - DNA, 481 bp, Homo sapiens
cctcaatcccaagcaatcattgctctgctttttttcctgtgaattagaatacccttttctagagtttcacgtcagtgaagtcgtaccgtaggtactctgtgcttagcttctttcacttggcatgtttttgagatgcattcatattattgcatgtaccaatggttcattccttccactccccgagtggtgttttgttttatggatgtaccacactttgcttatgaatacatttactctactaaatgtatagttttggttgttatgaataccgctatgaattcatgtataagccttcatatagacacatttttattgttttggtgtgtattcctttgattattattcctttattaactcattaaaagtttgaaaactttttcaagaatgttaactttttttgtttttgtgagttctatcttttgtccgtgttttattttgtggttttatgttttctatgttttaattattgagatagtctaat

SEQ ID NO: 164720 - DNA, 184 bp, Homo sapiens
ctcgtgatcaggtattatcctctgattaataccatataccatgtcttatcagtggtccctgtctcccttcttgtacaatccagaggaatatttttatcaactattttgtaaatgcaagttttttagtagctctagaaacatttttaagaagggaatctcacctcatcccattttttaagtgtaa

SEQ ID NO: 164721 - DNA, 380 bp, Homo sapiens
cgtttagattcctattgtgatgtctttgcaccataccaggtgccacttcaaaagaagggtagctgctagtgatgttatatccctctttattttcagcgaaatctcagcttgaatcttacatggctcttacatagaatcaacagaagtgcttttggaattgcaatttataaaaaacatgtttgtgtactagagtgaatgtgatggcttatcctaggatgtggcagaaaatgacttcaccctcaagttctatattaaatacatagcttctcagaaagcacctgaccccatctgtgaatcacgtcctgagcttcactattttgaaaatattaccatatttcatatttgctaagttatctaattaggtatgaattctgtgagaa

SEQ ID NO: 164722 - DNA, 286 bp, Homo sapiens
atatgcacctcaacaaacacacctaactcataagtgacagcctgacttacaaagtgaatctctgccttcaaaagactcatgcttatacatgtgacagcgtgccccatgtctactgcctctccatcacagactttctccattcatttgtttgaaatccaaagacaaacgccgggcctacctaaagccacaatcagcccagattagattagaaaggtcacctgtgttcctttctcttccattaggaaagatgtactgcttctcaacaaagtatttgctcatcctgccc

SEQ ID NO: 164723 - DNA, 220 bp, Homo sapiens
cagagctagaccctgtctcttaaaaaataatgataaatctttggaaataaaaatggaaaaaattaaattgagataattctaatgaaaattgtccaaacaatttcaagggaaatctttcagtattcataaaatatgtattacatatcttcagcacttctagagcaagcatatatagaaaccttttttgaatttttctgtaaagagagctagttcagaatat

SEQ ID NO: 164724 - DNA, 530 bp, Homo sapiens
cctgtaatcccagctacttgggaggctgaggcaggagaattgcttgaacctgggaggtggaggttgcagtgagccgagatcatgccattgctctccagcctggacaacgtgaaacttcgtttcaaaaaaaaagaaaggaaggaaggaaggaaattcaatccaaagatttataaaacaataaatggaaggttctagtgtagagtgagaaacagaagcaatttagcattaagccatatgctattgattaataagagaatacatgtgtcctagctcatatgttgtctaaggatccatataataagaaaaaatgtgatgttttggtatgctttaaggtttcttttcagcagtcatgcaagaatgggataacaattttgtaattatggcttgccttgagtaagcagcttattgcattatggtatgacacaagtacctgcttgtctcaaaatatccactattgacttgacctaatatttgaaaatctcacaattaataaacatatggggttatgacattaaatgcttaagtagtat

SEQ ID NO: 164725 - DNA, 92 bp, Homo sapiens
ggccccctcccccatcaccacacccagcccccaaacgctaggcgccgggtcccggccgggacgaaagcggccggagagaggcaaaccgcccg

SEQ ID NO: 164726 - DNA, 576 bp, Homo sapiens
gataaaattgacaaacctttatacctacaatttttaaggccaaataccttaatgtgaaaattttaaaaaaggaaaaaaaaacatatttgcagtgcataccattgtgtttagaattatactctttataatttgaagatatattataaatgattgaggaaagagtaaataaatccataggagaaaagggaaagaacaggaataaatagtttgaccaaaaaaaaaaaaattacatctgaacaaatgcttagaagcatccataattttatattaaaattaaaacaactgtgaaataccattttaactttcatattcaccagaaaaattattgttgaagatgtggagaaatgaacattttcaagcaattttaacaggaatatacattgggatatttgcttgggagcataatttagaaatatctttccagtttttcaacatatatactatttgacctgacaatcccatatcaaggactctctcctatggatatgtctactgtgtaagcaaagatgcatgtccattgttattagtagtaacattctagaaatattttaaaaggctcattaatagaaaactgat

SEQ ID NO: 164727 - DNA, 447 bp, Homo sapiens
aataagttgtgacactgtgctgcttgacccacagaaaaggatgagaaaacttctaaactttcctttactggaaaattctataaatgttgtcatcaatctatattctgcagatagttaaaaccttttttttcctttaaatcaaagtgcacagaatttaacatgatatttgtgcaagagccaaagagataagaggtaaaaagtctattaaagagggatcaaaattcagtatttatgttagtacagggtacgtgagaaaaggggagggatgcacacacgaataatttcctattcgggaaacatgctaggcaaaacatagccggcttcctgtcaaatgaacaggggcacttatggttaaagcaccacatgtatttaatatgctatatttagtttttatcagtgaatgcaaatgaaagaaatattctgagatacttttatttctattttggg

SEQ ID NO: 164728 - DNA, 333 bp, Homo sapiens
aaggttggatacaacagatatctaactataaaggatcagttgcaaaaactatggtaaatcaatagaatgttaaacagtcattaaaaattatactgatactgcagttgagtcatgtgtaaattatactgaaaggtacttagtgacattgaaaaatgttttagaatattaactgtttttttaaaggttagaacatagtatgtacaatattaacccatttttataagcaataatatgtttatatttaagaaagacagtaaagatagtggattaggattttatttgcacttacatatttctgaattttcaataatatgtatgatgattaaaatgaga

SEQ ID NO: 164729 - DNA, 414 bp, Homo sapiens
gatgtttatatgagatactattggagtagttcacttgagcatttagtgataggtatgtagaggatgtatatcaaggtatagagaagtaacttatttaaggtcatacaacctataaacaattgagctcatatctctggcattaaagcctggatatagaacccccatcagaagatagggttcatttgttcctttaaggagctggagcttgggaggaaggagctacaatgtgcctggaaaaatttcatttctgtagtcttaaacagcatttgattcagtggagcagtctgtacttgaaagcttttttcttcattttgatttgtaatattatcatctactgcttttctctacttcactgactgtaccttttctgtgtcctgctcctcctcttcctgacatctacattctgaggccaag

SEQ ID NO: 164730 - DNA, 213 bp, Homo sapiens
caggagaatcgcttgaacctggcgggtggaggttgaagtaagccgagatcgcgccaccgtactccagcctgggcaacaaagctagactccatttccaaaaagaaaagaaaagaaaaaaagtccaaactataccatggcctataaggtcctggaaggtccagatttctttaacctgatctcggagtgtctctcttgctcactccatttcagcca

SEQ ID NO: 164731 - DNA, 510 bp, Homo sapiens
atttcagtatcagctgagactatgggggagctctgctgcggcacgtaacagctaacagcggttgtggcaggatgaggcctgacctttatggcaagatcatttatagaccttccttctgtcccagttagaatacgtcaatgtcacatctaacacactttcttcttagaaattcttggttatcaaaacaacttgagagaactgttatggtgaaaagaagcactggagttggcatttgagggtctgtttcagattctgctcttcatttaatgtctgtgtggcctttggcaattccgtttgcctaagtttcacttaactgttggtaacattaacagttgccttaagagtttagtgagtgtttgataaggcaaatatatatgtaaatgttcagatatctaggcacttaatgtcaattgaaaaggatttatttctaatattataacatctgctacaactttaaaaagctgttacataattaaatcgtgtcccgacttctcgctttgataccctgga

SEQ ID NO: 164732 - DNA, 213 bp, Homo sapiens
catatttcctcctctttatctcttgtatgctattatttttgagtagttgtttattaatgcctttatcactagattttaaatttgcttacacaacttattacttttattccccccagtgtcaaaaacagttttgtgatgtttaataaatgcttattgaatgaataaacaaatgaataaggagctacagatacaatcgtgatttttttggggggg

SEQ ID NO: 164733 - DNA, 177 bp, Homo sapiens
gcctaaaatgtttataataatgtacttgttttaccttctttatggagttgccctaaggatcaaaatcagctgaaaatgttacaaaatactttataaactcttagtacaataaaaatgttaagataatagtacagagaataacttggaagggcatgccagaagataaggcatgtaaaa

SEQ ID NO: 164734 - DNA, 347 bp, Homo sapiens
  misc_feature (2)..(2): n is a, c, g, or t
anccggacagaacacacccagcttagttcttttcttttcacataggcccaaaggttggatggggggtagcttaaagaactgattttccccctacccaggctgtactctggggtgggaggagccttttctggggaatgaggtcactcactggaccttgagcaagtcacactgctgctgcaggccaacgagcggggagtgctgcgctgtgcccgccgtcggtgccctgtgcatctcttcctcttggctgttctggagtagtgtcccttataataaccagtgataggaagctgagtgctttcctgagttctgtgcatcattccagctaatcatggagcctggggatgggg

SEQ ID NO: 164735 - DNA, 411 bp, Homo sapiens
tgaggcatgagcatttatctgtcagcttaacttgtgagaaacctggctgtcatgataagtgtctgtaatcaggagttaggcaaattaatattatttgcatttttttatgtctagaaaatatttataaacaaaaagccagtcatctgagactctaatgaaggaaggaagtcaagacaaggaagtgtttccttgtctcctcctgcttttgttgactgtgtgggtagccaggaaaggactacagtcttctttataggagggggatggcagcagaagcaacaggaccatgaaccaaggagaatgttctcacctgctgctgttggacctccaggccatgccatctgatgtgtataagaggatatggaaagatttaggttttttctttttgaagactagatatgcaaatgattgaaa

SEQ ID NO: 164736 - DNA, 435 bp, Homo sapiens
atggtttggctctgtgttcccatccaaatctcaccccattatccccacatgtcaaggacaggaccaggtggaggtaattggatcatgggggcagtttcccccatgctgttctcatgatagtgaatgaattctcatgacatctcatggttgcattaagcatctggcatttcccctgcttgcactcactccatcctgttgccctgtgaagaaggcacttgctttttgccttctaccatgactgcaagtttcctgaggcctcccaagcaatgtggaactgaaagtcaattacacttctttccttcataaatttcccagtcttgggcatttcttcatagcagtgtgagaacagactaatacacacacacaaacacatgcaaaaccaagggaaaaaatgaagtaggctgggcccggtggctcacgcctgtaatcccagca

SEQ ID NO: 164737 - DNA, 427 bp, Homo sapiens
ccagttcaccttagggaactgggggagcagaaagattttcctgaggctcttatctcaataaaggcaattggtaactttgctaatacatcctttatctatttctatattcattcttcttggggaatgcctgctagcaaatgtcatttggaaggtaaagataaaagctttcagagagtacagttgctggctctgaggaggttcctccagcacctgtgtataagcttcacaaggaattccttcttgttcacactctatgtagacggttccaggctgtgccctgctccacagtgcttctgactcagaacccagggtgaaagatgcacgctaacctcagacatgctcagacatggataaatcaagtttactcacttttcatttggtcaaagttaatggggcaaatatatttttctccagctacagggaagca

SEQ ID NO: 164738 - DNA, 117 bp, Homo sapiens
aatgacaatgaagtcaatgcaaattaaaatgaaatggtcttcatcaattatactaaaaaggaattaatgcccagtgctgtggagcattggtggggaggaggaagagcaccactaatg

SEQ ID NO: 164739 - DNA, 374 bp, Homo sapiens
ccctacctgcaaggtacccttaattctccagggagaaaccttttataaataaatgtcatgagtgctcatcccccgagttgaagcttatctgcagagatgcttcactccgggagagagggttggagttgccattgtgaaggcctgtgtgtgtagaggtaccatgctgccaccaggccatccctcttacagctgtgtggcatcctggaggcctgggtaggagacggagggtgccgcaagttctcttccagtgatggggagccacaggtggttttgtagggttcctgggtcttaggtggttatcaaaagcatttcacagacatatgtaagataaagaccctgtcctcaagcagctaaatgaatgaactagaacagtg

SEQ ID NO: 164740 - DNA, 404 bp, Homo sapiens
agcaaatggggtgatgctacacactttttttttttttttagctaatatgtacttatttatttgaattagttgaattgcttgcagtaaaaatgttatggactgaatgtgtccttttttttttttttttttttttttagttcaattgttcatccattttttatttgcttttataattgcctccttgttttggtatattgtaaaataatttaaataatgtatttataaatatgtataattatgatgtaaaataccgtgtgtatatgtatgtatgtgtgtttctgtatatgcacacacataaacggctttgcctagccaaggattttttttatctgtataaaactttttgtataaagtttgctttcaataacagtaatgtataataaaaccatgtaaagttttgttgt

SEQ ID NO: 164741 - DNA, 264 bp, Homo sapiens
aagcaaaaatgacaaaattttagcaagtaatgaaattagtggtaggtacaccagtcttcactgtatttttcttttcttttcttttttgagactgagtctcactctatcgcccaggctggagggcagtggcacgatcttggctcactgcaacctctgcctcccgggttcaagcaatgcctcagcttcccgagtagctgggattacaggtgcctgccaccacgcctggctaatttttgtatttttaatagagacgggatttccaac

SEQ ID NO: 164742 - DNA, 350 bp, Homo sapiens
gaggagactaatgacaaggggagggaaaaattctgcatgttacagatttaaaagcatattctctatcaattcatttacattaatgaaaatctggatttttttcatgagaaattatatatttctattagcccatattgattcagaaagaaggggaaaaacctgtagaaagccccatagaacttgtcataatagtctgggcagaagtatatgactgtcattccaaggcagtaacactttccataatttaataccctagtggataaacatttgaatttaaagtgtagatacattttggaaacactcaaccaactcaggaaacacatgtgctatggtgtcatcaggtcacactt

SEQ ID NO: 164743 - DNA, 270 bp, Homo sapiens
agaaagaaagacgcaagtgtggtggtgttcctgtagtcccagcttcttgggaggttgagatgtgaggattgcctgagtttaggaggtcaagtatgcagtgagccatgtttacacctctgtactccagcctggacaaaagagtgagaccccatcttttaaaagaaggagagaaaacggaatcagagggttctacctggtttggttttgtttgagacagggtcttgccctgttgcccaggctgcaccagctgagggttttggaacagcctac

SEQ ID NO: 164744 - DNA, 120 bp, Homo sapiens
ggtggtgtaattcagtctgcaatccaggagatggtgctctagagtacgggctggcatgcctcttttctgtttcagcgtgttggcagcagtgctctggggaagggggagaagtaggattgg

SEQ ID NO: 164745 - DNA, 711 bp, Homo sapiens
cttcattctccatttctttagacagtgtccattagttttctctaaaaccaatgggaaattagcatcctttcacttcctgccctgtaactccggccagaggtaagaagccaagctttatggtcattatattctttctttggtttatcaagacattctgctttcttctccactttcatttttagtccatcaaattgtaaaaacgtatacactatttgaataagcaatttttcaattacaagctgctgatttttttacacccaaaatgtgcgtatttgtgaaatacccacataattaaattaatgtattgtagacataataaaattacacacaaacagagcttttgaaatgataaaaatgttttcctacctgtcttcactgaatcacacacaccccctggggtataaactctaaattgaatacacacatttagatgaatagtcctcaatctttttagaattatgtttcctctgagagtcaaattaacattattcattctcagacaaaaatgttcacattttctcaggcaactcgcagttcagagatggccaaggaactcagatgctaagcatttagacattcaacattactggaattgtagacattgccaacttcagaatctcccaatcataaagtgagacatgaaacacagtggagacatttgacaagacataaccgacgccggtcgcgattcatacgcgccgtcagctgtta

SEQ ID NO: 164746 - DNA, 885 bp, Homo sapiens
cttcattctccatttctttagacagtgtccattagttttctctaaaaccaatgggaaattagcatcctttcacttcctgccctgtaactccggccagaggtaagaagccaagctttatggtcattatattctttctttggtttatcaagacattctgctttcttctccactttcatttttagtccatcaaattgtaaaaacgtatacactatttgaataagcaatttttcaattacaagctgctgatttttttacacccaaaatgtgcgtatttgtgaaatacccacataattaaattaatgtattgtagacataataaaattacacacaaacagagcttttgaaatgataaaaatgttttcctacctgtcttcactgaatcacacacaccccctggggtataaactctaaattgaatacacacatttagatgaatagtcctcaatctttttagaattatgtttcctctgagagtcaaattaacattattcattctcagacaaaaatgttcacattttctcaggcaactcgcagttcagagatggccaaggaactcagatgctaagcatttagacattcaacattactggaattgtagacattgccaacttcagaatctcccaatcataaagtgagacatgaaacacagtggagacatttgacaagacataaacagcatagtcaaattagccatgcttgattaaatatgtaataactcctttagataatctgtccaacaacagcatagttcaacaagagtcagatttcaaataattttctcatttccctccttctttgcctctcctctttttctgtcctgttctccacctcttctctctcgtttctccttcttcctcccagcactttttcattctccctccttcc

SEQ ID NO: 164747 - DNA, 696 bp, Homo sapiens
gtttaggacatgctaaatatatgttttccttttttctttctatttaaaaaaatctgagttgcagtcacattaacaggtcagtaacatagaggtttggttccctcatatgactttctgcatgtactttacatttttttcttgtttaaatgctaggcatattgtgtaccccacattggtttgtagccagctctatgtcatagggcccttaccctttacctatttattgttagtatcatgtccataaacaagccaatggctcagcatgaactgatgctaaagaaagctcatgcctgagtgataaattaagtgacctcagctatttctcttcagtgttgtgaaagttatttttaacagtaggtttcctggtagattctctaaccactcggtatttcacatggcccaacttggttaactcgactggttacggcaaatgctgataaaggcaagatcacaggtttgctccccatgaaaaccaataacttctcggagattaaaaaaaaaatctcccttctgtgaccacaagcagcatcactcatgcaaatgtcggaagagaggaattgggagtgagtgagagtctagcccagtgcaaatatttctactgttgaaaaaagaagtccaggcgcagtgactcacgcctgtcatcccaacattttgggaggccaaggtgggtggatcgcttgagcgagaccaacctag

SEQ ID NO: 164748 - DNA, 227 bp, Homo sapiens
tccagtaagtgttagtactgagccacagtggagtagagagggaaagtagtaacttgtgtcatatgtgattttagcatgaattcttttttcctttaacaatgccagaggagcccagagaatggggtgaatgtagcacaacttcagtgattgctagctgcagggtcacatgattatataagggaaatgtcaccgctgctgccaaagataagtgagccagagcagggcat

SEQ ID NO: 164749 - DNA, 107 bp, Homo sapiens
gaccagttagtaacagaactaggacctaagtatcctgttttctggttagtagtaataccagctatattgattcagatggcaatatccagacaatagctcccactcat

SEQ ID NO: 164750 - DNA, 552 bp, Homo sapiens
acaattccattgttgtgaacatcatagaatacttatacaacctagatggtatagcctactacacatgtaggccacatggtatatagcctattgctcctaggctacaaacctgtacagcatgttactgtatgaatactgtaggcagctgtaatacaatggtcagtatttgtgtatctaaacatagctaagcatagaaaaaggcatagtaaaaatacgatattatgatcttatgggaccaccatcatatatgcacccatcattgaccaaaatggcgttatgtggcacatgaccatatttcaagggcgaatggaatttaaagttctattttacatagaaaagaaggatgaaagtcagagtgcctgtgggggtagagaactggcctaacggaagaatggaagttagctacagaaatataatcaaggaatctggaccactgtggtatcagaagagtttaagtgaagagaccaaataccccaattatctaggaggtttcaagaaagaaaagagattgcaaatctgacaaatttcattccaaaagcagttaactgtcca

SEQ ID NO: 164751 - DNA, 401 bp, Homo sapiens
acaaagacagtgacaccaaaccgagctcaaatgttctctacgaggatgacataacctgtaaggtttctaagcagtgctcacattcgcgatacaggctctctagatatctatgccctatgtggagtcagcgcaccaagagtgtagcattttatttatttatttatttagaggcagagtctcactctgttgcccaggttggagtgcagtggtgcaatctcagctcactgcaacccctgccttccaggttcaagtgattctcctgcctcagcctcccaagtagctgggactacaggtgcatgccagcacaccttggttaatttttttatttttagtagagatggggtttcaccatgttggccaggctggtctccaactcctgacctcaactgatctgcccacct

SEQ ID NO: 164752 - DNA, 354 bp, Homo sapiens
tgacagccattgtgttagaatgaccacaaggtctgcagatcacagatgcaaagataagcaggagatgtaatagccaggtgtcagagcacccaaggaaaagtgctttggcattgcaataccctaaaatcagcagtagggaactaagaggaggccattgttaactcccggctctcatggttcatgagagaaccatgaactatgtgagaatgagtagcctgtgctgtaaggaactgaaagaaaaatggtttcttggtaaaacatcagtttcaaataagcaaggatatatggtgatggttgcctacaacaatgtaaggactgtaagggatacagtcaagaggattggcaggaatttga

SEQ ID NO: 164753 - DNA, 131 bp, Homo sapiens
gctggggtggttttggaaaaagcaacatttgggcaggaaaacagggataactattctcattttcgggccacaatttccaggctgcagaatggaacctttgctggggaaccatcctcttttaccccctattt

SEQ ID NO: 164754 - DNA, 262 bp, Homo sapiens
cactcttcatctctgtataattttttagtggtttctctaggaattacagtatatatatttaacttttcacagtttacttaaaattagtacctcaagtggaatgtagaaatcttactaccatataagtcccttgactctccattcttttttctttttgagatggagtttcactgtctcccccagctggagcgtagtggtgtgatcttggctcactgcaacctccgagaagaaatggagtttcaccgtgttagccaggcttatc

SEQ ID NO: 164755 - DNA, 425 bp, Homo sapiens
gcccaggctggtctcaaactcctggcctcaagcgatccttcctcttaggcctcccaaacaaaacactgggattacaggtgtgagccactgtgtctggccttgatatattgtttttaaatgaataaaatacttatttataaagaaaacctgttatatataaatagatgtcaaaatactaaaatgacaaatttgtgatacagaattatatgcttccttatcgatgcattaaatcaggtgtagtggcacgtcaaataatgtcatttgagagtaattatgactgaacaatattaatattgtaagatatctgtaatggcaggagagtgtgatctctcctggtaagtcaagttttgctaataccactgtgatttgttgccagtcaattgaaactgaaggaaatgctgaattagaggttaataaagatgtaa

SEQ ID NO: 164756 - DNA, 413 bp, Homo sapiens
tgtaagcctggaatttagtggggaggttcggactggcaatttgagtcagaaatcatctgtttgtaaagggcattcaaagcagtgagcttgtatcagatcatctgaagagtgtgtgtgaagaaagatgtggttgagctactgagctccaagttactctaacataaagaggtcaggaagaaaaacagaagctggaagctaagaagataaagaaggatatgcaggtgaaatgggaggacctatttaaataagcatgttttagaaggagttagtgctcaaaatgccagctgcatttgcagagtttaatttagatgaggattgagaattggccattgatttagcatggtggtcatttatttggactaaaaatggttttgttggaatgattggtctgaaattctgattcatatgggtta

SEQ ID NO: 164757 - DNA, 140 bp, Homo sapiens
tcacaacttgttttctgagattcatccacgttgttggcatgaactagttcttttttattgctaaatggtattctgttttgtgactagagcataatttgcttgtccgttctcccattaatggacattggggttgtttccag

SEQ ID NO: 164758 - DNA, 293 bp, Homo sapiens
ccattttatttatttttcattatattgtatgatctttgatgtcaaccaaattcctctagatgcattattatctggtgaaatcatactgagttaggaatgaagagtctggcatgccatttcataacatattgccatgctgcacagacctttttaaattcctctggttcatgttcttcattataaaattggcatgtgactgctgcacctatcttcttcatgctaacacagcaggttggaaagagattgtgtttgtgaaaatatttgagaaataaagggctaaatgcatgtgagtt

SEQ ID NO: 164759 - DNA, 507 bp, Homo sapiens
cctcgaacacatcataccccacactactaccatcttccagatatgcccctgcttctgtaccttctacctctatctcagttgtcagtgataccagctatccaggactctatggtggaaacctgggaatcattgattcctgcctttcatcaatctcctgtccaataactatcatagtctgctaattatttcatggtctcctaaatatttctcacatttttctgcatcttaactaccactgctgcaatttaagttctcatcagctttcccctagatcagtggtcttgaacctttttgacatcagggaccagttttgtggaagaaagattttccatgcaccggcatggtgggggtgggggtggtttcaggatgaaactgttctacctcagatcatcaggcattagattctcataaagagcgcacagcctagatcccttgcatgcgcagttcaccataggcttcatgctcctatgagaatccaatgagccactgatcttacaggaggcggag

SEQ ID NO: 164760 - DNA, 252 bp, Homo sapiens
ctcttctccactcatctcaagggaggggatggggaaggagcagagagtagctgaggaaggtagggagaggctaggctgtgtgccggaggagagagatttgtaagccattttggtaaggattttgagcagtttaggagggagcagggccagagactgtcacagagaagagaagagtagggtatttgggggaagtaatggaaatgattccctatggaattagagggtctgtgctactgttcatagaggagatgg

SEQ ID NO: 164761 - DNA, 507 bp, Homo sapiens
aggaggcagatgttgcagtgagccgagactgtgacactgcactacagcctgagtgactgagcaagactcagtctcaaagagacaaagaaaaagaaataaataaaatcataaatgcaattttaacatttagaaaacttactgggcacagctatggtcaatgactttaaaatatgaggagccagaccaggcatggtggatcatgcctgtaagcccagcactttgagaggctgaggtaggagaatcgcttgaggccaggagttcaacaccagcctagataacagagcgagatcctgtctctacaaaaaacgaaactagccaaatgcagtggcatgcacctgtactcccagctatgcaggaggctgagacaggagaatcccttgagcccagaagttcaaggttgtagtgagctatgatcatgccgctgtactacagcctgggtgacagagtgagaccctcactatactccagcctggatgacagagtgagaacctagctcaaaatagaaaa

SEQ ID NO: 164762 - DNA, 383 bp, Homo sapiens
ccgggctttaggattccttctgttttatttcccaagatgtgagtgtgacaggaaattttattttaaaacaatttatgatctacagacttactgacagaagatgttggtttaaaaaacaaagacagcgtcaatcttaagaaattgggtgcagctacactgatagtcaattgctgaagatatctcattcttattcatggagcttccatggagggttttttaacctattatgttttcaaggtctatacagtcttgctgccagtgggccattacccactgggattgagccagttaagatccttgcatagactcaacatcatctttaccaaaatgaaaacaatctcatgttgtcttttgaatctgtttgaagggagcagtatttttag

SEQ ID NO: 164763 - DNA, 337 bp, Homo sapiens
gaattaaatatttaactacacaatgtgtgatctctttttacagtaattcttaatgacagtaatttatgtctgatgtacattggcagtcatctaattttcttttttgtgctttttgtttatctgcctgaatgagaaccaccttttatgatcaagtgaatatatgccatgaaagaatgttcctaaaatagattcaaggtgtagcatactgttgttcaaacaactttcccgttaatttctacatatccagagggggaaaaaaacagcaatggttttctatccaggaaccattaaacataggagcttaaaatgcctattttttaatactaaaacttcttat

SEQ ID NO: 164764 - DNA, 258 bp, Homo sapiens
ccatgtacccccacgcccggctagcttttgtattttttgcagaaacggggtctggcaatattgctcaggctggaacaccatccttctgtgtggatacttgttcagtgcctgtcctcccgcttcccaggccctttgaaagggagcagcgcttggctggatgcgatggctcacgcctgttaatcccagcacttgtgagtggccaaggcaggcagaacacaagatcaggagatcaagaccatcctggccaacatggtgaaa

SEQ ID NO: 164765 - DNA, 196 bp, Homo sapiens
atgcattggggagtatagacacagactaccataacattaatgtcagttctttaacttatttgtaggatacaataattgcagcatttgtctctatttgattttctacatttaaaaaatgatggcactcttctttaagtgctgggcatgaaatatttaatattatgttccattgctcatatttacgattatgctgaac

SEQ ID NO: 164766 - DNA, 762 bp, Homo sapiens
caaaacttcatgcgctgttccatgacaaattttgatgattcagatttcaaggcaaattaaagcctcacaaaaagcaaaataggaaaaagaacagaagaagtactatttagattacatggattacccagtcttaggttctacgtacctgccagtccctacatgcagtactgtgttcccttggcactgccactttttaaagcagccattgacacactggaatgagtctagaggatagcagtcaggattttattaccatctctttgatttgagatatagtggaaggaacaacaaaagttaactgagagaactgaaattggaaaatagaataaagaaggggatgtggtaactttctttaaataattgtgcttattgaagaaaagtgaattttattctgtgatgctctagagagccaaggttggatccgtgggtggaaggcacaagaaggttcaaaataaaatgaaactttcaaatagtaagacttggagcaaaatgaaagcagctgtttgtgggatagccacaaattagaccatgtatgattagaccatgtgatgctgggctagaaatattgaagcaattcctccactggtgcaagctttatatagtagtcttaaaggcactcccttaccaccaaattgctagaaattttatgaatctgattactatagagacattatttccatttcaataaaaagtagattaagaagataattatgcaagatgtttgattgacattatacataagaaagccatttctactaagca

SEQ ID NO: 164767 - DNA, 546 bp, Homo sapiens
gtctagaaatgcaattaatttgtgtgtgtatgttgattttgtatcctgcaactttgccttgcaatgtttttgaccaatccctgcctcttttctgtcctgtgttggttccaagataggcaaacatagatgggtacctagcctcagtccttcagacagctccccagcaggttagaacagacaaacacagtaatttacaagtaaggtcagctctgcaccctccagaaccaggaacaagggtcccactctgggaacacaggctgctttctgcaagactgctacccagctgggggaagggataggacaaggacaaatgatgctttgctaccattataaagttgtcttttttgtaattcagcattttcttcattgctgtaaacctttgagtgttttccagaattctgacaatgttggttctgaccatttctgggtttttttttcatatgtttctgtggggggatgggcattttgagtttccaattttgccattttgctgatgtcctttttcaatagaaacttttaattgaaatataatctatataaaggggt

SEQ ID NO: 164768 - DNA, 387 bp, Homo sapiens
gcggggtcgctatggggaggtcatgcctgtgtaccggcgggacagccaccgagacgtgcaggctggcagccatgactaccctggtgagggcatctacctgctcaagttcgacaactcctactccctgctgcgcaacaagactctctacttccacatctactacaccagctgaaggactgctgggacaggggcaggctgtatttgctggctgaagcaggctgccagctggtgcctcttgtttgggataggcaagagccaaaggttcatggggggctgctgagcctcacaccctgtctggcatgcctgactgttggcccacgtagctttttccccttcttggcttctgcaggtggtggtgtagtgcccctgttctgtagtccctgactc

SEQ ID NO: 164769 - DNA, 310 bp, Homo sapiens
ggcctgtaatcccagctactcgggagcctgaggcaggagaaccacttggaccagggaggcagaagttgcagtgagctgagatcacgccactgcactccagcctgggtgacagagcgagactctgtctaaaacaaaacaaaacaaaacaaaacaaaacaaccacacaaatgtagctcaattaggataatttatggtcccagtcatgagcactccaccaggggtctgagggactgaagacatacctgggcaataacagaaagaacaagtcactctcggcacagcgactacacacaccctagagctgtggttc

SEQ ID NO: 164770 - DNA, 512 bp, Homo sapiens
cttatagtcattctgaactctactgacctgtctttcctcttcactcttgctacccttaagcaaagtcattgtcagcactacggttttcccaaacattcctccctaaactcttccacttctaagaatcatggatttcccttcaagtttcctttccatgaactaaatacattttttttttcttggccaatttctcagtcctactccctctctccaaatgctggcttcgtttgtctaactgccacaatgggtggctgtagtaatgtagtaatgaaggagaagaggatgttaaggcttctttcagtgacattaaaagctatggaaacacaagttatgatttttttcagttatattgaatagtcagcaaggctaactgaatttgcaaacaaaagaacagttcttcagtttatgagcaaaatatatctagaagttttgtactattagtgcagtgaaaaagtaactgttttttttagatggctgcagtgttcccagcattgagcccgtaactgtggcag

SEQ ID NO: 164771 - DNA, 441 bp, Homo sapiens
cccaaagtgaaaacacggctttttctgtaatgaatgctattatttctgttttcattggttgaatactctgcaactccttggacgaggggagcaatcattgtagttctagtcattcactgtccctctagaccattgttttgccatttttgcacagcttctgatttttcaaaaagtccttaccatctgttctctccccatttttattgctttttgtcttttgtcccattgctttatttgcttttgtctgatgacttccaggatccacatggatcagttttcttcttcattgcattctctagtatccagtacctcactctcatcagttatctttctctcttccatctacaccttcgctattgagtctttcttttcagactacaaatacagaggtcttgtctatcctaaaacaaataaaaattttctgccttttcactttgggct

SEQ ID NO: 164772 - DNA, 615 bp, Homo sapiens
tagaatgatttataatcctttgggtatatacccagtaatgggattgctgggtcagatggtatttctagctctggatccttgaagaattgccacactgtcttccacaatggttgaactaatttacactcccaccaacagtgtaaaatcgttcctatttctccacatcctctccagcatctgttgtttcctgacttttaaaagtttcatttctttgaagagtaatgatattgaactttttcccatgtctactgatccagtgacttttaaggtcccaggcacaattagtctgcagcaaagcaaatcaaaagaacaggtaaagaagacgacataccaggcaaggatggcaccttagttctacattttaaaaatttaataaagctctacacctattaaggtatccttgtgtttataatccatatatctttcacaaattttcatggggaagaaaaatagttgggagatgtcagatcccccctgtgaagctgggcagactccaccagactccaccatggcacttgggaggcattatataaacgtttgtggctaccacagagaccaaaaatggattgtgctgcctcttccctggtctatttcatagaggcactgggatgctgt

SEQ ID NO: 164773 - DNA, 844 bp, Homo sapiens
aacacagaaacctgagctgccctccctttccttagtttagtcatttccagcacagaaattgtaaccctgaataattactttcaaggactacactcaaacttcttaacttctctggctactctaaggaaaagctaaagagataatgtggtaaggaataaaaagtacatggagaaatttattttactgattgaactttagaaaataaagccttaggaaattcttaattcactaagattagtttggttacctagtttcaagaagtaactttagaaacaatacccactctctaaaagccagagggtttttttttcctttttaaaaaaaccttagtttatatgtatagccgtgttatgttgccagatacctagaaatccaaatgtctgttaaatcccaaatattggatttaacaatgcaaaatataaatattaatttcaacctctgttactttaagagctaacctgtattatgcctgggctaggaaaactttaaaaccctattatcatttattcatcagaatatttttcttgtgtgtgtcagaacagttggtagaaataaactttttttatttggaagtttgaagtttaattagaaagtcaagacaagctagaaagggggttaaattttttaaaaataataatgttatactttttatattatttcacataatcgatgcgggaaaccaagaatgtggtagacagaataataacactaattgctgacattattgacatttactgatttattcatagctctgctgtgcgcctcacatctattatctcttcaattctcccatcaatcctgtgaaataagtacgtttgtcacccccagctttaactaaagatgc

SEQ ID NO: 164774 - DNA, 183 bp, Homo sapiens
gttgctttgtgtgtgtgcgcgcgcgcatgtgtgtgtgtaaggggcagggtctctaagaaagaaagaaaaggaggcgagaggaggaaagaacctgtttcagtttcacaggctctggcaaggtgactgaggaagcgccaagccccttagcctctttgggctctggttacctcatcagtaacatta

SEQ ID NO: 164775 - DNA, 269 bp, Homo sapiens
ctggctgtctgagtattgattatagtctcccaagtctctctggacacaaatgaacaagtacctacagaggaaaaccctccaagaacaccaggagactgggcatgggggctcaggcctgtaatcctagcactttgagaggctgaggtgggaggattgcttgagtccaagagcccaagaccagcctgggcaacatggcaagaccttgtccctactggaaaaaaagaacagcagaaaattattttaagcttgatcaatacttactctttcag

SEQ ID NO: 164776 - DNA, 145 bp, Homo sapiens
cgatcatagagcatcccggtacgattctttgcactaaaaagtcaactaaaacaagccttccataataataacagaaatatgcacactgtagaaaattagagaatacagatgagcaaaaaatcttaaaacacttcatattcccatc

SEQ ID NO: 164777 - DNA, 376 bp, Homo sapiens
gagtgtttgtgttttatagctttccatttgtgcagcttcccaatatggatctcagatgggccatatctgtacaatcagggattttaagtgttacccgtccatgtttgcatctggatttgactatgggttgcaaaacctgggtttttgtgccatgtgaataattaagcactttaacaatgggaatgatgtttagattatcagatacccaaattccttttgctaactgagctttccgttcaaagggaatcacacaacgttgtgcataaggccttgggtctgaggctccccttgcttctgtgcataaaaggcccggtgtttacatgtctgttgagcagtgctgtgctggcgctgggaaggaggaggggtgttaatggtg

SEQ ID NO: 164778 - DNA, 470 bp, Homo sapiens
tgtgggccgctgcctaaaaggggtaagaggaagaaaggacagtgtgggtgcaactgagattggagagatgacggaaaaatcacaggggaccctctgaacagaaaccccagataatcttccctaatgtggctctttcctccctttctcattcactttcccttccagaaagctttccctgcacaaccccctctgtcttctgctgccttcccctgtagaacaatggagttaaagggacacagccaaagacattccctgatatcttcactttttggtcctttcccattggaaccagtgggggaaatgatggcatttctggttgattggttggcctgccctttctcccacccctcctttcccttcctcttcctcctcatcccatcccttcttccatttctctctttttaaattggcaaatagtctttccacctccatgttcctaaggattcttgaaatagaaagaatgtgttgga

SEQ ID NO: 164779 - DNA, 222 bp, Homo sapiens
gccatgttggccaagctggtttctaactcctgacctcaaatgatctgcccaccttggcctcccaaagtgctgggattacaggcatgacccactgtgccaggcccaatctcccattttcaaagcctggttcaacggccaatacagaacttcatttttctctaagacacttaactcttcccactgtatatcatagttacttacacattgcatctagtcttccta

SEQ ID NO: 164780 - DNA, 762 bp, Homo sapiens
  misc_feature (738)..(738): n is a, c, g, or t
attgctcgagcccaggagttagaggttgcagtgagctatgaccgcaccactgcgctccagcctgggcgatggaacgagactctgtctctaaaacaaaaacaaaacgaaaaagcaaagtcttgtcagaataacatttcctttttttgaggtagaagaaggaaatcctgtaactgggttgtagtaagacgtatgattgtttttcagtttatccttgtgaacatcctgggcaacaagagtgtaactccatttcaaaattaaaaaaaaaaaaaaaaaggaagaaagaacgaaaaaaagaagaaaagaaatttacatttaaggtagttaaatgaaagatgaacattaacttcttcacctactgattggacagtgctgataaagaatatttccagcatcatggaaagttttattggacagtgctgccctagagattctgattctgtaggtctggggtgttccagatttggcagtctctctagagatgacctatatagttggcagaattgtaactacttgattcttcaggttgtacctcctattaattccccactaaccctttgtttgatgagtggtttggttgaatataggattctagattggagattttctcttaattttaacatcattacttcgtggttttctagcttctattgttgctgttgaaaaatggatgccattctcattcctgatcctttgtctgtgctttcctccagcctggacatagtgggagactctgtctcnaaaggacaaccaaagaaacaagat

SEQ ID NO: 164781 - DNA, 283 bp, Homo sapiens
atttactgaggtaattgtggattcacacagtaagaaatactacagagagagcccgtgtaccctttccccattttcctccagtggtgacatcttgcacagctttaatagtacaatatcagagccaggatattgactttgatacaatccaccagtcttatttcgacttcccattttacctgtactcatttgtgtttgtgaagcattgcttttaaagtgtttaccttttagacatttttataaaatacaattttttatctgcataaaacatgtataatttgaatgg

SEQ ID NO: 164782 - DNA, 483 bp, Homo sapiens
agtagagcagtcatgcgggaggaggcactactgaaagtgcagctgacacagttgaaggagtcatttcaacaagtccaattagaaagagatgagtattctgaacatctaaaaggagagagggcccggtggcagcagaggatgagaaaaatgtcgcaggagatttgcacattaaagaaagagaagcagcaagatatgcgtcgggtagagaagctggagaggagcttgtcccaaatctcaaaagaccagatggctgaacccttgcccccggagcccccagcagtgccctctgaggtggagctgcagcacctgaggaaggaactagagagagtggcaggagagctccaggcccaggtcaaaaagaatcagcgcataagtctcctgaaccagcgacaagaagagaggattcaggagcaggaagagaggcttcggaagcaggaggagaggattcaggagcagcacaagagccttcagcagctggccaag

SEQ ID NO: 164783 - DNA, 298 bp, Homo sapiens
ggagtggattccctgggccggcccccttgctggtgtcctgcctgcttgacccccgttagctgccgccatcacagccacactctgacatccatcctgactatgggaagcatcaaatgaagatggccaggagcttcagaactcttaaaacctggtgcctgaaacagccaggaaattggagccagagcttaaaaaaaaaaaggaaataaacgagaagacgaaggccatcctgatgctcccccttgtgcacacagggcaggtggttggaggcatcttttctgcccctgagggtcccacctgc

SEQ ID NO: 164784 - DNA, 103 bp, Homo sapiens
tacaaacataggagcaaggtaacaatagtttaataaacatacattcattgttttgaggagactgagagaaaaggaccagaaataataaaccagagatcaaaca

SEQ ID NO: 164785 - DNA, 535 bp, Homo sapiens
tagatcctgtgttgacatttcatctctcctgatgtgtgctgactaaatagattccacttgttttcattttgtctatcaataaatgtttggatttcttgctgctgagaactcagttatggccatcggttttctatcttaacaattcaagaagagctttgttatctgggatgttgttagaacacaggataaaaccctattcacattgtcttgaggtgtcctcttatcagttcttcctttctagcagtggacctataactgaatggggagaccctgggcacctggtcagaagggagacatgtatttccagttgacctcaggctgtcctgcaatcagagacaagcagatgtcaacagtgaaatagttgactcagtacggttttaaaagtcttaacatgtgaacatttcattgaatgaagtaggaagtgacaatacagagaaaaaaaatctcatctctccttttgaatgacaatctgtgaattaaaattcagcagagtacatgagtcaagttaattagaataaataatcttataactata

SEQ ID NO: 164786 - DNA, 976 bp, Homo sapiens
tattccttacgtcaccaatcaacttgtacttccccatctagttttagttgctcattgcttccagacagctctgcctcttctcttaatctaatcagataatagacttctacaaatacttattgaacagaggtgggtatggagataagacagggacttcccctgataacaaacaagcatgcaaataactaacaataatccaaacacagttacgtaaatgccagggagaaaggcagtgaatgtgctgtgaatatggagagaaaggaagaagtttctttcaaacagagctttggggtaagggaggcctgctttagtccttgcagggtagatatctcacaggtagaaaatggggagaaatggtactgaaggtagcagcttgaacgtgggagatgttggggaagaccagaaacgtgtactaggttggtttctggcagcattaggagaaatctcagactagcggggcatgttgcccagagcatgtgcttctaagaagttcctcatgaatgaggtggggaggcttttattcctctcgccacaacactgaggtataacaactcttttcagaaaatgagattttatatatctaagcctagctttctaggcaagctgtataggcaagatcgtctttataccattttgtggattttttttttttttttgaattgcttccccaaatctgatgttgctcatagtgtcaccaacccagggccacattcatatgaaatatttgcctggccgctcaggctgtgccatcttgagtgatgtgttcctctctccccacaccctggttctgcttaacttccaggttccagtttaggtcttgctttttccagaaacttttcatgatcccttctgtcctctttgctgtctgtcatgtctgaaattcttcagcttttatagtctacagcaattaattattaatatatcatgtcttttaaatatttacttgttgattgggtgacgtacagggtggatacct

SEQ ID NO: 164787 - DNA, 980 bp, Homo sapiens
tgtacaacgcctggcacttcgacggcctgacttggaaaaccccttgccgagttgctcattgcttccagacagctctgcctcttctcttaatctaatcagataatagacttctacaaatacttattgaacagaggtgggtatggagataagacagggacttcccctgataacaaacaagcatgcaaataactaacaataatccaaacacagttacgtaaatgccagggagaaaggcagtgaatgtgctgtgaatatggagagaaaggaagaagtttctttcaaacagagctttggggtaagggaggcctgctttagtccttgcagggtagatatctcacaggtagaaaatggggagaaatggtactgaaggtagcagcttgaacgtgggagatgttggggaagaccagaaacgtgtactaggttggtttctggcagcattaggagaaatctcagactagcggggcatgttgcccagagcatgtgcttctaagaagttcctcatgaatgaggtggggaggcttttattcctctcgccacaacactgaggtataacaactcttttcagaaaatgagattttatatatctaagcctagctttctaggcaagctgtataggcaagatcgtctttataccattttgtggattttttttttttttttgaattgcttccccaaatctgatgttgctcatagtgtcaccaacccagggccacattcatatgaaatatttgcctggccgctcaggctgtgccatcttgagtgatgtgttcctctctccccacaccctggttctgcttaacttccaggttccagtttaggtcttgctttttccagaaacttttcatgatcccttctgtcctctttgctgtctgtcatgtctgaaattcttcagcttttatagtctacagcaattaattattaatatatcatgtcttttaaatatttacttgttgattgggtgacgtacagggtggatacct

SEQ ID NO: 164788 - DNA, 153 bp, Homo sapiens
acggaggatgtgcttctgagtggtccgttgggtgctgtgctgatgagcatcacccagcattttacgacacatgtgctgccccagagggctgggctcccgtcagagctcttttccactggctgggtgcggtggctcacacctgtaatcccagca

SEQ ID NO: 164789 - DNA, 283 bp, Homo sapiens
gaactgaataaaaagtctatgataaccggctgatgaaatagaagtatgctcaattataactggtataaccgccgcttaaaaaaatattcctccagtcctttcttcataagtgctacaaatcattcatccagtggagaaatactaaaggggccctataaaagcaccagtgtcttgacgaacagattaggaaactgttctagcatgccatggtaagtctccaaagcaatagaaaaaaattaacaaataccttccatccctttacacatcttcttctgccatcttt

SEQ ID NO: 164790 - DNA, 300 bp, Homo sapiens
agaaaacagatgatagagccctaagctggactgagatggagaggagggggaaagaaaatgagagacattaatgtcagaggtaagatggatgagacctgatgaccaattaaatgtgcaatcagcggctgggcacagtgggtcatgcctgtaatcccagcactttgggaggacgaggcttgtggatcataaggtcaggagatcgagaccatcctggctaacacggtgaaaccctgtctttactgaaaatacaaaaaattagctgggcgtggttgcaggcacctgtagtcccagctactcagg

SEQ ID NO: 164791 - DNA, 317 bp, Homo sapiens
tagattgaggtctcgcctgggcaggtagtctcgtcgctggggaggtgtagacgttacagtgattgtatgaactccctgtatcactctccatttagggacagttttcaacactgtgtatcaagatgtgttctcttacgtaagtcgcttgttaaagatttgccattttggtagcctgaagtaatgtgagtttcaactgttattttatttcatcttgcctttgttacttgttaatggatgaggaaaatgaaaaagtacaagtattagtgctggtggtaactcagcctcatacagttaataaaatacaaaaaagatgagaa

SEQ ID NO: 164792 - DNA, 470 bp, Homo sapiens
tggatgaaagccctagaactttctcagggacttctagtacataggattactttgctttctggaaaggctatatcaaatttcacttccccaggagcatacgtgagaatcaccgcccactgattagtaccatctaaacattttgccaattttgtacacaaaatatcctcttttcttatttcactttttattgccttggtctcatgtgaggctaaaattttcccttgtgttaattagctaatggtattttctaatctgtggattgtctcttcataccctttgccaagcttcctgtcacaatgttcctgttatgagtttatactaaatcttcataatgaggatagaaaaaatctagttctgatgttttctgtttgtcctttaatgttgtttctgatatttctgatatttttatgttcatagcatttaaatgtttataaagtcaaatcaatcttctttttccccctgtggaaatc

SEQ ID NO: 164793 - DNA, 352 bp, Homo sapiens
aaaagtaaataagtcagaggttttgtcctcaaggaactaaccatccagaagtaaatagaaataaacttggggaccacatgcagtgctcatgcctgtaatcctagcactttgggaagccaaggcgggcagatcactggaggtcaggagattgataccagcttgtccaacatggtgaaaccctgtctcgactaaaaatacaaaagttagcctagagtggcggcttatgccaataatcccagctactcgggtggctgaggcaggaggatcacttgaacccaggaggcagaggttgcagtgagctaggattgcaccactgcactccagcctaggtgacagagcaagactccatctc

SEQ ID NO: 164794 - DNA, 235 bp, Homo sapiens
tttgatcctcaccctcctcctaccctccaccctcaagtaggcccagttgtctgttgttcctctcttcctgtccgtctgtactcagagtttttaatatgagtttttcatgttcctaatttagctgttctattgtcacagctttctgattttgttttctttaaagtacaagagaaaattgaattttctaaaatcattttctattattattccagtaataaactgtgtagtagaaaag

SEQ ID NO: 164795 - DNA, 630 bp, Homo sapiens
ctcacatgggaggaaaagatatgccatgcaaacactaatcataagaaagcctgaatggctatattaatattcaacttcagagaaagaaaagtgtgggagataaagaaagacagtacataataataaaagggtcaattcaccaagaagatataacaatcctatatgtgtttgtacctaacaatagagcatcaaaatacataaagcaaaaactgacagaattgaaagaggcaaatctaaaattacagctggagacgtaaaaactctaatcagcaattgacagagctagtagacagagtcagcaaggatatatatagaagaactgaacaccattaactaacgggatcaaactgacatttatagaatactccattcaaccacaacagtgtacatattcttttcaagtacaaaatggaacatttataatagaaatcgtagcaaactgaaagggactagagtcatacgatgtatgttcctgaccataatggaattaaactagaaagcaatgtgaaaaaataacaggaaaatcttcaaacacttggatagtagacatcacacttctaaataatccatgggtgacagggaaggtctcaaaggaaattagagaatattttgaactgaaagaaaaaaaaa

SEQ ID NO: 164796 - DNA, 366 bp, Homo sapiens
aaatgcatcagaacaaacagttagtgcatgtggggcttcatacctaggtgatatattgacaggtgcagcaaaaccaccacggcacacatttacctaggtaacaaacctgcgtgttccacacatgcatccaggaacttaaagtaaaattaaattaaatacaaaagacgaagaagataggtctaacatgattctagagcttcaagcccaggtaactacaagactgtagtttcattcgcatcaccagatgagagaaatcttgtttgggaagataagaaaggaacagggagatgacacagagctggaagagagaaagaaaaaaatgaataaactaaagtgtaatatgcttcagttctgatacggttttga

SEQ ID NO: 164797 - DNA, 567 bp, Homo sapiens
gttttaattgataatttttattataaaaagtgtttacagggaaaaaaatcactgggttgtaataaaagttcttataggtttgctaaatatagtattatgaggcaatattgagggggaaacatagctaaagtaggaagtaaattaatcctcagttgcaccacgggagaacagtgtaaagcaatgattctcaacacttgtttcacatgagaatcatctgagtaactttagaaaatactgatgccagagccccacctgtagagattctgaaggaattgatctaggggccaggcaattggattcattatttcgccattggagattctatgaacaaagattctaaagcctcttggtttaaagagattaaaataatgagtacatatttttaactgacacattgtttctaaaattaaaccagagattttgtgttattttagttactgttttgtgatcatttttcatgatgcattctccgcttgtttctttcagtattttttatgtacaaagtgtcatgtgaaatactgtcatgaatacatagagaaataaaatatctctgcttttaaggggctc

SEQ ID NO: 164798 - DNA, 458 bp, Homo sapiens
ctcccaggttcaggcaattctcctgcctcagcctcccaaataggtgggattacaggcatgtgccaccatgcctggctaattttttgtatttagtagagacggggtttcaccatgttagtcaggctcgtctcaaactactgacttcaggtgatccatctgccctggcctcccaaagtgctgggattacaggcatgagacaccgcgtctgtcctcatattggctttaaaataaagacatttgtaaaaatctgtagtaaatatcctgagtagaacaggcatggagctaattaatatcataactcaaaattcccatgaagcatccaggttctttgatgacatctttcatccccaccattcttagcttgtctattttggcgtttcatctatcttgccccaagtcacaatatggtatagcaactccagtttgcgtgtccagataataaaatatccaaaagaaaa

SEQ ID NO: 164799 - DNA, 219 bp, Homo sapiens
gtcgcttgtatgctgaaaactcccaaatttgtatctgtagcccagcttttcctactaagctctacttacatatctttgcagacctcattacttcttgactaacttactggctccttaaatatctaaaattgaatccatgttctacctccccatacaaaaagttcctcctccttccctaccacagttaacagttaccattactctggccattactatcct

SEQ ID NO: 164800 - DNA, 204 bp, Homo sapiens
tttgaggtgatgtgatgagaaatctgttagttcaggacctgtatctgggccccagacaagggggttggtcctgagggcagcccaggagcatgtgccagcacaaggccacgcctccgtggacaccgcagcatgccagcacaaggccacgcctccgtggacaccgcagcatgccagcacaaggccacgcctccgtggacaccgcag

SEQ ID NO: 164801 - DNA, 667 bp, Homo sapiens
caaacctggtaaattgaaacataaattccattctttgatattaaacagcacatcacaaagcgttttgacagatagattggttctagttttcagggctggttatttcactgttcctatagaacctcaatgtgctcagaaatgtcactttgtaggttctacataaggagtgtttggaactcgacgaattgaaaaacaggttccatctgtgatatgaaacagcacatcacaacttattttcttgccagctctgagaatgaaaaacaagctaggtgagaaaacaatcagagctggatattcattgctttttaataggcctcaaagagctcagaaatattactttgtagattctacaaaaaaagtgtgtggaacctggtgaatcaaaacagatgctcccttcagtgatacaaaacagcacatcacaaagtgttttcacagatagcttgtttctaatttttagggctggatattcacatgttcttttaaggtctcaatgggcttagaaatgtcacttcagagattcttcaaacagagtgcttcaaatctggtgaatcaaaacacagtttccattcagtaatataaaacagcacatcacaaaagattttcacagttagctggtttctagtttttaggactggatattcaattttttctttataggcctcaatgg

SEQ ID NO: 164802 - DNA, 479 bp, Homo sapiens
caggctggtctcaaactcctggcctcaagtgatccacctgcctcagcgtcccaaagagctggcattacaggcgcgagccactatgcccgaccaaaaaaaaaacttttttttaattagccaggtgcagtcgcctgtgcctatagtcccagctactcaggaggccaaggaaggagtatcatttgagtacaggagttcaagactacagtgagttatgattgtgctactgtgcttcagcctgggatgacagagcaaggctgtctcaaggaaaaaaaaaaaaaaacgtaatgatgtacagtgttcactctgagagaacttgaaacattgcaggaatgttgtttagtaactgcaaggtaaaattcattgaagagtggctaggtgctcacgcctgtaatcccagcacaggaggcctaggtaggtggattgcttgaatccaagagttcgagaccagcctgggcaacatggcaaaaccacatctcttc

SEQ ID NO: 164803 - DNA, 554 bp, Homo sapiens
tgtttgcggcagaattgagtgcccttctgtatacttcccacttcatcccacaaagtattcacaacattcaacatttttaacaaaggctcagaagcgagactggtttctttcctctctctcttcctgtgggtgagtgctgtgaagatatgactattgccctggcactgcttggtgccatggcctcaagtcatagtgaaaccctgtcttcactaaaaatacaaaaatgagccaggcacggtggcacacacctggtaatcccagctacttgggaggctgaggcaggagaactgcttaagcccaggaggtagaggttgcagtgaacagagatcactccactgcactccagcctgggcgacagagggagactccgcctcaaaaaaaaaagaacatcatccgtgatgagaagccaggggacacaggccaagcgacaggtccaggctgtctgtagactcatccactgtgaggcaaaagcacaactcagcagcagacatgtcaactccctcttcgtgcctgcagtcgtatcttgaatccagcaagtttcgactgcattgtgg

SEQ ID NO: 164804 - DNA, 583 bp, Homo sapiens
caaaattggtagacttgtgtttctagactgagctctcctgagttcacatctctaaatactggtacaggtagcttgcaagcatttcaagcacctcaaaactgctcttctcgtttttgttaatgacatttaatctgcttcaattatctattactgtttagcaaaccactccaagcttaatgacatataaacagcaaccattttatcacattcacagattctgtgagtcagggattctgatagggcacagcaacgatggcttgtctttgttccacacacgagggcacgtcagctgaagactgcctcttgctgtttggggagataccatatctcccacacattactaagatgaagagtcggggtgggtggcagagaggtaaagatgaaagtaggtccttatttttgcttcttaggaatacattatttttaagcaccacactcacgttgaatagcacataagatcaagtacacattaaaaaacaaaaagtactttcatactgctataaagaactgcccgagactgaataatttataaaggaaagaggtttaattgactcatagttcagcatggctgggaggcctcagg

SEQ ID NO: 164805 - DNA, 560 bp, Homo sapiens
caaaattggtagacttgtgtttctagactgagctctcctgagttcacatctctaaatactggtacaggtagcttgcaagcatttcaagcacctcaaaactgctcttctcgtttttgttaatgacatttaatctgcttcaattatctattactgtttagcaaaccactccaagcttaatgacatataaacagcaaccattttatcacattcacagattctgtgagtcagggattctgatagggcacagcaacgatggcttgtctttgttccacacacgagggcacgtcagctgaagactgcctcttgctgtttggggagataccatatctcccacacattactaagatgaagagtcggggtgggtggcagagaggtaaagatgaaagtaggtccttatttttgcttcttaggaatacattatttttaagcaccacactcacgttgaatagcacataagatcaagtacacattaaaaaacaaaaagtactttcagcagaatttgtattaaggtagttttttggtttttggttttttttgagacagagtttcgcgccgtcgcg

SEQ ID NO: 164806 - DNA, 239 bp, Homo sapiens
attacaggcatgagccaccgcgcccggccctctttattagtattctttatgttcagacataattttcctaatttcctttagttctttgtccatggcttcccttagttcattgaacatactaagacagttgatttattgtttttgattaataattccaatgcctgggcttcctgagggatacttcccatcacaatctctttttcagccaggtgcagtggctcatgcctatgatctcagaa

SEQ ID NO: 164807 - DNA, 447 bp, Homo sapiens
agaatggttgctctcttggtaataccaaaggcagcaaattaaagaaagaacaaaatgaattgtatcacaaaggacagccaagattctggcagagtgatgctggcaagagagagaggacagtgggaacaaacaagaagaagagggtctgagtttggaaagggcagggctgaggtgcagaatctgtgctggacagcactgaaacaggcggaagcagatttcagagggctctgaaggccaggatgggaagttatgactgtatttgctgggctatgagacacatcaatgatctaaacaggaacatgacacagtgattcctcagaaggattactctggtagtgctacctggcataacttagaagggagcaggaaatgttacgtgtggaggcagctgcatttgtctagacatgaggtaatagggacctgaaacagaattggaagtgaaaaaga

SEQ ID NO: 164808 - DNA, 457 bp, Homo sapiens
cccttgcgcagagcacagctgggaggctgcacgagcgatggcctttcgaggaagcagagtggccggcaccctgcctgctgtcccggtccagctctgttccccctgggaagccgaggggcgtggccaacacccgcctgctgttccaacccaacccagctctgttcccctgggaagcccaggagagtggcccggcacccgcctgctactgctatcccggcccagctttgtttccccggaagctgaggggagtggctggcacccgcctgctactgctatcctggcccagctttgtctcccaggaagccaaggagagttcgctggcacgcgcctgctactgctatcccagcccagctctgtttcccaggaagctgaggggagtggctggcacccgcctgctgtcccaacccagctctgtctccctgggaagccgaggaaagtggccagcacccacctgcta

SEQ ID NO: 164809 - DNA, 509 bp, Homo sapiens
aagaaaataataataatgcctttgttctatttatcagcagtttctagaataaagtacacatgaacagaaaggaataacagaaattatacctgaaactctaattgcgagctagctttactcccagtctctttctaaggaaaagacccataggcaattcttctccatataaaagcatggtaccccaatcacaactaaccagactaatgggtaagccagaagtgatgaggtagaggtgaaagcaaccacctatgactacgccagtatcagaaccacctattccatcttctctccaagaactagaagaagagatatacatagagaagtaagcagtgccatgtaagaaatgaagatttattcttctgattataaaatcttgaactatgattatcccaggataacagctcaatttgcaattatgggaaatactggaacacagacaaaattgcactgctgttaaggtaagtattccatgcttctcgacttccctgtgtcaattaaagcactgcttc

SEQ ID NO: 164810 - DNA, 417 bp, Homo sapiens
tataaacattgttggtatttaactttacttcccattactgtggatctaaccaaataattatgtgttttgtgtccctaagtatgctctcattttttttggtctacacccattggaagcctttttaatgtgacatcttttagaggaattctgctggaataatttcatgttaacgaggctaaagctcaagtctcccaaattaagtggaatgttcattatcccaaggtgttcatagtcaaaagtcccagttgatagtgaagaaggccaggactgtaattgagcagtccttagcaccatttagcaaactaggtttacttactacataatatagctgcttattcacagcatatacagtgacaccttatctctgaaaaataatttccacggagccacttagaataaaaaaactattataactag

SEQ ID NO: 164811 - DNA, 245 bp, Homo sapiens
tcagagagcgcgatagcagggaagaaaatcaatcatccactgggggaggccacccaaaccagggggaaacttccccacctggggctgagctagccagcagcctcctgccagacctgggcatggggaggtccttcatagactaaatgccacctgtcacgtcaacctcctgctcacctggcactccttcttactcagtgctgtcattcttctctgggtcatctgttcctttgaaatccctgtgtcca

SEQ ID NO: 164812 - DNA, 522 bp, Homo sapiens
acaatcttgccacaggcacgtgcttggctgagtccctcatctccttctttgcccaaatgccacctctcaccgaggccttccaccacccgcttcaataccgcaaccggctggctctgcctcacactccctgcccggccctacctgactgccttcttcttccctcagaggacatcgcctcccactgtactacacggtttcctcatattcattgtcatctccttctaccggatatgtaagctccagcagggcaggcatctttgcccattttgttcaatgaaagattacaagtccctagaacagcgccagacacatagaggtgctcagtgaatagaatagaaatgcatgaagctgcgctgggcaccagctgggaggtggtggagctgggacttgaatccaggctgctggctctagaacccacgtcctgcagccctccgtgtgctggggccaggccatggggcaaagcgtgcagctctcctggccagggggccccctgggaggttcactgtgctgtggagggtctaa

SEQ ID NO: 164813 - DNA, 575 bp, Homo sapiens
cctaccaatattgccacattggggaacaaatttcactgaacaagatggtcactgagtgaacatactgtgtcattcggtctccagaatagtgttctatagaagaaaccgctcttaaagtttgatgccagaataacacttttattgaggttctcttttgtctctatttgaagctatgtgccagtttttctttctcaatatagtgtcaaaagctttgagcaaggttttatatataatcacatattatgtatactttcatcatatttgcttttctcttttatcactttactaaaccttatttttagtgtatgtgaacttctgttaagccacttcaaaaccaatagcaaataattgttccttgatcttttttctaatgttgttagttttccaatgttgttaaattgcaggaaatggaagggaaatggagggggaaataacagaaaatgtataatttcacttggctctaacactacactactggtgctatattagtaatgtggaccttgaggtataggttgtggcagtggcagttactcgaattggacagctgtaccacatagatgaccattgcatttcat

SEQ ID NO: 164814 - DNA, 364 bp, Homo sapiens
tgcttagtggcaagaggtgttgggaaagtaagtacctggcataggaaaatagaatttccaagactgttttaaaataatcattaatcatatctggattgggtccatcatcatcataaacaaagccaggtttctctgagcaaagaaggggagactaagttcttggatagaaatgtcaagttgtacgacacagtcacaaatcaatagatcatttcagaactcaatccaaaactcatatgttccaatagagttgggagggtgaaaaagcggacaagtgtaacgccattaatcatgatctggagggtgagaagagaggagacagatgccccagatagatataattagtattagtgcagtccaccaaggg

SEQ ID NO: 164815 - DNA, 342 bp, Homo sapiens
taatctatgaagccttttgaaatacactgaatatttcttttctccttgtttcatggtagtaatatcttctctaatttcagaagacattcatcataatttcttgtctctctgtcttccaagtttcttatttaatttggttcactctgtgtttttcgtaactgggaactgcaagaacattagagctgggcacccacattgctttgtagaccagccatcattgcttaatctgggtgggatttttttgtattagagtgaccaccgatgtcactatccttaaggttctagttgtaagctgattagataccaacaaaagtgtacgtcaaaacccatataaaatatatg

SEQ ID NO: 164816 - DNA, 406 bp, Homo sapiens
tgacacccaccaccaggagaacagaagcaacgtctaggtcagagattagcaactgccaaaaataaggtgaaagttgcccccaaagccagtgaacacaggaaaacctgggcaggtttccttcgcaaagaaagtgaagaaagtttaaaacgctcagaaaagcaagaaacgagtgctaagcattacttaccatatgagctgtatgttaaaagcttgtttttttatttaccagtgctagaaataagtttcatgccaaggttttacaagaaaaaatatctttgaaaaatattcatgagaaccaagtctcacaagaaaaattaaaacttgagaattactacaaacttttagacatcaaattttaaaaaaatgaaatgctttctgtgttaggtacggatcttcaaactcccac

SEQ ID NO: 164817 - DNA, 136 bp, Homo sapiens
acattcaaggggaggagaattcagctctactttctacagggggtatatctacatatgttatacttgagttctgtaaggaagatttgttccttctccctcatttatttatttactgattcatttttatcagtatgga

SEQ ID NO: 164818 - DNA, 257 bp, Homo sapiens
agaccagaccattaatctggatatcacactagaacaatatgcaatagaaaaaaaaagaatgaggctgggcgcagtggctcacgcctgtaatccccagcaatttgggagcctgaggcaggaagatctcttgagcccaggagttcaagaccagcctgggcaacacagtgagacccccgtctctataaaaaataaaaataaaagaatgaagaagctctgaaatgaaaagatcttctccaaaacaagatatagaacagtgt

SEQ ID NO: 164819 - DNA, 438 bp, Homo sapiens
caagcgaaagccaggcaggtctccccctgaaacctctgcacaggtccaggctcctgcgtgaagtgatgctcctctttgccttactcctagccatggagctcccattggtggcagccagtgccaccatgcgcgctcagtggacttacagtttgagatgccatgactgtgcggtcataaatgacttcaactgtcccaacattagagtatgtccgtatcatattaggcgctgtatgacaatctccattcagctttccagtggggacagagctgctgtgtgtccagggcctcatccaactttcttccagcctggagcatggatccccacacaggtgaccgactccaagcatcagcctctccctgcccacctgaccaggcgccaccctctccacgggccaggaaacatcctccccagtgccatcaaccgccccaccttgtgcc

SEQ ID NO: 164820 - DNA, 397 bp, Homo sapiens
gtgacttatccagagtcgcacacatataagatagaactgcgttttaacttgaaaccctttgcttttcacagtaggggagatggcaataatgaaatcaattccaatattgtttgctagaggtgataatggtggtacatacaaagtatagagttaaagcagaggagggagtgattgtttatttggtcagggaagactttcttgagttgggatttaaaagatacgtagcattttgagagacaaagaaaggaacatcttaggcttggaaactgatatgcagaaacatggagggatgaaacaagatggagtctggaatgtgtttgggatgttccaggcatttcattcctactgaccctgcaggggagtaggtgggagctaggctgagtgacaagtgctagtt

SEQ ID NO: 164821 - DNA, 498 bp, Homo sapiens
acagatgtaagacttctcaatcatcattgtcaagagaacatctgacccaaaggataagggctatacttagggaatggaatctgatgctctcagcattcagtaaacttggtcctgatgtcttcaaagctttgacaagtcaacaaacatcttgagacctgattttaaaaaatagccactatttgccttccaaagatggtctaaggatgttttaaaacagaaaagaatttcacgaccataaagaattaaagctcctattgcaacgtaccaattggcattgctgcttccactgggactaaacagactttcttgaagctaaccagtgacaaatggaattgaaacaatatgttaataacaaaacctgagtttcatcttctttttgagcttgtgagagctctagccttctgaacggcagacaattttgccaagttattgaccaacgtttccagctgcttcggtagcagcttctaaccagtccccacataaagcctccaataccgt

SEQ ID NO: 164822 - DNA, 176 bp, Homo sapiens
gggccctgttggggtattattgatatgctggtagtggagtaagaataaccttggaacctcaagtgccaaatcagtcagcgaacatttcgagcttttctttttcattaggcactgtgctaagcatttttcatgcatcattcttcatttgaatttctcaacagccctaggaggaatta

SEQ ID NO: 164823 - DNA, 122 bp, Homo sapiens
cttcctggcagcacaactctcctacccacagcagatggaactccttactccaacaagcacaggcaggcctggctttctgggcacccgagaagagctgccttatgacctagtaccagagccct

SEQ ID NO: 164824 - DNA, 260 bp, Homo sapiens
tgtatcagaagccactttatactaaattatagcacagaagggaataaagaggtacaaaaattttttaaaatactgatcaaagtaaaagttcagattttctctactaacttcattttctttctatgaattcagaagaaatttctagtattaggctcagctaatgtctgtgtcatgaggagtgttttacatgaaagtacccttgcttgaaaccattacaaagttccagggaaggagaaagcggcatgaggtagaggggacag

SEQ ID NO: 164825 - DNA, 441 bp, Homo sapiens
gacatattgtgatagttaattttttgtgacaatgtgactggattaagggatgcccagataactggtaaaacattatttctgggtgtgtctgtgagggtgtttctggaagagattagtctttgaatcagtagactgagtaaagaagagcttcctctccagtgtggccgggcatccttccaatcacttgaggccttggatcaaacaaaaaggtggaggaagggccaattctctcttttcttgagctgggacgtcggagctcctggttctccggccctcgtatccagactgaatctcaccaccagctttcctggttctccagcttgccaatgacatatcatgggacttcacagcctccataatcacacgagtcaatttccataataaacctcctcttatatatgtcttatatatcctactgattctgttcctctggagcaccct

SEQ ID NO: 164826 - DNA, 285 bp, Homo sapiens
gggtgtggtggcaggtacctgtaatcccagatactcaggaggctaaggcaggagaaccccttgaacccaggaggcggaggttgtagtgagccaagatcagagcactacactctagtctggatgacagagtgagactctatctcaaaaaaagaaagaaaagaaaatactcgcccagcattgtattttatatatatgtatgtaattttccatttgaacacagttcgatgagttttgactcacaagcaatcatgtaaccacctccacaacctctagaagcctgccaca

SEQ ID NO: 164827 - DNA, 292 bp, Homo sapiens
attggcacctttgctgtgttgtctgctgttacgtaattgtgcacacagtgtgaaatccgtggaagcacaatgaccatgagctgcagctggcagttcatctctgcctgaacaataaccagagacccccacttcctcctaaagcctggtaggacttttgggcaggtcttccttttcctggtagagctaccctcccacagcccccaccaacacctgccctgccctgaggttcagaacatgaacattttccagaagaaggattttcctttttggaaaggagaacttctggcttgac

SEQ ID NO: 164828 - DNA, 349 bp, Homo sapiens
gctggaggcgggacctggaggaatggaggccagtgctaccctcacactcccagcctcctgtcctggtgggatttggacccacagatccccatggtgcatatgtcaagtctggcctgttccacctctttctcaaaggaaggttctgagcctccctacccagtgtaggggtggcaacgatccctcattcattcaagcatttatgaaccaccctccctaagtctagctcatgcagcaccaaatttattcacttagctaatgattgacctactgctgtgttctaggcaccagggataccacatggaggcgtgcgccagagccctgtcccctggagcccttgggttcaaatact

SEQ ID NO: 164829 - DNA, 223 bp, Homo sapiens
ggctcatctcaggttccaaataaaataaatttacagaattccactatactctatgtagatatgtcacatacattcaaacagtatagacagtatagcctggggaaagagatgaccagtgaatggaaaaaaatattgactttagttgttccccactcctgcaactggaaaatatctctcctgaatatctaccacgtttttattccctacaggtggctcttacaag

SEQ ID NO: 164830 - DNA, 415 bp, Homo sapiens
attaatgtgatattgctgatgatggataagccaaagaggttatttgattacacatacatatgaaatgtttgggtggagatacagaggcatcagtaaaatgtacagatacaagtggcaataattggaaaatctgatacacaaagtcagactaagaaagttggtaactttagctttcagtaagtttggctttaatacaacctcatattggttagaggaagcaaaaaaatgggtttacaagtaccttttaaaaaactatcaacctggggctgaacaaaacactggttgggatcattcctaccacctgggcttttcctagcctaaacatcatcttttgaactacctacactttacgggaaatataccccaagagtaggaaaaaaatgaaaataacataaaatgatgcaaatattgaaaa

SEQ ID NO: 164831 - DNA, 354 bp, Homo sapiens
gcctcagcctcccaaagttttgggattacagacgtgaaccactgcacctggccataactgccagcattaatatagtgttactcactctgtggcagccactgttctaaatacctcccttacgttcccttatcatttcctcacaacagccctctgaagtaggtattctagctgacgacactgaagcacagagaggtgagcaacttgcccgaggttagttgctgattagtggtggagctgggattggattcagtgactgtcgcatacagccctttgctgacattgtagactctgttctgattcctgctcgccaatgagggtgatgccacgcggtgccactggggaggagggaagaga

SEQ ID NO: 164832 - DNA, 420 bp, Homo sapiens
ctggaacttgggcagtgccccttaacccatccatattcttctctcccgttctgtccctctgccttccccaccagagggagacattatcctaaattttggattattatccttttgctttaaaaaaatagttatatcacgtatatattggtcattaaatcatatttcattggcttttgtgatttataaatggtttttgtactgtatgtagttttgtaaaacatgttttttcaattcactgtatatttctatgatttatccatgttgttgcgtatagctgtgatccactcatttgtattgctgtacagtatttcattgtatgaatataccacaatgtacttatctgttctcctgtcagtggtcatttgagtgttcccagttccttgctatcataaacaacggtgatgtaaaaataattgtaca

SEQ ID NO: 164833 - DNA, 107 bp, Homo sapiens
ctggcaatatattgaaacaaagccacctttcaccacctcaaatgctatggtctagtctaagtcaccatcatctatcacctggaccactgtgacaacctcctaactgg

SEQ ID NO: 164834 - DNA, 436 bp, Homo sapiens
gggcaccttatccaaattggccaatgataaattcttttttggtaccttactatatatttgtatcctcagaacaaattctcctttctgcttaagctggcttgacttcatttctttcactagcaagctaagaggctttggccaacagaactactctaggggtagctgtaaaatttatctctaaggaaaggctgctcttttgaaaacacagtttaatgggtcttctgggtatatgacgatagtaaagcaaaattttgttctggaatgaagaagctgattacattgttgtattacaaacaatatattactcagtgaagtgaaaggccacactgtgggcagggtggtgactttgcagatagcatgttaatccttgcatgctttttgttgtttctctttttggagggggagggtcttaattttctttggccctcccccaccc

SEQ ID NO: 164835 - DNA, 374 bp, Homo sapiens
aaaatgatggacagatgggggaagatttgaatgagttttgttatacattcatgttattttagtaatggtaatattcttttttcaatttttgatagaaacaaaggagacatttttgtatgcctgggataccataattgttgaaatggaaatacatccacatccacacacatacatatatatgtacatatatgtaacatattactttaaagtaattttagactaacagaaaattttcaaatataatgcaaatcattcttatgtgtttgtcatcctgatttacctcatcagtcaaccaatcaagttctctgaaagtgatatctcaatataggcataatgtcacctagtgcttctgtcatagatttaatacaacttta

SEQ ID NO: 164836 - DNA, 231 bp, Homo sapiens
tcacccagaaaccctggctttggagtctgtcatcagggccctttccccaccctgactcaccccccatgagggtgccctgtctggagcagccaggacttcttcgtcccatgggatgccagctggcccctcccactcggtatgacacctgtgtcattcgagtcgtctgcgtggttgtgtgtgtcctgtgtattgcattgtgatgacgtctgtgtcattcgagtcgtctgcgtg

SEQ ID NO: 164837 - DNA, 319 bp, Homo sapiens
taatatgtgacgtatgccctgtaccattttcagtagtgtgaggtagggaagaagaaatggcattgatctactactgtagaaactttgcctatgatttacaagcatgagaatttgctttgcctgttttatgactctattcaaccctgaattatgggctgtttattttttctctctctttgattagattcatgagagagttgtttgcctggttcagtcaaaatacaaatccagtgttgttcctatacgtcttacagcttttccttttgacaaatacaagaagactgggatgtagcagacagagcatttaccagctgccagg

SEQ ID NO: 164838 - DNA, 459 bp, Homo sapiens
gccatcccatcttcaaggactgacggagttaatattgtcaggatgacactactcccaaaacagacttgcagattcgatgcaatccccataaaaaattccacctgttcttttcacaggaatggaaagggtgaccctcacattcatttggaaacgcaagagacccagatgattcaaaaccatcttgaaaaagaacaaactgggtgaactcacacttcccaattgcaaatgtcacttgagggatattctactagatcatgaccaatcctcgaaaccgtccagctcaccaaaaacaaggggcctgagaaactgtcactgccgagaaagaggagcccaggccgcgcgtggtggctcacacctggaatccccgcactttgggaggccaaggcaggcagatcttttttttttttttttgaggcggagtctcgctctgttgcccaggctggagtgcagtggcgtgat

SEQ ID NO: 164839 - DNA, 640 bp, Homo sapiens
gttctggggatggaattgtttcttggcaaatccagccatatagatctaactgctgtatgtataagacaccacctgtaggagcgggaaggtatcagtgcttcttatattgtaaagcattggcctaggaaggcaaacagttgtctttttgaaggatttttttctgctggtcctttgggttttgatttgatatttttatgctccctggttgagtgtgttgtcttcgtttttgagatctactgtatgtgttgaataacaagctattttcattgtactgtgcattttcccattaaattgtttgcttttaatattcaatgttaaatatgaggtgaccgtacagtagttaggagtttctttacttacaaaatcactggaaatgattaaattgcttttccccctccccagaggtgcatttttcttatttccatatagtaaagttgagcttttacagtgcataatgtgacatttggaatgcttatcaactgcatgtaaacattaataacctgcacttttttgtcttaaggtttgttgagctgttttgttcactgtactttaactgtgatatggaaaagactgcattctctgtgctgttactaattaggaaagagaattgctttgattttgtctcttgtttactatagct

SEQ ID NO: 164840 - DNA, 280 bp, Homo sapiens
gatccaaactacgttcattgaatgaatgaacgattacacagacgtctgcattgcagaaacggcctattctgagagttactccagacccacttcacgtcccagccttgtccccctcccccgccccgctgcctgctgccccaaactctcaggaactcagtctccccatctataaatgagcacttgactgtaatcccagcactttgggaggccgaggcgggtggatcacgaggtcaggagattgagaccatcctagccaacacggtgaaaccccatctctact

SEQ ID NO: 164841 - DNA, 158 bp, Homo sapiens
gatgacttagtatgttgcatggcatttcagaattacaattataaaaaccaattttcacagtgcagttttgtaaaacaaactaattttccatttttaaatgtgcatgttgtagataaaaggaagtttactagatgcgctaaaaagagaaatgctctcct

SEQ ID NO: 164842 - DNA, 261 bp, Homo sapiens
caaatgttagggcttgtgctcaaaatgtaagtcttgttcacagcagtgaattattctctatggacaatgaaattagtactcactggtatgaaacgcagaacaaagacaagtacagtaatttttcagggataaggttcttggagttgaatgtttaagtcatcataaatctaatcagtgctgattggaaaatattaaataacatgacgattcattaacttcacaataatatagatttattgtcaaacgggtaaaaaatacaga

SEQ ID NO: 164843 - DNA, 496 bp, Homo sapiens
agcaatcctgagcaaaaagaacaaagctgtaggtatcacacagtctaatttcaaagaatacaacacaggtgtagtactggcatactatagcatagtactgacataaaacagacacatagaccaatgggatagaatagagaatccaaatataagtccatgcgcttatacccaaatcatttttgacaaaggtaccatgaacacacattcaggaaagggcaagctctttaaaaattagtgttggcaaaactgggtatctatatgcaaaagaatgaaactagatccctgtctttaactgtgtatgaaaatcaactcaaagtgggcaaaatacttaaactaagtcttgaaactatgaaattactgaaagaaaacactagggaaacactatagaaaattagtctgggcaaagatttttggggtaaggcctcaaaagcacaggcaacaaaagcaaaaatagacaaataggattacatcaagcagaaaaactctgcacagcaaa

SEQ ID NO: 164844 - DNA, 523 bp, Homo sapiens
tatttgatccatacaactcatggatcaaacatggaagtatggattacattgtgaaagagaaataaagaactaactttttggaaggtttgggaaatctgatctgaaaagaaatcactaatttttattaacattcagctcatttttctttttttattgatgtataatagatgtacaaagtttcagggtatgtgtgatttaatacattcatataatttgtaaagatcaaattagtgtacttgggctatctatcaccttaaatgtttatcttttctttatgctagacttattcaatgtcttctcatctagttatttggaaatgtacaatcaataattgtaaactatagtcaccctactgatctaatactaggtcttatttcttttatcaaactgtatatttgtacccattaatcgacttcttttcagctaacatttaatgagtactatctttgtgtcatgaagtactgtgttttcacaaggattatctcattcagatctcacaaaagtcctgcagaacagcatctgg

SEQ ID NO: 164845 - DNA, 110 bp, Homo sapiens
tttgcagtatttatgatacaccatgaattttgaagttgtgaatgtgttaccattcctcccaaaagatgattcttaaaattcatatattcaggagaagaggcatatgtttt

SEQ ID NO: 164846 - DNA, 361 bp, Homo sapiens
gtctaaatcttcctccacttcatttcctggagactttgatctgccccactctgccctggttgctctctgagcatgctgtcatcatgaaatctccctttatcaccatggtagtaattctttttacacatctcttatgttaaatgtcctgtcccctggtttctttgtctgacaccttgatttactggtacattttggaggaacacattctccaggaactcagtgagagaaagctcatggtaggtaaatattttgtgtattgtatatctgaaaaggccttttattctacacttgcccttgattaatatttgactgatatggaaatctatgttggatattatttttcttcagaagtttgagggca

SEQ ID NO: 164847 - DNA, 233 bp, Homo sapiens
ttagcagtgaacaaaaaatgacaggttattagtgtcacatcttgcccatcttagttttctctgtatatatgatatacttggggctagagatatattggcaagtgaatgaatctctgttgccagaaacataatcttttttttcttttttagtcagggtttcactctcttacaggctgggattgtgccactgcactccagcctgggcaacagagagagactctgtgtcaaaaaaa

SEQ ID NO: 164848 - DNA, 114 bp, Homo sapiens
agtcagacagtttctggcacttagtagctttagaaagtgacttaagccctctaagccctcagttttcacatctataaaatgaagtaaataatataagcctctcagaagtggggt

SEQ ID NO: 164849 - DNA, 499 bp, Homo sapiens
ttctgtggacacagagcctcagcctaccctcccacttccccagccttaatctgaccttcagcaagcagagagaattaaacacaaactcgctttgatggaccagaactccctgctcatagggtctgggtgcccggactctgggtgacctgagcaagtcacatgctaagattcaaagactcagtttccaaggaagaggcctggcctcacagccagaccagcccctgacttttgatcactcctgccctccatgcatccctcagccacccgcagagaagctgggggcagagtaaagcaagcctggctcaacctccacccagaaacacacaagcacccgacaaatgccatatctgaaagctttctccatccttttcctttccttgactccctcagtagtctccatggacagtcatctccactcccagcctcctcgctggcctcccacggtctcaggctaagcccagagggtttaggggtttgccagcaggcacgcagtgtgtgg

SEQ ID NO: 164850 - DNA, 676 bp, Homo sapiens
ctgggattatagtgaggagttacattatctcactcataagcagcgtagcaggcatccgtttgaattctacaaatgtatatgctcagctttcagactcatctttcattattttcagtaaaaacaactccaaattctattaattggagaaggtatacaggtggtgagcttgcctaaaagacaatgcacatatcctgatagctgttagtactgccttattctcatattataatggcttacttacttcataccaagagaaactcatagccccagaatcacaaaaaattatataatcatttctataacaaatttactcaaatagcagagaagtagattcacaactactttaaataaaggttttaaaagctccataattataactacctttaactattataactttaggccttaaatcacatctctaaatttttacagtaataagacaagcatcttttaagtgcctactgcataccaggcactatgcaagacacttcacttggactatcttaataactatcctatgaaagaggtatgattattatcactttacataaaagaaaagattagagagggtaagtaattggcctaatactacacaggtaagaaatgggagagacagagacggacagagagacagagagtttgttcaaactcatatctgccctgattccagtggtgc

SEQ ID NO: 164851 - DNA, 315 bp, Homo sapiens
atacttcaggctcccaaagtgctggaattacaggcatgagccattacacctggacacagttcttgtttatagtttttaaaatgagaatatattacttacaaaatcaacaaaattctttaagatatttccattttggaagaaaaaataacttttttttttttaaagtaataaagcactatcctgagaaatactggtcagtatcaaaataatgtcattaatatttcttctctgaatgagttacctctcactctcagaatgatattttatttgtagacttttttatcctaaaattgaatcaaattaaagaagttggtg

SEQ ID NO: 164852 - DNA, 192 bp, Homo sapiens
agcccccatagaaaattacccgttcttactcaaggctgggttcctgtttattttccttaccttctggcaactgattctcaatagacatccagagatatctagcataattattcactctgctcaaatgcctagctatttggaaataattctccatcagccgaggatgctggccctcagaagctctgtaagatt

SEQ ID NO: 164853 - DNA, 290 bp, Homo sapiens
tatcaaacttaaggtctgtgttgatgttaaatgctggtcagcttttcctgaattccaaaagggaggaggacatgaggcatgtctgaccctcccttcctgtctgggtctgaaccagtttttcaggttaactttggaatgtcctggccaagaggagggatcctttcagttggctagaggggccctagaattttggttttggtttacattctcccacttctggccaagattttttccagaggcaacatcaatggccaccaaatttttatattgtcccatgatgttaccggggt

SEQ ID NO: 164854 - DNA, 509 bp, Homo sapiens
atcacatcctggacactggaaatgagctcttctttcaccctggggcttctcaaagtctatattactttccccaaatgaaaagttgtaatagatgcctatttacagagaggaatggaaaaaatttagagaatattttggaccatagatagtcatatgcaggcttctatttctatttgaaatacaatataacagctatgttttcctgaaaagacaagtaaatggaaacatatctgaaatgaaagctagggctacgccatattcataactcacaaataattttaaacaacataggtcagtttataattagcaacaaagtagcatggaatatggggcagttttccaactggaagagaaatgctaagaggcaatagtgccatattctgggtcggccacatttttaatttgtttttcagaacagtgcagattagactaaaatttggctcttaaaccatagaaaatagattctggttctccaaatatctccaagccaaaactgacctcagatctgt

SEQ ID NO: 164855 - DNA, 712 bp, Homo sapiens
tgggtgacagagcaagactctgtcttaagaaaagaaaagaaaagaaggaaaggaaggaaagggaaaaggaaagggaaagggaagggaagggagaaaggaaaggaagaaaggaaaggaattatgttaaaatatataaaacataaaaatttagcatcttaaccattttttagtgtacacttcagtggtgttaaatacatttacattattgtgcagcccatctccagagcccttcatcttgtaaaatgaaaactctataccacattttgcttattcatccatcagtggacatttgggttgcgtccaccgtttggctgctgctgttaatatgggtatagaaatatctcttcaagataccattttcagttcttttgtgtatatacccagaagtaggattactagatatatggtaattcactttttaatattttttgaggaacttctgtattgttttccatagtagctgtaccattttacattcataccaacagtgcacaaagttttcaatgtctacacatccctgccagcagtagtgttgttttttttcttttttgatagtggctgtcctaatgggtatgaggtagtatttcattgtgcttttgatttgcctttctctaatgattagtgatattgagcatcctttttgtgtgcttattggccatttgtatatctatctttggagaaatgtctattcaagtcctttgcccattttaaa

SEQ ID NO: 164856 - DNA, 530 bp, Homo sapiens
aggtatggctgtcttctgttaatcataagaaggcacagggctaaagggagggtagggaaggtggactagcattatatcagtgttgccttcaaacaagtcaatttcaggaaagagtataaataaaatatagagaatctggaaatttattctcttaaaacagtccaagcctagatattcttagacatgtcctccagtttgagatcatggttctaaagcaccagacttggttcatttatcggaactcagtaaatacttgttgcattaaaatagttcagggccagatgtggtggctcatgcctgtaatcccagcacttcggaggccgaggtgagaggactgcttgagcccaggagtttgagaccagcctgggcaacatagtgagacctcatatttacttatataaaaaatagtaacaatataaattaaatgaaattaaattgtttatgaaaaaatgttattcaatgagaacatctagatcgtactgatttttttctaatcaaatgataaagtctgttgtgaggatgaagcaaga

SEQ ID NO: 164857 - DNA, 349 bp, Homo sapiens
agatttggaaagggtacttgtttatgaggatataatgatgtgggacatatagtaatgaatataacaaataattcctaatatgggataaggtcccctttctcccagtgagagaactcatactggctgtttagtacccatactgactgcttgatgtttcatgatgtctgctttatgaatacagtaataatatattcaccttgatactggtgaaagatcacttgtaaggaatttttggaagttaaaatttaacttccagatttcactagcttaagtcctgagtgtgagggaaataaccatctatgctgtaagaagagcagacactgttactataatgatagtagcaaaacca

SEQ ID NO: 164858 - DNA, 360 bp, Homo sapiens
tctccaagcagaaaaaggcacaacagtagagcaatggacatgtccaaagtccaggatgtggaaagtagggtgtggctggaaggaagggtgaggaccagagatgctgctggaaatcaggcagtgccaagtacactaagactctaattggccagtctgaatgagccgtcctttttaacaagcttttctgaggtttcaaatgggtagttcaattttcaacaaataaaagggtggccagattataaagaaaattaggtatttaccaatcatcctcatctaataagtaactaattcaataaaaatatattgattatcttctaggagctaatgaagacagaagacctgctccctgtggttaaagac

SEQ ID NO: 164859 - DNA, 233 bp, Homo sapiens
ttcaatttctacaccatgcaccgtgggtatgcagaccgtcctttttaacaagcttttctgaggtttcaaatgggtagttcaattttcaacaaataaaagggtggccagattataaagaaaattaggtatttaccaatcatcctcatctaataagtaactaattcaataaaaatatattgattatcttctaggagctaatgaagacagaagacctgctccctgtggttaaagac

SEQ ID NO: 164860 - DNA, 698 bp, Homo sapiens
cctgtaatcccaatactttgcaggaggccaaggtgggtcgattgctggagcccaggagtttgagaccagcctgggaaacatggtgaaaccctgtctctacaaaaaatacaaaaattaactgggcatggtggtggtgcgtaatctcagctacttaggaggctgaggtgggagaatgacctgagcccaggaagtcaaggctgtgctgagccatgatcacaccagggctctccagcctgggtgacagagtgagactctgtctcaaaaataaataagtaaataaatagcccagataagaagccctataataaacttactgaatgttgggaatatcactggataaaattctgcctttgttcttagttttccagcctttcctgatctagaaacagaagcctactttctcccttatcctacagccaacttggactttaaaacaaaacccccgaggtagtcagcaaaggaaggtgaccaagctgacttgcttttccatattgttctgaaagtttcagccaaagcaactaagaaaagacaagaaaatatgatggataagtaacaggagatatatgttgtttgcaagtggtgatatgattgtcagagtagaaaatatattagaaccgtaaggtggtggagtaggtgtccacatataaaatatagtgggatttgtctatgccggcatgaactagccaggaagtaggatg

SEQ ID NO: 164861 - DNA, 429 bp, Homo sapiens
taaaatggcaatattacccaagcattttacagattcaatgtgattcctttcaaactatcaatgacgtttttcactgaattagaaaaaaaaattgtaaaattcatatggaaccaaaaaagagcccaaatagccacagcaatcctaagcaaaaagaactaaggctgaggcatcacattacctgacttcaaactataccgcaaggctatggtaaccaaaacatcatggtattggtacaaaaacagacacatagacccatggaatttgccttatctatccatctatctgccacctatccaccagctagctagctatccatccatccatctatacatcaatctatcaacctatttctttggcaaggctatggaaatgtcatagagaagatgaccctgtaatcattgcctttgctgccaatggtatatttggggt

SEQ ID NO: 164862 - DNA, 496 bp, Homo sapiens
ccccaaatcaactaaactgccaaaaaagaaaatcagtccaaaggaaactgctttccatccctccaaacactcaagccattgatctgttactaacagctgtaagacctatgaaattcttaggccagtgtccaaaactgtactcaaactgaaatggaaaacaatctgaattgctctaaaatagcaattgtgaaattcttaataaccgtaattgagtcactcaagaaaggccatttaagtgaattttagaactttgttgtttactcagggaaaaaaggactgcaaaagagccccaactcaggagctgccaaaggagatcttcacggggtgcctgcctctctgtgctgagcattggctgctgggcacctggcatgtgctgtctgtggtcctgacacagtctactgaagacagagtgggtaagtaatttgcttatgggtctaatgcagagccaggattcaaaactaagcctgtatggcaaaacaaaaaacaaaaaaacaaa

SEQ ID NO: 164863 - DNA, 641 bp, Homo sapiens
gtataatctcttgaggtgcaatttctaggaaaagattatttgcatttaattttacttgacattgccaaattgcccttcagagagatgacatgatttttaaatgcatttttccagctgtatgagcttattgtatttcactgatcttggctacatataccataaacttaacgtggaattaaagtctagtaaaattttaaaccttgattgtgcttcaccataaacctgaaacacaagttaatctatgatcactaatatcatactaaatagtcactccttcatataagcagtgattctcaacaagggcagttttgccccctaagggacatttgacaatgtctctagagacttttggttctcaaaacctaggaggagggtgctattggcatctagtgggtagaagtgaggaaagatgggaaatctcccacaatgcacaagaaatcccccaacaacagagaactatctggcccaaaatgtcagtaatgtcgaagttgagaaaccctaatttaaaacaaggtaaatgtataatatctacatgattacatgctaaatactgagaccataacacactgatccacacacactactatactatgtagcatggaaggaaaaacacaacaaaaaggggggaatataattaatgt

SEQ ID NO: 164864 - DNA, 550 bp, Homo sapiens
gcagggagccagttaagagacttccacagaagacgacagttatctatctggattggagatatagcagaggagacagatgcaaaaggaacatatttagacatgttttagagatggagttgacaagactagctaacagtctgatgtaaggtgtaaggaaaaaagaaaacaaggatgaatccccaattggggacctgactacctgtgccatttagtgggaaagacagagaagaaaagcaagtctgggggtgaaaataaaggttgatttgggatatgtcaagttgaggaatctgtaaggggagattttaagtaggcagttgtctattataatgtctggaatttcagggaaaggtcagggctagagatataattttgggagtcacaggcatctagataacgatttcaaaaccgtatattgggacaagattacttagtagaaatcaacaaagaaccctggactgagggttgcaagtagggtgaaaggaaaaccaagagtgtggtccagaagccaaaacaagggtttctaacaaggaaggcatgctcactttctatc

SEQ ID NO: 164865 - DNA, 108 bp, Homo sapiens
taagttttatccacacaattctaacttctggtatcacgtaggagggcacgccgagcctagcagaaatcttattcttaagcccaaatctcacgtacagatactgcctat

SEQ ID NO: 164866 - DNA, 557 bp, Homo sapiens
tcactgtgtcttgccccacagcagtagaatgatcattaaaaaaacaaaatcagacctttcactcccctgctgaaaactatgtaatctttctattacatttaaaatgaaagtcgagcctttaacctggcctacaaagcggtctgtgaactcaaccctgcctgccacttggcccgtgtgtcacacacctcacattttacccagttttccaggctggggcctttgtactcaaaatttcttctgcctggaaagctcttacccctgattttggaggatcagggctggtttttgttttgttttgtttttaatctttttaagtctcagcttaaatttactttgtcagacccttcctgaatatctgatccaaggtacctattctatccattaattctctgcataaagctatcagaagttttaaattttgctttatcttcgcactccaaaagaacataaagtattaagagagcaatttgttcacttctgtatctacagcacccagaataacgcccagctcgcagtaggtatccaataactttgtgaaactgattggaaggatgatg

SEQ ID NO: 164867 - DNA, 402 bp, Homo sapiens
ggacaaaaccatcctaaaaatattctaatcacactcagagcaattcaaaatgataaatagctaagagaaaaatagattctaaaacaattaaacagaggaaacaaacagagaaactagaactaagacaatggctcattgtcttactgtgtcttagttcactgtgtcagttagtggcaggaggaggaagctgggctgggcactggagactgagaatctgggaaaaggagtactcagatggatgctgtggctgttgcatagacggagagcttgggccagcccaccagtggtgctggtggaagattgcctagtttcaaagttaccattcaaggtcacgaacttggaagttccataatactgagtttcaaggttgcccagaccgatactttctattcttagaacggg

SEQ ID NO: 164868 - DNA, 457 bp, Homo sapiens
cgtttctcagacttgcccaaggacatcctcgaggcagcaggtggcccgccctgcctttgcaagagcttgtccagccataggcacaggttgaatcaatcccacctatcacagcacatggcacgggtcactgtgaagacactagcagggtctgtgtgtgctgagaaggacgaccaggacactaaggacaaatgaagggcaatgcacgggatgccacccacacaagtgtgtacccaccgccatacacacgtgcatgcccccaaccacacaaatgcacaaccccccccacacacacgtgcacatgcgtcagacatggaggaagctcccgggatgtgtgccagctgtgagttcctctgggagacagagtgtgtggggacagcgtgtgtgtgtgaggccagagtgtgagtgagggccagagtgtgtgtgtgtgtgggtgaggacagagggtgcgtgtgaggac

SEQ ID NO: 164869 - DNA, 192 bp, Homo sapiens
tgtactgagtttcctcatctacaaaaagaaaatcagcatctcccaggagagtcagtcttcatggcagttaactgagattgcacccataaggccctggcatgcagcctgtgtagttctcaattggaaggctccttatttttttgtttttgtttttttttttttgagatggagtctcactcttgtccgcccagg

SEQ ID NO: 164870 - DNA, 841 bp, Homo sapiens
  misc_feature (723)..(723): n is a, c, g, or t
  misc_feature (759)..(759): n is a, c, g, or t
  misc_feature (805)..(805): n is a, c, g, or t
  misc_feature (809)..(809): n is a, c, g, or t
gttgttttattttgggttgaaaaatagattttgagataattataataggtcttactgaaagatatcagtgatcaagtctaacaaactactttttgtttatgaccattcaaatcatagtatctttgttaaagaagtaatccctccccagcccacacacatagcagttggggcagagggatgtatgcagagagaaagatttataccaagtcatgcatacatgactctagagggagttagcaagtcacaagtatggggcttcagcagttcaggtctctcgtaccacactccagaaaggactttaacagtgatctagtccagtccttttgatcggctcacaaagagactagaactcagggagctggggtgacctgcctgaagtgtctgactggacacttctcccctctgccaagtactgaacaacccttttagattgcaggagacaaattacaaactaggggcagggttatacatagtgcacatgagaagattgtttttcataagcctgatctatacatgctttcccaaaccactaaagccttcatactaggttttagccacagccacctccttgtatgttacctttcagctctggccaagagtgggacagggttttaaccacaaataggagcagcatgcaattcctagtgacttgctgcacagtattgtatcataattacaggaagtttttatttttaaaactggatctggggtatattcatttgncccatcaactctgtctaaaggcccaagtcctagggntgccatggtcacaaagcacactggatggttccttaagattgttttntctngggcccacataagtgttgggaccaaaaagtca

SEQ ID NO: 164871 - DNA, 106 bp, Homo sapiens
tagctggaactacaggtgtgtgctagagtgcctggctagggactccattctagaatcatggaatcttaggggtcccctgggttgcatcttgactcagtgagtgagt

SEQ ID NO: 164872 - DNA, 433 bp, Homo sapiens
cccttaggagaatctacaggtctggggatgttcaggcaagaatgggcttgcaacatgtgggagctgggaggccgcagagatcatgcaaccctctcattttgaaaatgaggacacagaggcccaggtaggggaaggtgacaatgggctggagccacacccagactaagagaagaggctgcacctggccctctggctccctgctcacaactgtttttgctcaccatcctcctccttgatgggaggctgaaataggcttcaaagcaggcacttgcctgaccccagctctctagacacaccacggaggccaccttggaggaggctgcagagccagaacaggggaacagcagccagcggacaccaggatgccaggacgccagacccaggccagcgtgccattccccaccatgcctgtccatccagggcaagtgggcag

SEQ ID NO: 164873 - DNA, 463 bp, Homo sapiens
agcccctgatgtgaagtacacgaatctccctgtggacagttggaaaccactgaaggattctgagggcaacagtgcctttggctaaagagcctggtgggttggagaggatcaggcagaagattgagcttgtccctcctccatatcgctctgaaggaaggacttggttcccttccttccctgccccacctctccccccacgtcaaggagagtattttgcggcaattaggaacacaggctttgaagaatgatcagctgggttcataccctgagcttacacctttccctgtctcagcacatttagcctcttgaagcctcagttttctgatctgcaccttgggaataattatagctgtgtcaaaggttttgtaggattgaatgtgatcgtggatatcacatgttgacattcagtaaatattcagtggtctagtaactggtcactggaaaaaaatattcagtggatgcc

SEQ ID NO: 164874 - DNA, 229 bp, Homo sapiens
cctcctggtgtcctcccaaagttgaagaaaaggatagtgctgttgagaattgagcaagccttctggactttcatcctgccaggctttacatggctttattgtgccatgagattaggttaattcatcattgccttgggcagggtaacacaagccctgcctgcccacttcctagtcaaattacatttcagtggcctggtctgcttttggtatagtggttactgaccagtac

SEQ ID NO: 164875 - DNA, 443 bp, Homo sapiens
aggtcaggagttcaagatcaatctgaccaatatggagaaaccctgtctctactaaaaaaaaaaaaggaaaaaacaaaattagccaggtatggtggcacatgcctgtaatcccagctacttgggaggctgaggcaggagaatcacttgaacctgggaggtggaggttgcggtgagccaagattgcgccattgcactctagcctgggcaataagagcaaaactcatctcagaaaaaaaaaaaaaagaagaagaaggaggtaagtgtttggccacctatggccaagatgagggatagctcgccctagaaagctttctcagggaagggaatgttgctctcccagccaaacattcttgtatgtggaaaaataggtttgcaaagctaaatcatttcacataatccttttataataatggggccaacacttatgtaaacacactttgaag

SEQ ID NO: 164876 - DNA, 273 bp, Homo sapiens
gaattagcacaatgttacttccccctcattcaattggccaaaataagtcatgagggtagtctagattcaggaaatgaagatgtagactctacctttggttgaaagagctggatataaggtgaggtgcagccattttgcaatcaatctagcacagtcctcatttgctattttttcctttattcactagataccacctgccttatcctagctttgtaaatcatttaactcatctaatgaaaaattttgtcagttccagaatctagtgcaaacttg

SEQ ID NO: 164877 - DNA, 132 bp, Homo sapiens
gctgggcgacagggtgagacccagactcaaaaaaaaaagaagaagaaggaaacgttggtaagagagacatatcgagaacaggctgctggggaacaccaatatttcaaggaaaggctgaggaagaggagccag

SEQ ID NO: 164878 - DNA, 414 bp, Homo sapiens
gcaatggtcagttccatgtctatctcctccagctctctgggcagctcagaaagcagagctcacccgcccacaggaacgggaaggaacctctggggataattctgggtgacttgatctttccatctgcctactgcctccccagcagatgcacacagcctcccacccactcaacatttccttcacctggcatagaggtgacacccgagcttcccctatagaccttgccttcccgaaccgcccctccgggctctgctctgactcatggtttctgtctattttcgagtctctgttgaaagcctcatctgtttctgtgtctctggatttcctgctttcatttttcagcttcactccatcgctagcctactctcgtgggacttaaaacgtcatgtggggatggaaacagcagcattgggt

SEQ ID NO: 164879 - DNA, 529 bp, Homo sapiens
aggagccttccatagtaaatggagggaagtgaaccacacggggcgaacggtaggggaggtaggcacaggccaggccacgttccagcgcgtcatgcgtgccttaggcgttcccaccatgagccccgtttcctcttcagcacctcatgaatcctttaccatctgtaggagactgagtatgaaagtgctttacgttcttgatacccaaggtgacactggctgcccacatgcctattgctgacatgaggatttcatcttctgtctgcagggagtgaagtgctggtgccttcagtggaggcctcattccttttcaagccattccattaacttgagtctctccacttctgcttcaccccaagatctgggttcctctgggagaccacagttcttgagattctagagattagatccaagcacacaaacctctcttgcagaagtgatataatcctttccccaactaagggttttgttgcggatatgacagaagatttatggaaaatgtctagctcagggtctgcaggcactgttagct

SEQ ID NO: 164880 - DNA, 461 bp, Homo sapiens
caccctctacctgttacccagttccagtgttgcttccacattttcagttatctttatagcagtgctccactcctcagtaccaattttcgttaagccgttctcacattgctgtaaagaaatacttgagactggataattcataaagaaaagaggtttaattggctaacagttctgcaggctgtacaggaagcatgatgcaggcatctgcccagcttctggggaggccttgggaaacttacaatcatggctgaaggcaaatggggaccacacagtttatacatggcagaagtaggagagaagaaacccattttcaaagaagaaaatatgttccattataacttagaattgtttttagggtatactaaatcttttaaatgcttttgttacccaggcagaggttgcaatgagctgagatcatgccactgcactccagcctgggcgacagagccagactctgtctc

SEQ ID NO: 164881 - DNA, 376 bp, Homo sapiens
acaggcttctgtttctgtacccacctgtgcctcttgggcacttttaatatggctagtccaaactgagacatgcagtggagtataaaatgcactctgggttttgaaggctcagtatgaaaaaacagaaagtaatatcctttaaataatttttaggtttttgatatgttcaaacaatatttttgattatatgttaggttaaataaaacattatgaaaataaaaaaagtaagtgggaagagaaaggaagctggcactggatgaaaaaagaaactcttgagaaactgtaatgacccaaatctacagtcttttttttttttttttttttgaggcggagtctcgttctgtcacccaggctggagtgcagtgacacaatctcg

SEQ ID NO: 164882 - DNA, 351 bp, Homo sapiens
gacttgcagatatgaaagaacattcatttattcatttattcaacaaacatttgttgagcatctattatatgccagacatatacaatgtaatactgccttggggacatattagaacatagaactagacacactcctgcctttttaggcatatgaagagaataatacaataatcacaaaaaattgtaaaaactatagttgtgataaatgcagtgaaggagaagtccagggtgctgtgagaatgtgtaatagagtggggattggggcagtattccctgaggaagtaacactaaacctgacaactgaaggatgggtccataaacaaagattatacaaaattgtactgatttcact

SEQ ID NO: 164883 - DNA, 454 bp, Homo sapiens
caaagtcgctaagatttagagtgagtcattggctcagctgcgaagtgccacagacccctcaggaacactcgtgcacacacactccacccccagtgctggtcactgctgctcatcattactgaatcccgactccaagcagtcaaagttgggtctttttcccacttctcctgataaaggctgcttcctcacgcacatggttcctcccctctccaccttactcggagcccagccccgactcggccgcatgaaaccaagatgggtttgggggaagctttaggagtctgggatggaggagacccagggaaagggaaggagcttctcatcctacagaggaatgtaaataggaaactggaaggtcttcgtatgttccagtctccctaccctagcctgtctgcttcccctcccccaatacagttgtatttgcagaagaaataaatgagtgtcatggaaacat

SEQ ID NO: 164884 - DNA, 500 bp, Homo sapiens
  misc_feature (36)..(38): n is a, c, g, or t
  misc_feature (289)..(289): n is a, c, g, or t
tggtggttgttgagatggagtctagctctgtcaccnnnaggctggagtgcagtggcacaatctcagctcactgtatcctctgcctcccgtgttcaaccaattctcctgcctcagcctcctgagtagctgggactataggcacgtgcaaccatgcccagctaaattttgtatttttagtagagacgggtttcaccatgttggccaggctgctctcgaactcctgacctcgtgatctacccgcctcggcatctcaaagtgctgggattacaggcgtgagccaccacacttnggccagactgcagttgttattggaggctgtggtgaggctttgctgaggatggggatgccaggaagtcttgtccttcagcatcagtggtagtggcggtggaccaggtgtgtcaatactagggaccatgggcagcgtttgtgggcactgatgatagcctgtctgtgtgggccaatccctgggactccaggtggcttctttggttgctggcagt

SEQ ID NO: 164885 - DNA, 547 bp, Homo sapiens
ggatcaatactttgtatccttcaatccaatcaagttgacactcagtgttaaccatcacaacattttttttaaaattcagaaccccaacttttcattagaattaaatggacagcatttgaaaaatacaaggatggggctccatcccagaaaattaaataaaagccactgggttgggcctgagcctcttggggcttttccaaagccctcgtgtgggcagaaatgagaatcacaggtttggggaacaatcctagttgcttgggaaagtatcacacagtcaactcaaatcctggagattaaattcactagaagtgcagctagagccctgtgacacccacaaagccagcctgagtccctgctggatacagctcaccaggggggatgaaaagccagatacaaacttccccagtctcgctcacagttaagaatgaccaaatgaggctgggcgctgtggctcacacctgtaatcccagcactttggaaggccaaagcgggcgaatcatgaggtcaggagatcgagaccatcctggctaacacggtgaaaccccgt

SEQ ID NO: 164886 - DNA, 185 bp, Homo sapiens
tggagttgtggaagtagacgagatctgtcttggggaatgtacacagcgagaaaagcaaaggcccttggcgaataatgatgtttaaagactccacagacagagtagctcataatggtatgtagagaaggagaagaaactaccagatggataggacagtttgttgtcacagaactcagggaagagag

SEQ ID NO: 164887 - DNA, 180 bp, Homo sapiens
cagccacgtttggggtctggagtgcaggaccacaagagcctgatgtgatgtgtccagactgcacttcccacctgggccctgggcctcaggttcacctgatgtgaatacagttgttgtgacaggaatgtttctactgcaaatgggaaacttcaaataaaattcacctgtgggattcttcag

SEQ ID NO: 164888 - DNA, 435 bp, Homo sapiens
tatttcaaatggctacccaattgtcccaaaaacctttattaacaatcaaaatcaaccttgactccactcaactattattccaacttcacctaaaactaaattcacaagtgtatttgggtctatttgggaatctctgtcctgtcacactggcctgttattcctgagctgagcactgtagcatggaccagaccccacacacctctcttctttttccagaggctcatggcacttctgtaggtcattttttttcttttttgaatatacccttggtacgagatctctgtatattttttcatctgaacttcagaatcagcttgtattgaacaagagagaaacggatgggcattttaaaatttgggattctgttagatgaataatctgaggaatgttttttgaatttgtcttctcttcctttatatcttacaaccaactact

SEQ ID NO: 164889 - DNA, 563 bp, Homo sapiens
ttatttctatcttcagcatgccatctccagggcagtggggaccttgtctgtatctacccggcccagcacagtgcctggtgcatagactgtgctcaataaatattttagtgaatgagcgaataaattaatgaatgtgggttccctcttcccaatctttggacactgggtttcttctattcctcggtacctggcctaggggatagaaaagactccacccaaacccgggaaccctgggtgtactgtctccaagccctttacatggtcccaggggcccgtctgcctctgtgtaagttcccccggggccgaagcactctccaaagaggtctgccggggctaggactcggccggctggggccccgcgcctggaagagggcctggcacacagtgggccttctcaaagtgttagaacaaatgggtgacaggccagcagactgccgatcctggcacccgagggcacccagctgccctgcgcgccttcccggcccgggcgcgggagcggcgagggcgggaggcttggctgtgcttctcccgccgcctggatgccaaaactttcaaaagatgcg

SEQ ID NO: 164890 - DNA, 669 bp, Homo sapiens
cttagaaaagccatggagtttatccctagaaaaatgaatatgcctatatgcaaaatttgtttgatggcttcataggatccaaagaccctgaagccatccatggctcatgtatttctgcttaagaaagcataatcttgttctgctctctcattttacaaatgattaatgcatcccttttcaactactccagcgctgttgctgctgcaatgttagcaaatgcaagccagagagaagcacttgaaaatcctttgatgtctaaaaaatgttcaaatagtgtggatgtttacatatctgaagttttcagcatttaagcaaattaatgatcatttcaacaaatactagcatatccggtttcccttaatagcctgtcagcagtgctgccttgtcaatttgtgtgtgtgtgtgtgtatgtgtgtgtgtgtgtgaattcataaggagtgcttctgatgcttagtccttgaaatggaacttcaactgtctttcaaaacactggcttcaaaataggatgtgttttcctaatgaatcagaagtgggcaatgagcattgttccacaggaataatttttaatttaatttctataaaactagttgagaaatgagagcctgtccacccaccatttgtgtatcagtggccaattcattagtaaaaataaaggaggggaaaggagaa

SEQ ID NO: 164891 - DNA, 419 bp, Homo sapiens
atagcagcagtgtccagatggaaaattgaaaaatggcttgacctagtgaaataagatcaagtgcagagtctaatctgatgctggtgttgttctgccttcaccttctgtctactctgaaggaatcaccatcagggtggtgaatgcttatcatgaacataacatctttattgactgtctctatcatgacaatttgtaattagctttgaatgatttttgcacagctataaagtatttaggattcaaagaaatgcattttggctcaggacagacatgttgaacaagaaaacagcttttattggaagtaaggcagaaaaggagcactaaaatggaaatcagagaaattttttaaaagaaaggagactgggaaggaattagaaatctgaagagaaacatctggtttataaagattgtgagaatga

SEQ ID NO: 164892 - DNA, 336 bp, Homo sapiens
caggatgatacatcatgacagagttggttatatccaggaatgcaagatccgtttaatgttacagagtcaatcggtgtaattaatttaccatggttaacaacaggaaaaaaaggatcatcccagtgcataagatgggtttgatcaaattcaatgtttcttcatttaaaaaaaaaaaaaaaaactcatagaaaactaagaataagaggggcagttcttaatctggccaaaaggaaaaaattcctatagaaaacattatacttactggaattgtaagccaccttctctttgagacagaacaaaacccaaatgactgtttctattcagtattaaacagga

SEQ ID NO: 164893 - DNA, 235 bp, Homo sapiens
ttgggaggccgaggcgggtggatcatgaggtcaggagattgagaccattctggctgacatggtgaaaccccgtctctactaaaataaaaattaaaaaatctctacccatgagcctctttccacactttttataagtgccaccagatatgtagtgttcatagcatttatgaggttccaaacaatactatgtcactagtgtatgaagaactttattttacagtaataaaaatgttag

SEQ ID NO: 164894 - DNA, 536 bp, Homo sapiens
agagcctctggctccagtatcaccaactgtctttagccccaacactggtacctgcaggcatgaagagaaccatccccatacctctcaggcaacaggaattcattccaggctccttacctcacttcctcattgttgccctactaccaaaccatctgtccacactgccctttaccctgctccactgggtaggtgggaaagcctgacggctaagcagacatccaactaggaaataaatgcagtccactcttcttaacatccccaaactttataagaatctctcagcatctctttgcagaagaaaaatattcaggcacttcctctcaccctcaccaaatgtcaaattcatctcagtcctctaaaatcatctggagggagtaggggtatgagtgatgttaccatcactgtaggttccactaaacaatggcctctcagcaagccctggtgccttcaatatcgggtggttacccaagtctacagggtagggtccttagcaaacttcttctttctgtgagctttaatggtcaatcacagggaaa

SEQ ID NO: 164895 - DNA, 248 bp, Homo sapiens
tctctgccccaacgtgttccacaatccctgcctttcacggttgtgtcagctgccactggggcttccgggggattatattttattttcttcatatctcattctgttcttgttttgattgctgtagttagaatagttcattttcatagcacttgtcttttaaaatttggagtgtcactggctgctctcacctcttcacatggactttggaatcattttgttaaattattttttaaaacctgtggatttga

SEQ ID NO: 164896 - DNA, 506 bp, Homo sapiens
tcatgggctgaggtaaaaattctaagtcctctaattttaaacaaaataggaataagctagatatgcattctcaactcggacaatgtcacgcccaaatgagccacaagtggtttttggagtgatggcaaaaatatcttcactattacgttttatgggttaccaaaacacaaccctacctgacaaaaaacttattcctttgtatttatcttctcattaggtagaattttttttaagacttagtgggtacatatgcaggtttgtcacatggatataacggtaacaattatagttatataattgttatattgtgtgatggtgaggtttgggcttctattgaacccatcccacaaatagtgaacatagtaccctattatatagagattattttcaaattaattaatttattgatttatttaaattaaattgaaatgatctctgtaggggagcaatgatgaaaaaaggctgagaaacaccgacctagatagttttacaaggcatctactcag

SEQ ID NO: 164897 - DNA, 386 bp, Homo sapiens
ggacttaagccagttgaaggaaacataaacgcatcaaagcttaagtccaagatgacataacattggaattttaaatgtatttgctctttcagggaacaaagaccccttcatgtccctgtctgttgctttataatggtactttcttaggaatgaattaagttcaaatgcagagaattgccagcatataaaacgcaaggatcagaaccctgagtttgaactcagcccctgtgtacagcctccgtgtggcctctgtttaattagatcgtgctgctatagcagttccttctagctcagttgctttgatgtagtacccaaattttggcctaaaagtgatttaattagtaataatttttaaagatataggatgttgaacaaagtatagcaca

SEQ ID NO: 164898 - DNA, 479 bp, Homo sapiens
catcctccaccagtccatggaaaaatcatcttctgtgaaaccagtccctggtgccaaaaagattggtgaccactgccttaaggcatttagttaactttctgaataaaactattttaattaaagggacggaacaaatcttcattcttgattctctttcattctagagcccctcgagatatacaacctggaaattaatgtcctaactcggccactcacttctgagaacccctgtgttctgactataatttgcattcttcacatgatcacaggcctcccagagtgtgggtgcagaaatagaatatttatgtatcattaatagccaaagtgtgaaatacagctggtgcaattacagcttgattaatgatcaaaacaatgatttctccagataattttgattcttatgtgtgttggttcttggaggagattagccattacatttttgccttttatctttcttgaatacaaacaattcatacatt

SEQ ID NO: 164899 - DNA, 158 bp, Homo sapiens
ggctgatctcgaactcttaggctcagccttttgtgagtatctgggattatagatgtgctccaccatgtccagcttgcccctttgttgacataggcaaagtagaacatcttactgtcattgccatataccatatatggttcagcccctgtatttggaag

SEQ ID NO: 164900 - DNA, 172 bp, Homo sapiens
cccgactagcccgacagtccccgactagcccgacagtccccgactagcccgacagtccccgactagcccgacagggcctggggacaactgagattagacatcatggggtcaaggctctctgtgctggactctgggagagtggagactggtgggcttgctgtgggagttgggg

SEQ ID NO: 164901 - DNA, 386 bp, Homo sapiens
gggtgaggaattgggcacaaggaacagtcaacacacatcttagcctcagtaaaggagaaatgtgagatcccggccccctcagaccttcagtggtggccttcccttcagctgcacctgaaaaccacccacgttgctcctctaccctcctctctcactctgctttatcctcatttcatttggaatctgcaattcagagaaaattagaccaacacctgattgtgagggcagggaccaaaccaggtgtgtgatctcgccttctttctctttcttagttcataatatatttatttctctaattattcctcataaaatatattcctgaaactgcttagaaccaattcagttatcagggattacccagaaccatagcatcagatgctgttatt

SEQ ID NO: 164902 - DNA, 406 bp, Homo sapiens
tggtacatagtcagtgcccatcgtatcatggctttggccatagtccctcgatgtgaagtgaagttcccatagattggaaggcctatcgttgacttagaaactgctgcccaagggacaaagaagaatgcaagcccactatgtgaaatggaagcacacagaaaaggaagggcctcactctgctctctctcttctgtgtgtgtgtgtgtgtgtgtgtgtgtgtgtgtgtgtgtgtgtatgatgagaagtttgcacagagaagctggtgtttaggccaggtcctgaatggtagatagcagtttacaagagaaaagggggaggaagggtgtcagagataaaaggaacatcaatgcaaagtgatacaaggatgagaatgagtgtcatccgccttgtcagatgcctggggaaa

SEQ ID NO: 164903 - DNA, 346 bp, Homo sapiens
ttagccaggcattgtcacgggagcttgtaatcccagttcagttacgtgggaggctgaggtaggagaattgcttgaacctgggaggcagaggttgcagtgagccgagattgcgtcactgtactccagcctgggtgacagaaacagaattagtctcaaaaaccaaacaaaatgctgagattacagatgtgagctatgatgcccggttctgtttttcatttatctgttttctttttcctgccttcctgtggattaactgaacactttttaggattccatttttattcatttataatgtttttgagtgttatctctttgtatagactttttagtggttactctaggtatt

SEQ ID NO: 164904 - DNA, 322 bp, Homo sapiens
ccaggagttcaaggctatagtgagctatgagcatgtcactatactccaaacttggcgacagagtgagaccctgtctctaaaaaacaaaaacaaaattctgctgtgaagttcttctaatccacacactcattgcacttttaacaattctgtgtatcctctctagcccactaaaccaatagatgtttcttactctgaatataatcactcccctttgccctaggttttgaatatagcagaaaataagcatagtggtggagaaatagtttaatctcagttcagcagacctttttctcaagagtccttagaaactcttcccattcct

SEQ ID NO: 164905 - DNA, 665 bp, Homo sapiens
agtggccatgtgagtctacagatggtggtgctggcagaagcattataggtagagaaagcaaatccatatgcagaacatgctactagccctgtgagaatatatctttgccccctccatgatggaagaggtccaatataatcaaccactagcagatggctggctggttcctcagtgaatggtgccatatcagggactcaatgttggactctgcagttggctgattaggcactcagcaataacagtagccaatcagtcttgtaaagggaaagaccttattgttgaacccatgaagagctcccaaccctgccaatatagccaccttttcatgggtccactgagcaagccctaatgtgggtgaataaaaggctgactgacatgcacacagcacgttgttctgtccagctcactagcaagtatcctttgcagtagatgccctttaacaggcattcacatggcactcaattttcacagtttgtggacattcagagaggtctatccacacacctcttccctagacttccttgtcaccagtcttcacatcctgtttgttccaggtctctgaccaccaagataaaacattagcaactatacaaaaattagccgggcgtggtggcaagcgcctgtaatcccagctatctgggaggctgaggctggtataatggcgt

SEQ ID NO: 164906 - DNA, 577 bp, Homo sapiens
caaaggtcacacccaagacccagatatgatcgcgtgtgttgacacatagccttctggaatgcgactaccgttgtgcattttattaggaaaaaaaaaagttaacacccttaggctcatgatttggcaggtgtgtatccatcaccaattgaaatgggaatatgtgggggaaaccaacaaattacgttagtttcattcttagctctcatgtaaatgagctcctttgagcttaacaactacccggtaggtagatattattcttcgcatcttgtgcatcaagaatggtgctcggagaggtcaagagactgagcagaccatggtgttagttctgttgaaaagaactcaggtcttctgagctcaatctctggtctctccctgcagttttcttagccatccagttcatccagcaagaccctcagggctgcatcatgtgtttctctacagaaggatgtgctcctatgtggacacacttaaattgaacgtgaattgcctaggatggtatgataatgcagaggagattaaattcatgggtttcaagaggttttttaaaaaaataaattttagctcattcatacattca

SEQ ID NO: 164907 - DNA, 341 bp, Homo sapiens
tggcctaacggtaggaggtagaaggcagaaggaaagtaactgaattgagaagctgtttctgtttaataaggtgttgctgaagctagttaaaccctctacctgtctttaaaccctctacctgtctttgggttaatttacatgtttgtcatccccttacctggatatttatagctgtacccaggaaccttgtctatactgagaatatatagtgatgagggtttttctttttcccaggtattcctgattgtcatcaagcttatagtagatgaaccactaaaataatactacaatttgacattagtgttcttgtactttatgctattgaaacttctaaaactagg

SEQ ID NO: 164908 - DNA, 321 bp, Homo sapiens
tagtaggtgctcagcaaatgtggggccagtgtgcagtgggtgctcagtaatgctgggtctgtgtacagtgggtgctcagtaaatgctgggccagcatgcaataggtgctcagtaaatgtggggccggggcaggttggtgtgcagcaggtgctcagtaatgcaggactagtgcacagtaggtgctcagtaatgctggggttgtgtgcagtgggtgctcactaaatgctgggccaggatgcaataggtgctcagtaaatgtggggccagtgtgcagtaggtgctcagtaaatgtggggctggtgtgcagtaggtactcagtaa

SEQ ID NO: 164909 - DNA, 373 bp, Homo sapiens
caaattaaggccagacacggtggctcacgcctgtgatcccagcactttgggaggccaaggtgggcagatcacttgaggtcaagaaagtatccaatcattgtttcctttcctcctcttgctccaaatctgagctggttattctccaggcctgctgcacagcttccatccaggcccttccctttgtaacaatcctgcaaacttccatgcctctgcctgattaagatgccctatgtggtttcctcttttggtttttcctactatctgtctcttccctcatttcatttttggatgacaaaaatggcattttaatacattaaattttaagacattttaagacatcttaatcatttaagaaagttccttcagaagcatt

SEQ ID NO: 164910 - DNA, 287 bp, Homo sapiens
aactacagtgccctttagaaatgtactgctatattataccttcatgggaaagtcatgaatatactctcaatggcatcagaaccaaatgcatcaattcagattaacttatgaatattacaggtagttcttaaggttcttaaggtgttagtatcattatgatattaaaacacttgaaatagaagaaaatgagttttccaatggaaaataatgtttcaaactaaaatacataatggacccggacagatcgagtcttccttaagagtatgtctcatagggagggatcctca

SEQ ID NO: 164911 - DNA, 333 bp, Homo sapiens
agtcaaacgcaatggctttgaggcagcaggcaacatgacaggtcttagcatcatcaaggaactggagtgcagagacaaggtcacagccagccagcaaggactcaaagtaggatcctgaaagcccaagtagggattttcacactcagtgacaagggcagccattgtagagatttaagcagagtggcatattctgctttcattttttttttaagtcagtgttactgagatatagttcatatagcatataattcacctgtttaaaagtgaatatgtcaattagccaagcatggtggtgtgtgcctgtagtcccagctacttggtaggctaagacag

SEQ ID NO: 164912 - DNA, 272 bp, Homo sapiens
ctgatcagtgagggcaagtctctaacttttagccccagtcctttactcttcttctagaggccatctctttcaccggtttcttttgtaccatccagagatagtctatgcatgtaggcagaaatatttttccgttttctaccttgtagccagctccctttttaaaatgttctgttcctcctcttgattttttcacataacagttaatttcgtgatagttccttatctgcataggactctgtctcagattccatcgtatggatgtaatttattta

SEQ ID NO: 164913 - DNA, 154 bp, Homo sapiens
atcctaacaacagatggtcctgttttgaattaaaacaatttaactcaagatccatcaactgccaacatcaaacacccttaaaagaaggaaagaaactcattatcaagagtatttaagcaaagtaggtatttaatctatcttaatcatttgcatt

SEQ ID NO: 164914 - DNA, 498 bp, Homo sapiens
gctcaggctatgggactagcttgaggtctgttccatgtttcttcattttgagaccaggaccactgtggggcaggttgttctcacgacagcagaaatgcaacaggatgagcagaaacatgcatattatgtctcttaaagtcttagctaagaactagcacattttttttttagaataacaaaaaatattttactaaaacgtaagatttacagaagtttccagataagccatacgaaatggtcacaagattttttgaagaggggaatctacacttgacagcaaagtcacaatgttgttagtgagggctgtgatatttgtttaatgttcccattttagttcaaacagtcaagcttgtccatctacattgtctaaataaagttagatttggttagagagcgtattctaaagaactgcttagctgcttttaaccaatgcagttagatcaccaaaaaacgggagaaaggagcccataaaattaaaataaaaccagctcccttctc

SEQ ID NO: 164915 - DNA, 418 bp, Homo sapiens
cctgacacatctgacccagaccaactccaagatctggagaaagagggaatggcaagtccaagggtctgcggctggagggtgacatcagagagaggggcagagagttgggggtgaggccggagaagcagcagagggtcagcctgtcattaaccaacaccgccatccctcgcccaccatgtccagccctttgctgggcgcaggggtcccaaggaggatcagctttcggcaagatgatgacagtggagcctggagggcaatcagaaaagacttccagggggtgacatctaagctgaacagcatatgccaggtcagacatggaggagaggcagaggcaaagccagaggacagagatggctgcgcagggcccattcccaggcactgagtggactcatggctgggcctgggggcagagggcccc

SEQ ID NO: 164916 - DNA, 703 bp, Homo sapiens
tgtaatcccagcactttgggaggctgaagcaggtggatcacctgaggtcaggagtttgagaccagcctgaccaacatggtgaaaccccgtctctacttaaaatacaagttagctgggtgtggtggcaggtgcctgtaatcccagctactcaggaggctgaggcaggagaatcgcttgaacctgagagatggaggttgcagtgagctgagattgcactgctgcactccagcctgggcaaaagagtgagactccatctaaatgaatgaatgaatgaatgaatgaatgaatgaatgaaaagaaaaatagtctcattcattagccaacagtaccctgaggtaccttgaaaagaacctcatgacgtgtacaagactttatgaagaatattaagaaacaataaacatacaaaatgtaaatgtagacctgatgaaatagcaaaatataccatattcatggattagaagactcaatattttgaagatgtcaacttactctctattgatgaattgcacataactcctggcaaaattccaacaggaatttaaaaatcaacttgagaagtaaatgttagaattcatatactagaagaaggagccaagaatagccaagataaactgaaggatgtggccaagttaaggggtcttggcctattagatattaaggcttataaagcaatggtaattaaaatagtcttatacagattatt

SEQ ID NO: 164917 - DNA, 890 bp, Homo sapiens
atcccgtctctttctccccctccattgcagagacaccgtcactctccacgtgatttccacatggcgtgtttggtcatcagagccaccgtctttcccctgccgtcagtaccttcctttaattactgagatggaaccgtccaatgagatggtttttaaaagaagcaggcagcttataggattctcctttccacagctgctgggctgatgccatcacagggtggttcttgtattttgtaacctttgacattttcttgggccctttcagcaaaaaaaaatatgatgcacgttttaacttctcagctgtcgccccagttttttcaggtaaccgctgatgcatagcaggtaaggtgttcaccgcctgcgggctgtggtgtcttgtggctcggcttggggccctttgttggggacaggctccaaaaatttcaaagctgggcacaccactgagtgatggcatggccagagtcggaaggcagagcatcggccgccgtccgtgaggccatccgaagcgtgacctcatctcttaaggggcaagaaatctttactgtgtcaaaataaatacaagccaaagtgtctccctgaagcaggaactccttcccttggttccatttcttccctgtgtagccacctccttcctctgccatggtcctcccaaccctcctacagtttcacatttaatctgcaacttttaaagaggagccttcgttccacatagaatccgtatcttgttcttaagctgatgacacttggggctgctcaaggcccatgcagtggtgaaggtgtgtagaggagtttggtttttcttaggtcctgagatggccacatgtagccccttcacccctcggtttccaggaggattaagggagccacttggcttgctgagctagagggaa

SEQ ID NO: 164918 - DNA, 381 bp, Homo sapiens
tagtctcctagctccctgcctttgacggcaaagtgggcttgggtgtgtccctgaaccaaaaggctcaatgcctgaccaggtgtctcctcacacagccctctctgttcatatcctcctaacttaactcttccattgttctctaaagcctaggggcttcagaagcagcgctgaagcaccccagggttctgtaatatcctttgttgttgtactataccctgcctaatatacaaatgggagagtgctacctgcttcctatccagtctgaaatggaagtttttgagaacaaagtgatcacttctagctgttaggaacaattttgttatctttgattatgtagtatataatggttagaatagaaaactgaaagttttttctatactc

SEQ ID NO: 164919 - DNA, 523 bp, Homo sapiens
gcaggtgacctttgcagcccagccaccattgacatggcagaactgtcgtgggtcagataagatagattattagattagagaattatttctttttgtgcgattggcatgcattttacaaattaagtctttagagcatttaaaattcatccctggccaggcatggtgctgcactcctgtaatctcagcactttgggaggccaaggtgggtggattgcttgagctcaggagtcgataccagcctgtgcaacatggcaaaaccccggaagtgggttgcagtgagctgagatcgcgtcactgacctccagcctgggcaacagagccagaccctgtctttaaaaaaaaaaaaaatttatccctgatgatagaaagctgttcacctctaggaagcacgaagccctccctgtggaggagttcagtgttgatacttgattaatgagcccatatgttaagcagagtttccttatttatgtacataggaaacaagattgttgtggctttggggtcaggttagggaaaccacaaa

SEQ ID NO: 164920 - DNA, 567 bp, Homo sapiens
aactaagtataaaagctaaacaagtgaaattgaagcagttttattgtaaggtttggaagagtacaggatgtttatcatagcacattattaatatttattactcttcctatgtagataagtaatgtcctagatttacaacatagaaaaacaggtagagacgtttagctgtgagtgtgcaagtataaatcaattaagtgccagattttgataatcaccagcctctcattcaactcctatgttgcaaagttgctcttatgcttttcttacattacttgataaaggcaatgtttaattacatatttcctattaactagctggtagagttcatacctaaagtcagtaaatgttaagaattttttccagctgagcaaatgagtatgtatctagttgtaagaaatcaagaagaggatataaaatgtaatcaggatgtggactctaaaacggaataacctctatgtcctgtaacttttatcactcgtaataatacagcattctcaccctattaaatggaaatttaaagcacccttaaattccagaataattaaaattgctatttggattgaaaaa

SEQ ID NO: 164921 - DNA, 488 bp, Homo sapiens
taacccctgagaaccactgatttgtcctccatttgaaaaatttgtcataagagtgtcatataaatggagtcgtagaaatgtaaccttttcgattggcctttttgctcagcgtaatgttcgctctgttttgttgctgagtggtctccgtggtgtgggtggactcagcttatttatccatggtgagaaacacacattcacccgtccacacccaaagactgggcttggagacacacagaacagcagaaatgagacttttttctttctctctcttttttttttttgagacagagttttgctcttgtcacccagcctggagtgcagaggtgtgatcttggcttgctgcaacctccgtctcctgggttcaagtgattctcctgcttcagtctcccgagtagctgggattacaggcatgcgccaccacgcctggctaattttgtatttttagtacagacggggtttctccatgttggccacgctggtctcgaact

SEQ ID NO: 164922 - DNA, 323 bp, Homo sapiens
cactgggattacaggcgtgagtcactgcaaggctgtctaaaatggctttttttttttggagagggatgtctcgctcttgtcacccaggctggagtgcaatgacgtgatctcaactcactgcaacctccgcctcctgggttcaagcaattctcctgcctcagcctcccgaagaactgggattacaggtgcccgctaccatgcctggctaactttgtatttttagtagagacagggtttcaccacattggacaggctggtccttaactcctgacctcaggtgatctgcctgccttggcctcctaaagtgctggggttataggtgt

SEQ ID NO: 164923 - DNA, 895 bp, Homo sapiens
cagggggaggaaagagatattattatctgggggctgatgcaggagtaccaccactggagaagcaccaaacaggtagatccaggcagacggattatatgcagccttgcaaaaggtttttggttctcacaggtgacacaaagtagcagaaagctaagaggacgtgaagaggcattcagaactagtcatctcattggcaacttgtatgagacagggactagagcagatggcccatctcccttctccctcccaatgtccagacactgtggaagactctagggatagagcagaaacctagtgtagggccacaaagggaagctctgcattagaaactaaattaagctacggagcacttaagaatatttctacttcatttgagtttgtggactaagacttatgcccacaatagctcttatattctccttactttggttaaggattatatcaaatccatcaccccttgaaaaagctttataagagatgcgatgcattttaagtactttgggaaatctgacagaaaaaattaatgcagagtcatatagctctcacctttcttcttcaggattatttaattgtggctggaagtcctgaggctctgtacttgtaagcactttcagtacaaagggtgacactttgattaaggcagttgaatataatggttaagtacatgaattttgatgctgtcagaaataattgttgtaaacagaagcttgcctaaattcatatctagggtccacccctttcatatgctgtgggaccttggggtatctgtgcctcaatgtcacatgtatcacagaaataaaacaggggcagtaacagttcctatctcacatcattgttatcaagattgggtgcacgtttgcaaaatgctcagaatataggaaactagatgtaaatg

SEQ ID NO: 164924 - DNA, 222 bp, Homo sapiens
tcctgtcaagggaagtggtatcagtgagcaatgaaggtctgtggaagttaggtaatgtgcacaatgtgagtgatagagctggcaagagccgagctagtctttgagtgaagggctgctctaaagcccatgtgttttcattataccatgaatgctcttatcctccaggatataaagataatctcatcctttttgttttttagacagagcaagactcagtctccc

SEQ ID NO: 164925 - DNA, 465 bp, Homo sapiens
cagaaatttgctttcttctcatcaaaacaaagaaacattgttggagaagactagtggaagacttaaagggtgttttcaattgattttagggtcagcgattttttaaggaaatagtaggtagccattttttaaaaattaaacttttcattttgagataattgtagattcacatgcagttacaggaaataatacagagatttggcatatgcttgaaccatttctttccaataataacatcttgcaaaactatagtacagtatgaagacaggatattgacatttatacagtcaatgcagaacaattctgtcaccataaggaccccttttataaccccactcacttcactctttatgctccacaccctagcctgtttgtaaatcctggcagctgcttatttgttctccatttttgtaattttatcatttctaaaatgttgtataaatggaatcagacagcatgtaactt

SEQ ID NO: 164926 - DNA, 480 bp, Homo sapiens
ctcaggctccaagatataggtaaatgcagagataactggaaaactgagagaggcagattctacactctaagaggactgtagaagtatcctaccaacaaatactctcttactttcatgaaaacagagacccattctggagaaattgcaagaaacagaaatagacctaagcaaagcaaaaagaatgagaaccctccaggagagataagattcacattctaggtgggcaggaggtccaagtgacacagatctcagaaagttccacaacagtaaaatacatttaaaggggtctattcagaaagcaaaatacctggaaaacataaaggtgaaaagctttactacatctcaaaagtgcaattaaaaaaaaaattcacaaatgcggcctggagccacacagctcaaaaactgcactggtctatcccctcctcctacagaagttcttccttctaaaactacaggaaaaccaacttgtttaaacaatag

SEQ ID NO: 164927 - DNA, 525 bp, Homo sapiens
atggtagttgcatatatagtttttaaagaaacttccaaactgttctggagtagttataccattttatagtcccatctgcaatgtatgagtgatccagtttttttgtatcctagccaggatttggtgttattactgttttttatttaagccattctgataggtgtatagtggccttaatttgcatttccctgagggctagtaatgttgaatatattttcatgtatgccatctgtatatcctcttcagtgaaatgtattcttattatttgcccattttctaattggatttttaaaaaatgtttgttctttcatagaaaaatgtttttaattttgatgaagtccaatttttcccttacaaaaattactcaggcgttgtggtgcacacctgtgatcccagctacttggagggctgaggcgggagaatcgcttgaacccaagaggcagaggttacaatgaaccaagattgtgccactgcactctagcctggatgacagagtgagactccatctcaaaaaacaaacaaaca

SEQ ID NO: 164928 - DNA, 390 bp, Homo sapiens
cagacacccttcaaaattggatattgtcgtcaaagtgtccaggaactcttcagctctgagtctttgagaactcagcttgtaagctgcgtcctgcctgtggaactgccgatcctggctcagccgagggcagtgtctgaaggatggcggagggggtagcgtttgcagaggctgagaatgctgtgttagcagtttccaccggtgtcttcccaacagcctctcggagcctcctgggaactcttgatctctttggccctgagtttgagaaccatagatttatttagactgttgatttttaactttctcaaggctcagctcattatttgtttattcccaaaggagagccttctgccccatggaataaacagcactaagcatccttcccatttgcct

SEQ ID NO: 164929 - DNA, 658 bp, Homo sapiens
aaacatggtgcttagattttcagcccaagtattattttatcttagagttggaaattctcaagaagcctttgcaaagccccacaaagggaaaacttgatgtgttcaggactcagatgccattctgatgagctctttggagagatacggagggggaaagtggaacgttgtgaaatcaaaccaacaattacaatgtctcggaacatcaacgtggttggaaattattgattcaagtcacgctctccaccaggccactgtctgtgagcagtgttctttaaaaagaattatacagccacttactaagtatctataagtcagatttatttccagctactcccatatgtgtcctctccgccccaaatggctggccgtcctccctgctcttggcttagcctcatttctgtggctttgctgaagctgctttcttgccaagtaggccgtgcctgttctccagtctagggacatccgacgcagcattcaaatccttcctgagtcctcctttctcacgtcttggtctctccttgttcagaggtgcaagtttggtcttcccaattacatatcactgaaggtgaaccacagtctccccttttcttccatcccttaattcccagcaaagtttaacgaagaagaaagagcttcagatcagtgtagtcaaaacccc

SEQ ID NO: 164930 - DNA, 440 bp, Homo sapiens
tgatgtgcctgactctgcctcccagagtgctgggatcacaggtgtgagctaccacacccggccacaatcattaatcttaaaacaaatttaggagagccagggcagaggtaagggatatcaaaggagggcagagattcttccttcttggtcctcaaccatcctgaagatggaattccctcgaggctgccacctggagtcccatggaagaaacggggaacggaaggttaatctcacacaggaaggccctggacaagttggggtaattctcaccatgttgtccttgccagaggagcacggaaagtcctggaaggtgaactttctcactcagggtttggggaatcccaaaggctccagaactttggaatcaaacaaatctgggcattaatttcaactctctcacttcttggcaatgtggcttcaacaaatttcttgacctcaaa

SEQ ID NO: 164931 - DNA, 192 bp, Homo sapiens
tcctcatccccatcccaggggagaacgtgaatgttccaagggacttcggcctctggggcttccacactctgggtgtcaggggtacagctcacaggctttcagtttggccacagctgaatgattgagaattaccagataaatcctccaaatccatttctccagaaacctcttcctagccacacagtgggagcc

SEQ ID NO: 164932 - DNA, 582 bp, Homo sapiens
attccaatctagcctcaatttcctcatctacttaataggcttgttttgaggaagaaaggagattaggtaagaggtttggtttggtttagtgcctagaatacagcaatcgtggtgccaaaggggagggaaatatttccctcaaatcgctttttctcagttttttgatatggccaactggtattttctaccttaatatagagtactatgcaaaagcatcttcaagtcttccttccagattactcctctgtccccatctatttggaaattctggacctgccacaggattacagtaagataaccataaatgtagctttttaaaaattgattttctcctatgtgccatggagaaagggaaagggaattagtaaaagctcctatctctttggttattttcagtcttggttaacgccgtccttttagttggccctcagtcattgctataacccaaatggtcttccacaggctctcctcgaggcttctcgcttgcttccatggcattgtccctatatgccaaccatgtccaaaccttattcttttcatttccaaaccttgttcttttccaaaccttatttgctctgtcgc

SEQ ID NO: 164933 - DNA, 399 bp, Homo sapiens
ccctagggcaggaatcttctagggttataaacagaactttaatcaacctctccttggttattttactggttccatgatacagctttttctgtgcaaaagatctgaacagaaactcacagaggatacaagagtggcaaaaaagaacatgatattcagcattgttagccattacagaattgcaaattaaaaccacaatgagatcccactagacttgttagaatggctcaactaaaaatcactgataacaccaagtgctaacaaagacacagagcaacagaaacgtgacagattgtcagcgggaatgcaaactaaaacagcctccagtttaccaaggtagacacctcgagtcacagaatacagagtagaacccagccaggaacacggctcaggtgagaacac

SEQ ID NO: 164934 - DNA, 217 bp, Homo sapiens
gacttaaggggtgagagatgcaaaactataatagtgagtcaaagaggacaagagcctaaattctgaaaaaagcctattgaacatagttggagagaaaatgatgtgtatgtgtttgtaagtttggtgtcagtgcactggtggaaatggagaaatataaaatgactcagaaggtgagggatgcactcagcaagttacagaatacaagaggaggaacaga

SEQ ID NO: 164935 - DNA, 307 bp, Homo sapiens
agaaagcacagtccttatgggaagttccaaatagttctaaatgactgaagtataacatttgaggtgagggaatagtgaatgatgttacaggaaagacaggcagagacatatatatgtattatataaatactttatgtatacctatagcactatatgaagtcctttaatattcaaccattctgattaccttcttactccaattttccaattaggtgcataacatgctgtgagtgtagaatgggtttcagcttcccaatatcagtggagcctccattctatatggtaccataatttgtcctgactacca

SEQ ID NO: 164936 - DNA, 502 bp, Homo sapiens
ggtgctgctccaggctgtcagatgctaacctgggattgtgggcgcctgctccaggctgtcagatgcccacctgggggtgtgggcgctgctccacgctgtcagatgctcacctgggggtgtgggcgctgctccaggctgtcagatgctcacctgggtgtgtgggcgctgctccaggctgtcagatgctcacctgggggtgtgggtgctgctccaggcagtcagatgctcacctgggggtgtgggtgctgctccaggctgtcagatgctcccctggaggtgtgggtgctgctccaggatgtcagatgctcccctggaggtgtggggtgctgctccaggttgtcagatgctcactgggggtgtggggtgctgttccaggatgtcagatgctcccctggaggtgtggggtgctgctccaggctgtcagatgctcacctgggggtgtgggtgctgttccaggctgtcagatgctcacctgggggtgtggggtgctgttccaggctgt

SEQ ID NO: 164937 - DNA, 402 bp, Homo sapiens
caatcagatggctgacctgcatggactccttatcagaatgatttgaaattattctgctgggatctttggttgttcagaacccactgagttgtaatctgcgtcagtcttagatgacagagccatacctagcttctctgagttagttacaatctactctgtaaagcgttctaaggtagcacttgttgttttcaggttttcctcccgtcactcgtgcacattcggagatgacatggtctacttaagcttctgtgtctccttggtcagcaccatcattagcccaaggtcctaaaagtgaaataatgaagactttcccaattctgtgccttattgctgacactcagagtcccctcaacctgctcctaattgtccctacaagacacccgttcacctgcgaacctatga

SEQ ID NO: 164938 - DNA, 546 bp, Homo sapiens
ttagacctcaacaagaaaaatataaataacccaatttaaaaatgggcaaaggatttgaatagacatttctccaagaagatacacaatgtctcctaagcacaagaaaagatgtttcattagccatttaaaaaatgcaaatcaaaatcacaagatgccactttagaccgagtaggataactgcaataaaaaaaccccagacaataacaagtgttgacaaggttatgaagaaactggactactcagacatggctggtgggaatctaaaatggtgcagctgttctggaaaacagtcttgaagttctttaaaatgcaaaacatagagttaccatatgactcagtgattttactactagatatgtatgtgctcaagagaaactgaaacaaatgtgcatacaaaaaaacttgcatagaatgtaacagtgttcataatatccaaaaagtataaacaacccaatttttccccccctgaggaatagacagattacatgtggtatcttacaatgtaatattgtttgataataaaaaggaatgcggtactgacacaat

SEQ ID NO: 164939 - DNA, 179 bp, Homo sapiens
agcaatacatattaaaatattttttaaagttttaggctctcatttagctaaatgaatgcaaagttaaacaaacattttgtaggattttaaagaatagttccttttcaaattgttggcaagagggtgggttagatagcaatgataggcactgttgtctcaaccacttcttttataaatgg

SEQ ID NO: 164940 - DNA, 577 bp, Homo sapiens
tttactcaataggtgtaataataactacgtatcagattgttgggaagattaaatcagggaatatctatccttatcacagtgctccaatatatagattttgttgctcatttcttctttccagctctatcccatggctcagaaagaaacaacaatgtctagaacatataaaaatagagactaactctccctcctgttatctgaagggtctttggctgagattcaggaaatcttggagaccaggcaccaaaggattttgtaaaggaatctgtagtgggtctaagtaggcactttttaaagcatcagccatcttcttgaatgtcatagtcacattaaaagagcctagttaaatgtggcttagatattgtttcacaagtggccttagtggaatccctgtaaataaatatgttagaatattaggttgggaaaatattgttttgtttaatctcatgtgattctttaaataattgtcacattgttgtgtttagaattatctagctatctggcctagtaaacagatgagcaatattcactgagaggggaagtatatacaatttggtttggaacgtggaagagaacc

SEQ ID NO: 164941 - DNA, 135 bp, Homo sapiens
ggaaatctggtatctgtaagtccatctgggatgggttatagccagtttgccttcagaaggaaagacctccaaaggtccttttaactaagatttactacacttctcagagctacatccttcttcttggcttgattc

SEQ ID NO: 164942 - DNA, 542 bp, Homo sapiens
ctgcccactatgaacccaactgtcaatcaggcaagtccccttcacttccatcttctgtgtctcctcccatgcctgtgctagctcaattttcaccactgctccagtctaacaaattgccatgggtatgctaccctttttcaatccattcctacagtgtggttaagcattgctagaaacaagcaaataacatacagattgatattccctgatgttttttatcaggtttgatataaatcagcctcttacattttatctgcttttccatttatctttaatttcttttatcccatctatgggaatgaggtcttcctattccttctaaggccaattttatgtccttggctccattccctccagtattctgtgtgtcttcattttatgaggtaacttgtttttcttcagtctttagtatcttcttttctacaattacttgactgtcaacatatggctgtacccaagatttttctgttctgtaaaaagatgctttatccctcaaatttatgttactgttatcaattcccctattgtctaatttttttaaa

SEQ ID NO: 164943 - DNA, 362 bp, Homo sapiens
gtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcggcctggaggcccagtgcaggatgccgagaacctcctcgtgggagcgcccagtggggacctgtagggacccctgatgcctctggcacggcaggacggcctctcagccccgcacgagcccgtggaggtcatggtattcccgggcctgcgtctgagccgtgaagccttcctcaccacggccga

SEQ ID NO: 164944 - DNA, 381 bp, Homo sapiens
ccagaccctgggtagatggagccgccgttttacagaggtaaggacaagagtttagttttgaacattccaaggggagatgtccaggacacaattatatacctaggctgccattctgggaggagatctgagtgggagaccatgatttgggaattatcaccacagatggtaatttaagccttgggagaggatgagtttgcccccaaagagagcataaagtaagaaaattgggctctccgtgtttcaaggttgactaaagatcctgtcatttgactaggctctgctatagtctgcaaaatctgcccagggacagaatattgaagtaaataaagtgtattccaaaaacctcaaatagattgattcaaaactggagttagaaaaact

SEQ ID NO: 164945 - DNA, 400 bp, Homo sapiens
ccgactctagagcagccccccccctccctgggaaaacgacccactaccacactgagtttgtgccatgagtttagttttgaacattccaaggggagatgtccaggacacaattatatacctaggctgccattctgggaggagatctgagtgggagaccatgatttgggaattatcaccacagatggtaatttaagccttgggagaggatgagtttgcccccaaagagagcataaagtaagaaaattgggctctccgtgtttcaaggttgactaaagatcctgtcatttgactaggctctgctatagtctgcaaaatctgcccagggacagaatattgaagtaaataaagtgtattccaaaaacctcaaatagattgattcaaaactggagttagaaaaact

SEQ ID NO: 164946 - DNA, 170 bp, Homo sapiens
gtgtgagccaccaagcctggccttaattaatgtttgttgcatagagtggcactgataactttcatttttctagaccctatatatatatttttttgtttgtttgtttctgtctcaaaaaaagaaaacaaaatatctttcctgtgtccaaagtgtttacagttaggtggggg

SEQ ID NO: 164947 - DNA, 314 bp, Homo sapiens
tgaatatttatttctggaattttccatttaatattttgggatggtggttgaccacagggagctgaaaccgtggatgggggcattcactactgtaatcccgtgcaagagggtgggaccctcctgatgtaatcccctcctccagaccctaccttctaatgccattaccttgggggttaggtgtcaacataggaagtttgggggaacacatacattcaaaccctagcacctcctctcttgttttctttttctccctaacagaacccttctaacaaaacacatagatattttaaatgtttgttttctgtctgttccat

SEQ ID NO: 164948 - DNA, 122 bp, Homo sapiens
agaacacaagtgcctggggctgtggggcagctgggttccggccacactcacctcgagggctgcgtcatttctatcgggttctgatgccccacatcatcggggccagagcgctgccttggcca

SEQ ID NO: 164949 - DNA, 376 bp, Homo sapiens
gcctcgtcgcccacataggaatccttctgacccatgccctcccaccacgccctgctgcatgaagcgcacctcgatggaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggtgtatactagtgagggcctagattatgccctataactgaaagctaggttatctccag

SEQ ID NO: 164950 - DNA, 687 bp, Homo sapiens
gcctcgtcgcccacataggaatccttctgacccatgccctcccaccacgccctgctgcatgaagcgcacctcgatggaggtgaagaccaagtagaggtcaatggagctgtctttcccaagccctttgtggagaagccagtgagtgcagaagaccacaatgtttacatctactaccccagctcagctggaggaggaagccagcgtctctttcgtaagattggcagccgaagcagtgtttactctcctgagagcagcgtccgaaagacggggtcgtacatctatgaggagtttatgccaacagatggcacagatgtcaaggttatggtggatatagggatttaagaggttacaaatgtgtgggtggggatggggtacttgggaagcaggtggaagtatatggggaggaggtcctagaaaataacatgatgtgaatgtgattggctttcatattcaggtgaagataatgagtggaggatacagacattcacattttcactatcagagcaagggcaaggctgacttagaaaaatggtataatgtttgtaaattattttttaataaggactacctgacagtagtggagtcccgaggagaaattcataatgatacttcagtaaggctcagtaggaaaaatgttggtcagtctccttaatgctcaggatttgttttgtttttgttgttgttgtt

SEQ ID NO: 164951 - DNA, 461 bp, Homo sapiens
agttatgtgatttctattttttacaatattatacttttgatcatagagagataatattactgccactttaataacagtgttcaaatacacactttctttgaaaggtacttcagatcccaatgcctgactgcaagacttaaatgctctcagatacagacacaaattgggtcaaagccatattgaatcatcaaatatgacagcattttcttacttctgagtataaccaacagctaacaattttcagattcttttctaatttctgcttttaacaaatacataatgcatttgtaataccagactgtgtgaaatatgctgagtactgaaggagattctagtagcagctctatgacaatttgtgagaatctggacaaattccataaattctacacccatctttgctgttattgaaaatggtgaatgcagatcaaatgtattaaaatccgtttcaatgctgatttctg

SEQ ID NO: 164952 - DNA, 320 bp, Homo sapiens
ggctggaagtaaatggtatctttctaatctaaagcaatgccttgcatataatctactctttataaatgtcttgaaattcaataacctcataatcccaaataaagaacgcagcaaatatgcacacttatggcatatccaaaagacttacaaagttaagcaaaactcaaattagatctgtgattctcctagaacaccaagagtctgtagaaggcacatggtcattaagtatgagcaacagcctaggtactgtaaggaatcattccttacatttatgtccagctaaggaggcttttcaaagatttatccacatcctttcatag

SEQ ID NO: 164953 - DNA, 496 bp, Homo sapiens
acacttctagatactttctagctactcttatgctaagattaattgattaactccacctctccaattcccataacttattacacaatacttaagctatgactaataataaaatacatactcatgtgccaatgtcccagcttaagaaataaaaaatgacctaaacagtcgaaacccctatttccccttccctgatggtatcctctacccatccctccaatggaattgtttttcagtattagggatttgtaattctcatgcatgcctttatcatttccttcatatgtatgaatcgctaaatcatctatattgttgtttggcatattttaaaactttatatcaatgtcatcatattatgtatgtattttgttttcttccctgagactaattttgtactatgttggtatatgtagctctgcttcattcatttttgtggctatataatattgtattttatgcataattataatacaattcatttatccattccatttttgtt

SEQ ID NO: 164954 - DNA, 163 bp, Homo sapiens
tgggtaggtcacttgagctcaggagttcaagaccagcctatatagcatgtttttaagaaattttagttatcttgtcaattacttgactaatctgtcctctccaatgtagggttttagccagctgcagtggctcatgcctataatcccagcactttgggaggct

SEQ ID NO: 164955 - DNA, 499 bp, Homo sapiens
ctgtatacctacggtggagggggcaggcgggggacagatgctgctgggccaagactactgagtctctcctgcctgctggaggtccctagctcaggacttattccatgcacactctgatagaatatttacgcccaacactaactgtttggcttggcaaataagcaaagccataaagtcacagctggcctgtaggctcccagtcaccatgtgcagctgagtcacaaccacttcccccaccccctggggagcaagcgcctatgctcatgcctgcactcagacacatatccacacagatacccacagatgccgcgtgccactgagtcatagctacctcctcagagagcacgtgcctgcatgtacttgcacacaggtccccacagatgccatatacacctgagtgtgagtcatcatcaccactgaaccctgagggagggcacccagagtgtgttctgccatccttgcttagagatacccatatacacacatatacagatatgtg

SEQ ID NO: 164956 - DNA, 323 bp, Homo sapiens
atacatcttaaaatcagaacactgttccctaacagtcacatatatatcagtgaaatcgaattcattttaaagaaatttaattattcactgtagtttaatttactatatctcttaattctaaggtgttgaatataaattaaatttagatgttagccagatatcccattatttcacttatcttaatatgatacatgtaaataattctttagtcttagcttctttctttgatagtaaactcacacatatttgtggggtatttttatttaaaatgtgttcaatttttaattatataaagtaccacctctcttttcagccatgtaagt

SEQ ID NO: 164957 - DNA, 259 bp, Homo sapiens
aataaaatcccaagagagacgttacaagcaaagaaaatcatggaccaatatttttcatgaacataaatgtaaaattcttaggaaaattttagttaattaggaatatattaaaaggttagtgtactatgactaagtggtggtttattctaggaatatatggctagtttaacatttgaaaaaaaattcagtgtaattcaccatgttaacagaatgaaggaggaaaaccatagatcatcttagtaagtgaagaaaagcatct

SEQ ID NO: 164958 - DNA, 571 bp, Homo sapiens
catcattattcttaataacatgatgtatactgtataatgaatgtaattttaatttttcttaaaaaggaaaagaagaaggcttcttgaactttgtacttgagactcgagagcttaaaatttgtcactgcttagaagctttatatctaaaaaacgtgagtggaaaattacaggataatagtatgagaattattgaaagaatctttgataatgtcagttactggagcttttaccgaaatcattaaaactcacttaagaagaagagaaataataatagtattactcaaattaaaataaaaactaaagagctactgaatattttacagcattaaaaaaatcatgttctctagaaaaaggggaaaacagaggtggcatatttttttcagattattagtggatgatgtttctgccatttaagaaaccaagtaaatttatattttacaaatttgattgattgatttacacatcatagtaattttccaactcctaggaggaaagattacaaagtgagaggggcatatagtacactctttgccacagaatgtgatacatccatccccctccatgtattaac

SEQ ID NO: 164959 - DNA, 451 bp, Homo sapiens
ggtccaattaatcaatcctttcctttatggttcctgctttttggtacctttagtgacatcaaaaaatccttcctatcttgagatggcaacaatcttcctgtaagattttctaaaggctttaaagacctttcacatttaggcctaatacatctggaaccgatttttgtctccaatgtcatgtgtttcatatatggataaagaactatgccagcaccatgcctgccacaccaccattcccatgtgcaaagtccgcacacatatgcatttgtctgagctgtccagtctgtcttagtgacaacggctttaataataactcttcatatcctggttgggccaatcctctcacctcattcttttttgaaaatattttgggtctcttgaccttttatacttggatatacattttagaactaactcgttaagttacacacacacacacacacacaaaacc

SEQ ID NO: 164960 - DNA, 285 bp, Homo sapiens
cagagtgggaggaaaagcccgaatctcctgttcacctgccaacagctctttgcaccatggtgccatgtttcctctgcatgcctccgttcatcctccacacccggaaaacacagagaagcaggagaatcagccagatacatgaaaactcttgtttcgaacactgagcattgactgtttacctggcccttggttcttgtctttctttcgttttagcagcagcattacgtactgctgccaggtggagcgttgctggttcctgcttccccttcctccctgcctgtcttc

SEQ ID NO: 164961 - DNA, 215 bp, Homo sapiens
gaactgctgtagcattatccttaagggagacaacatcaattgaaatacagaagtgagggaggctggccttagctaggagaacagatataatttatctctagtaacagaagagaagatgtacattcatagatgctggtagatgaatagatgtttcagagacagagcttatgaaaattctcttatttatcttctcagcgcttcaatttttttcagag

SEQ ID NO: 164962 - DNA, 275 bp, Homo sapiens
agaaattctactttctactcaattttgctgtaaacctaaaactcttctaaaatatagtctattttttaaaaaggtcgtttgaaaattttaagtaaaagaacagaacatcagaaagactgagataaccagcttagctgaagataactaaaacatacctactccttatcaaactctgaactaagaaattcttcccatggatatgaacttgaacttgaatataagctctatggggataaatacctactgtttctttgtattcgtacagcaccacggtt

SEQ ID NO: 164963 - DNA, 313 bp, Homo sapiens
tctccctccagctccttgagatggtgggtttcagaagaaaaatctgacagcaaaaaaacatccatgctacccaaagcctgtcattttataggtccatgccggggcctggggacttcctcttaggtccaatgagatcaccacgtttcccttgttttaagagctgtttgtttatcaaattaacagaaatttataagtctctacctactctgatagctggctgactccaaatccaggctgtatcagcagaaaaagatgtcagtgaaccctgtgcctgacttgaggaaactctggacaagttaccagaaaaggtgat

SEQ ID NO: 164964 - DNA, 666 bp, Homo sapiens
gtgaatggctgaagcttggaaattatatcagactaaccctttctgagactctgagaggtgaagtagcttgcccaaggtcatggaactagttggtagtattgaaccaggatgaaacccaggtcttctgatttcttgactggtactcttatcatttcacactggagtgggcaaagtttgattcagggcatgaaaattaaaacagtttcttcatatttctttctgagagtaaagactgcaaaatatggtaggaaaagctatgagttcagagacattagttgcaggtctggtactgtcgctgttacaggtctggtactgtcactgactagcagtatgattgtaaataggtatatttttctgttgcacgtggcctcaaataaatacatatacatctaaaaaaaaaaaacaacaacacaaaccaaccccgtgcggcgcccccgggccccgcaaaagggctcccaaacccacccgggggcgccggggcccaacgccccgggcaactggccaaagcgcgtcccaaaaaacccgcccccaaacacacggccggagccccccagaaccaaaagcccggcggacaccgaacggccccacacaaccccagcgggcctgagaagacaaacggagctaaacggggacccacccagccgaatcaaaaagcgcacgggggcc

SEQ ID NO: 164965 - DNA, 509 bp, Homo sapiens
catacctaagaacccggttctggagcagaaggaatggatttaaatcccggctctgccacttcctagctgcctgacttgggacaagccctctccgctctctgaactggttttcccatttgaaaactggtgaccccaattcccaccttatgggtaatcatcataatgtattgaccttcctgtgtcacacctcctccctaggctggtggcgaggtgcccaggatggcaggctgtagagcatgtcggacagtaagcgctcagtgtggtggctgaggttatggttgtgggcgggacggggctctgatgatgccggctgaaggatgagctgcagttcacaggagctaggcgacaggaccctagacactctgggggtcacggctgctgctgctagagtcagcctgtcacttagagagggagccgcccggcctcctccctgccggactcgctgacatctcccccacgtgcctgccgcgtccttatcattccgggcgtagctgttttttattttgaga

SEQ ID NO: 164966 - DNA, 353 bp, Homo sapiens
acccaaaacgtggaatttccccggatttttctgattggaccctaccatctaaaagtactgaccaggcacggtggctcacgcctgtaatcccagcactttgggaggccaagctgagtgaatcacttgaggccaagagtttgagactagcctggccaacatggtgaaaccttgtctgtattaaaatcagccaggcgtagtggcgcgtgcctgtggtcccagctactcgggaggcttgaggcaggagaatcacttgaacccaggaggcagaggtggcagtgaaccaagatcgcaccactgcactccagcctgagtgatagagtgagaccctgtctcgaaaataataatcataataa

SEQ ID NO: 164967 - DNA, 254 bp, Homo sapiens
agaattgaccagcagagggcaaccaacaactatgttgtgaagggaagaaggctccatggtttacaaaatggaggatctggaccaagaagggaaatatggcagaggtagtttgctacttgaagttcatcccttttactctcaaatgcttctcttgtaacttttgtgggtgagaggccgaggcttcaaaccttcatatacaatagatcattttaaatttctaccatccccatgtacccaccccatctccccaattc

SEQ ID NO: 164968 - DNA, 297 bp, Homo sapiens
atgtgtaagcattacacgtttcattgaaactttaaaaatgattttctagaaagattaccttaattaaccaagaactatgttctttatcaatgaatggcttttcaaaggatgatcatacttaggagtaacattaaggttttatttattgcttcagaaatttatattcttgacagaatttttgtgggagtttcttctaacacatctcttatctggatcttgctacgttaattcataaaacttcatctttagcaatcttacttttctaggcaaagatgacagttaaaacataatttggtg

SEQ ID NO: 164969 - DNA, 343 bp, Homo sapiens
cttacccagggtaatgggagagaagaaaattctaatgtaaatacagggagctgggtagatttgctaatgagaacgtggaaattgtcttctgactgtttctctttcttgatgaaataatgaaggacagtatttggctcttagggggaggaagggatgttttgagaaaagaaaagaaagttgagttatggctgtatggtcaagaattgcagacattgttggtgggtttttttgtttttttaagttgttctttctttcccctggaagttgtacaataagttaattttattccactggcttaaagtaagtttgttgtaaagaaaaataaaagagtattttatttaaa

SEQ ID NO: 164970 - DNA, 536 bp, Homo sapiens
aaatcctttaaaaataaaaacagtctctgacttagaagcatgtgatatcccaaaaatgtaacctttctgtatgtaataacctttctggaactcaatataacctttctgtaaataacctttctggaactcacaacgagtttcagagaaataatgttctaaatcaaggagtgggatcaggggtttttctgtaaagggccagattgtgagtatgttcagctttacccaccaatctctgtcatgtcttcttctctgggttttttgttttgttttgttttgtttacaatcctttaaaaatgtaaagaccaatcttagatctcaggtagtgccaaaacaggctgtgggccagatttggcctttggactatcatttgctgacccctcttctaagtggtggttaggcccacagcttagctcccagaagcacaattaatccataatattactgagatgccaaataagataatatattttaaattgcattgtaaagtctatactaatatgaagaattatgtagtttttcagtgtttagcacgtgga

SEQ ID NO: 164971 - DNA, 327 bp, Homo sapiens
aaaataattctgaaattgtatggagcaacaaaaatcttaaatgaaaaaatattaaagaaaatgaggagatccagggtaattgaagtatctggctttaatatagactacaaaattatagtaaccagaacagcattgtctggcataagacagacacagacacaactggaacagagtagaaaggaaataaactaaagctcctaaacataactgattcttcacaaagttgccaggagcacacttcagggaaaataaaacatttaccgtgtaaatggtactgggaaaatttgataattacatgcaaaagaattagattagaagtctacatct

SEQ ID NO: 164972 - DNA, 425 bp, Homo sapiens
ccaaatcctataattctgtactaaaagtatctctttcaactccaattaggatttattccttcccacttatatgtggttacggagggtgtccttattaaagaatgcaaatgaacagccaggtgaagaggcccagaatggttcccaatgcaggagcttctgttccatggaattgggggtgtgctacctcccagcacatggaccaaatttaagtgtgcatcaacctggctgttccccaaaacccatcatttagagttgtttatggaggttttcagttatggaggaatgatttattaaatcaggccatattgattaattcagtctttagctccctctcctctccctggagtgaggggaggggctgaagtttctaaccctctattcatgctttagcttttccagtgaccagaacccatcctatctggggg

SEQ ID NO: 164973 - DNA, 271 bp, Homo sapiens
tgctgggattacaggtgtgaactaccgtgcccagcctaagacattattaatatatttttaaggcaaatatctctttctgcatggcttttcagataaattcttccctgagtaaatagttttcttcagcgtatttccagagcaccttgttcacaaggctatttaatttttgggtgcattgtaatactctataatttgtgaaccctttgagaccaaatgccgtgtcttaaccagttgttaattttttgtctccctccttccctccatagagctc

SEQ ID NO: 164974 - DNA, 383 bp, Homo sapiens
gctaccgccctggtccaagccatcatcatctcacataggctactgcaatggcttcccaaatcacatctctgactcctctttcatcttcctacaattccttctctgcatagcagccaaagtgtttttagaagagtatatactgaagttataaaacaggtaaaaacgaattaatgttgctttaaaaattagaacagtggctgcccatgtggaggaagagttacagcaggtatcaacgggaatggggaatgagggaacttttctgaggtcatgttaacgttctatatcgcagtagcaagttgagtgacaaagggatgtgtttgtcaaaactgaataattaggattatgaatttattgtatataaattttaaattaaaagaaaaaac

SEQ ID NO: 164975 - DNA, 452 bp, Homo sapiens
agaaatggagccctcacacaggagagaatcctcagggtgatggtggagctgggtggctggtccagccagcccagatgaggacagaggaggtgcacaaggatatacaagaagcatatgtgtctcagggagatcgtaagtgagagctacatcgtgatattttatagtacataatgctgtataaaattacaaaatcaagacatagaatccgcatgaggttttagataccaaggaactaaaagagttctaaggtgtctcgaggtgagcaggggattcctgctttatgttataaactttgtaggacagttacccttttaaaacctactatatttcatgtataacaatgaatttttatggaaaaatacacatcaaactgctgacaaacccacagggcggggggcggcggcagtgagcccagggccatagcagatgagtgagtaaacacctgcctggca

SEQ ID NO: 164976 - DNA, 781 bp, Homo sapiens
agcggacctgagactgtgggcaaaggtaccatgaagtgttgtggagaggagggtcaccaactccaggcagggctgctaagtttattacaaacaggcaagactagaatatgtttccactttagtgagtggaaacctaatcattcataggtatcctgtacacacagaacaactatgatgaagagtgaggcctaaatcagaggagacgaggacaataatagtagtagtggtcatgatgataataataactaccagacatgaagattaaccatgcctaacattgtgttaaacgtctcacttctttcatttaatccttacaataatccaatgatgtagctgctattatttttattatacagatgaagaaactgagggcttgaggggtatactgctttgccaaagtcgtacaaatggtaagtgcagaaccaggatctgaattccgtcagtctgactgcagagcccacgccgacaccgtggaagctggtgatgcccattaggccctgtctgggcatgaagaggatgccctccctcatgagctggaacacagcatcccctgttgtgggtgtggctctcttaaagaccatctggtgaattttgcttgtgctggtttcttattaaacaaccttcagatttggcttcacgtgcaactcacatagagggaaaggagaccatgatccgccaacatgacagctgtatttttcattagtaaattagcaaactggctgcctgggtcaccatgcatacctgttaaggtgagcccgccccagagctaaaggctaccatg

SEQ ID NO: 164977 - DNA, 437 bp, Homo sapiens
ggtataaagaactgaagcataatcatgtttgaatcctctatgacagcaaatgttctgcaaataccaaagagctgtgtccaaaagagatcggctcatatataaagaagtgctctcaactggtctagacacacccacacatttgctttctgatctccaagaaaatgagagtttacacctgtaatcccaagtgtactgggaggccgaggcaggcagatcacttgaggtcaggagtttgagaccagcatggccaacatggcaaaatcccatctctactaaaaataaaaaaattagccaggcatggtggtgcacgtctgtaatcccagctacttgggtggctgaagcaggagaattgcttgaacccaggaggtggaggttgcagtgagccaagactgaaccattgcaatccagcctgggcaacagagtgagactccatctta

SEQ ID NO: 164978 - DNA, 432 bp, Homo sapiens
ctagtcccacacaccagttttacaaatgagaacctgaggcctggggaggggggtggcttgcctaataccacccagccaactggagggggaatgggcccggccccggggtctcccatctcagctccaggtggcctcgaagggcctttggcaaagtgatcaactgctaaccagagcgtgagagaaaaagcccaagtccaggctgttgctgtggaggaaaagcttggttctcaccatggctccgtgttcctgggcagaagggaacctctctgggggcttggttctctcatctgtaaacccctgatatactggtgtcaggtgacatgcttgtgaaagcccctcagagcaaccaggtgcaaatatgagtatcgtgtgctgtgaaagagcccatcccgcttcattggtgggggctgcagccttcggcatgtccaccgt

SEQ ID NO: 164979 - DNA, 478 bp, Homo sapiens
ctgtgacccagtaattctgttcctgggtgtgttctctactcatgacatatcctgcaggaggcagaagtgtttctatcagcaaaaatagtaacaacataaatgtttgttgacagaggaaaggataattaaattgggatgtattggaatgctgtagtagaatagaatactatatgtactgaagataaatgaaccatgttccatggttcatttcattcatccatgtcggcatggatgaacttcagaagcatgatgttgatttacataaaagaagcagattaggccgggtgtgatggctcatgcctgtaatcccagcactttgggaggccgaggcaggtggatcacctgaggtcaggagttcgagaccaacctggtaattgtatacagggaactgatatccagtggcgacttgaaatggtgaattgggataagcaggaaatgagttcattgtaaagctatcacctagacctaggcgtctata

SEQ ID NO: 164980 - DNA, 378 bp, Homo sapiens
ggctgagacaggagaactatttgaacctgagaggtggaggctgcagtgagccaagatcgcgccactgcactccagcctgggcaacagagctagactccgtctcaaaaaaaaaaaaaaaaaaatcagacaaaatagactttaagacaaaaactgttattatagacaaagaatattttataatgaacaaagtgtccgtccctcaggaggctataccagttatagacatgcatgtacctaacaacagagccccaaaatacatgaagcaaaaactgtcagaattgaaaggaaaaaatgaacaactcaaataacagtaggaaacttcaatactctactttttttcatgttattttatacatacacatgagagagagaaaacac

SEQ ID NO: 164981 - DNA, 495 bp, Homo sapiens
ctggtcctactttccacagggatctgagacaggttgtgaggacttgatacggagtcataaggttcaagccaagacatctgaatgggcgaaatgaacgtgaaagcagtacatgttcttcctcaaactttcttggaagggtcagaaaacagaagattgaaaaatacccaatatctaacatcgggccattgagttcgtccaaaaaaagcagaagagtatttctgaaccaaagaaacagaatagaaagagaggatgagaatggagacctgctggccgtgcatcagctatttaaaggaagaaagggctggagcccagagttaaccaaagcttagccttagaccaaacagggcttcccagcacaggtttccaaggaaccctttctgctccagtcctctacagtgagaagagcccagaataacacagaaatatgttcacttattacagacacccgtcaccatctctgatgtcagagaattctattctcttaacttgtgcctc

SEQ ID NO: 164982 - DNA, 339 bp, Homo sapiens
ggccatggagaaaggtgacccccagctatgcgacttcctggagagccacttcctgaaccagcaggtcaaggccatcaaaaagctgggtgactacctgagcaacctgtgcaagacgtgagccccagaagcaggcctggcagagtacctgtttgacaagctcaccctgggcggcagcgaggaagacacctgagccaagatgggccccacagccacggtgtgccttccctgggtcaggccaccaggcgggggcgtgcatgttgccctttcagaacgttctcttcaatttttttcctttcagtgttaccattattggcaataaagttatctgttctcaaagca

SEQ ID NO: 164983 - DNA, 139 bp, Homo sapiens
tacttgggggaaatgtctcctttctgtacctaaagtaagtttgtgattctatcctttgccttaactttttcctctgccaattcatcttttatgaatttatccacttccaaaggtttcacctctctcctggatataggag

SEQ ID NO: 164984 - DNA, 436 bp, Homo sapiens
ccaaaaaaccaccgtggatgcagcggggcctctgcacatcacccctcggtgcactggaggcctcagcggtgctcctggctgagcatggggacttcactaccagtctgccctgggtcacgtatggaagcctcagccggaggcgtgggagctgaaggcccgacgcttcctgttctgctcagctcctccttggaggaagtggggtttgcaccacgatggcccttcacccctgccccctcctctctacacctgcactgatgtcagacagcaacctctcaagacaggtgggacacgccattcctcctgtgaggtcacagcgagaagtgcatcagcttgaaatgagaggcagctcttgggggcaggagtcagtggcagcaccaagcgacccacccaccacgtttgggggttggggacctccaaagcaggcaggggcttgctt

SEQ ID NO: 164985 - DNA, 300 bp, Homo sapiens
gcagcagatgggtatgagaagataggaatccatatcataaggggaaaaacaattaaatagtactcaaaaaagtaaaatcttcaaaaatttgagatcaaaaaccctttctgcagcgctgaaagagtaaaaataattttctgctgctataacagaatatcacagattaggtaatttataaagagcagaagtttatttggctcacagttctggaggctggaaaagtccaaaagcatggtgctggtatttggccagggtcatcctatggtgcaaaggtggaaggtagaggcaagcacagaacat

SEQ ID NO: 164986 - DNA, 619 bp, Homo sapiens
aggctgttgtcagtggtgcatccctgtaatcccagctactcaggagcatgccactgtgactggctaattatttttatttttactttttttgtaaatgataagtggttgcccaggtgagtcttgactcctggtttccagcaatcctcccaccttggtggcctcccaaagtgctgggattagaggcgtgatccaccgcgcccggcctctggctagcgatttttaaagagcactagggatgtagactgaatgatttattatttgtagaatttagaacaatgcctggtacatggtagtcacataaattatgtcattaagaccaaaactttcagccagccactgcgttccagccggataggtgctatatttaaacatacccattttataaggtgaggaaaatggaggcacgaaaggaaaaaacgattaaaattagctaaataacctgatccagactacctggctgctgactggtggacccagggattcaaacacaggcattctgactctagaatcaatcaatctatctatctatttttttgaaatggagtttcttccttgttgcccaggccggagtgcatgggcgcgatctcagctcactgacaatggctcgggtaccgagctc

SEQ ID NO: 164987 - DNA, 721 bp, Homo sapiens
atgtcaatcgagctcggtacctactttccacagggagggaaactctgagaggaaggaggatggagatttcatgggagacaaagggtggttgagactacaggtttgaacaagcacaggacccttggtagtctgatgtgaaggacattataaaaacacattatgaaggttttttctgtcacttcaagctgggtcttgttaaacctttgaaaattctctaatacctcatttgtttttgaaagaaatctatagcaacatcattttgtcatgtggtaaatattgctgagcagtcactaaatacctatagtcttttagtttgttcagattacatctaggccatttgtttactctaatagctaatagaatgtacagctgattttggtttaactgtgcgtgcatatttgtaatttttaaccaagaagtggcatatgtccacaaggaacttgttatctctgaaatactcacccatgagagctggattaattttttaagatgtaaatctatgctcatgtagaaataatataacaaggtgatattttgatgatcctctcaaatgattatctaactcttgcctgggcacctgactctgagtcagtatactcttgaatactttccatccttaatcaaatcaggagaaagagatggccatgtaagaaaattggccacggcagggttttataagagttaagcaagaagataaaacaacacatggccctgtgaaata

SEQ ID NO: 164988 - DNA, 120 bp, Homo sapiens
ccctaaaccagtattgcaagggactcccaaaatattgcaaacctgaatgaatgaagttgctttaaaatacggaatgaaaactctgccatcaaaattaaacattcaactaaatatctacta

SEQ ID NO: 164989 - DNA, 317 bp, Homo sapiens
aaaaataggtaacaggtgtgtttgtaagtttgtcaccctgggacatctcctccctcagaatctcatcaacagggtcaggagctgtgggaggtgttggtggtgtgagcaagctatacatagtaatcatctctagcccagtcctcaaatatatacatccagtccagactcatttctgagcttgagttctgacttcctatggcccattggacctttactcctgtgtgttgtagagctgtctcagtagcagtatgtctaagactgacttcattatggttaccactcaacaaatggactctacttttttattctctattttg

SEQ ID NO: 164990 - DNA, 474 bp, Homo sapiens
ttgatctccctcatggttgaaaattaatttatatgttgaaacccttaaattaaaattttccaatcttaacctcttctctgaactccagaaaacatatatacaattaccaatttgacatttcccttggatatctaataaatgtcaaattgaacatgaccaaaactgaactcctcatcttctccccaaatttacttctccagtgtcttccatatgtgtatacatacatatccttccaggtgctcaggccaaaaaccatgacattatccttgatgccctctcttttcttcacatccacagcaaatctgtcaaaatatcctgttagctttgccttcaaaatacatccggaatctccacagctacagtcctggtctaagccaccagcacctctcacctagattactgcaacagcctccttacgtgtctctgcctccatcgttaaccccctacagtctagtctcagcatagcatctagag

SEQ ID NO: 164991 - DNA, 396 bp, Homo sapiens
tgtgtgtgagtcactgtgtctgagtgtggagtgtgtgtgtggtcttctgagtgcatatgactgtgtgcgtttctctcctgttgcagctgtgatcaggccagtggcatgaagcaaagggctatcctgtgtggcacagagtaaactgggggaaaggctggtggcagggagacgagctgagagggtggtgcaatatgtgaaatgaaggcccagaggatgctcacttggctagccatggagaaagaaaagactacatcgggcaagtcctcttatttattttactctatagttgggaagaatgagatttaggagtgaaaggtaacttcataaaagacgtcatagtctctttaaattaggccagtttgatcacttgctgagtattttaccagccttattaaa

SEQ ID NO: 164992 - DNA, 315 bp, Homo sapiens
attgaatctcatttcggtaccagatactgcacttcacgataaactaatgtggccttgcccagcgagcgcagtcaccaggcttcagacactggtacctgttaggaacttagctgtacgggaggagatgagacagtggcccggatgggtagcagcagggaagggtcagatcttttcttcggctgtttgcaaattcagcagctcctcttctgtcttttctcagagacccgcccctctcacctgccatgagttatctctacctgggaaagagatgctagccaaagctacctccttcctggaaacaccagttgttaattt

SEQ ID NO: 164993 - DNA, 553 bp, Homo sapiens
tcaaaagaggaaaatatgaaaaagaaaacaaatgagttaagtgtttacagaagctaataaaaagtaagataataaatccaaagaaatggggaaaatggaaatataagataagaacaaatcaatgaaatagtgaacaaagatcaatatgaagattaacaaaggaaaaattagttctttgaaaggagtaataagatagcaaacctttgataagactgaataagataaatcagaaaaagaataagtaaaacacatactgaaaaggagatctacgaacaagtaattttttaaatactttttaaaaatatgaacaaacatgtaacaatacatttgaaattcattaaaaaaggattaatttatataaaggatataaaatattaaaatggcagaagaataaatggaaaacttgaatagaatgtaaaagttaaagatactgaagtggtaataaaatgtctccttcaacaaaacccttgggaaaatgatagggaacccgagaaagaagcaaataggcaatgaatatgaaaagataattcacagaatagtggagaaatacaac

SEQ ID NO: 164994 - DNA, 104 bp, Homo sapiens
gcaggcccagatgaagtgcgtgcacggaccatcaggaaagggactaaggctcctcaggctgcaggaaagattcacacagattttgaaaagggattcattatggc

SEQ ID NO: 164995 - DNA, 234 bp, Homo sapiens
actaggcttctggaagccaaggacagctattcctgcttttgactctggatggcacctctagttctcactaagcaagagaaggactgataaaatggcaaagagctgttaaaggctaactacctgtaatgtcaggagcatggcaaggcaaggattatgtatgtgtctaatctaagagtgaatcacagggctctgcttggtaagcctagcctctaattcattcctatattgcatggc

SEQ ID NO: 164996 - DNA, 484 bp, Homo sapiens
atctagtagtaaaacattttttcttctatttaagcaaacctatagctcaatcagttaaagagtatgaagaaccaatgaaaaacctaaaggacagtaaatattttggtactaacattttttaaaaattaatttgtaagtctaagtaccattacaattttactcatttaaatccaaacaaaataaattccaaatgaagagttagtcttcaattctcataggcaacatggaaatatagttactataaaacaaaagagatcaccattctgaagacatctaacacttgcagccaactgattggacttaatagcagtggtgcatagtggtcccctaacccattagattttcaaagtgtagactacatatctttcagtaatttggaaggcaagattattttcccagaaatcttacagtagtcttattgaacataattattctaaaggttgtcagagttctacaaaaatgacatatataattcacattcatt

SEQ ID NO: 164997 - DNA, 1102 bp, Homo sapiens
tgtaacctgccctttcaaagttttcatgataaaaactttaaaggttgatatgctatggaatcattacatattttatttttggtgaatatattcacctgattttacagaaacccttgatctaacaggccttgtcctctaatgaacacactagtgggactataaggtattaccataaaccatttaggggtgcgattttggagaatgtttcaaatattaaacaaactaaaggtaacagcagctaggcagattccaaccacagctccatgaaggtaaaactgtaacgtagtaaaatactgcctctggaactttccaagtgtctttggaacctttctgcagcatctctctgtgtattatgtccactcctgaacctcacataatctgccctgtcctgcagtctccactagttgattctctactctaattagtattttacctatgattaggtcacagtcacacaattttctagctatgatattagattggtgcaaaagcaattgtggtttttgccgtaataataactggagaaattttaaagaatatattaaattaaaaagcatgactaaaatgtaatctgactaaaataacattttcttttttttttctcttgagacagggtctcactctgtcacacaggctggagtgcagtagtgtgatcttggctcactgcaccctccacctcctgggttcaagtgattctcccacctcagcctcccgagtagctgggattacaggcatgagctaccgtgcctggcctgaaagtgtcttttaaaaccttgaagtgactctctgacaaactgaggaactttaactttgcctccatagattgacagaaaagtatgagtagtagcccttttgaaaatgatagaccaaccttatttctctgacagccaacagggttatgatacttattttataaatggtaacctccctctgacccttacttggagtgagttttcaatagtatgcattcaataaacattcaccatttttattccagccattactgtccttgtgcctcttactggaacctgtactttcatgctcagcaggtgtccagcattaaaagaagtaaagattactagaaagactcctcactatatac

SEQ ID NO: 164998 - DNA, 1047 bp, Homo sapiens
tgtaacctgccctttcaaagttttcatgataaaaactttaaaggttgatatgctatggaatcattacatattttatttttggtgaatatattcacctgattttacagaaacccttgatctaacaggccttgtcctctaatgaacacactagtgggactataaggtattaccataaaccatttaggggtgcgattttggagaatgtttcaaatattaaacaaactaaaggtaacagcagctaggcagattccaaccacagctccatgaaggtaaaactgtaacgtagtaaaatactgcctctggaactttccaagtgtctttggaacctttctgcagcatctctctgtgtattatgtccactcctgaacctcacataatctatgattaggtcacagtcacacaattttctagctatgatattagattggtgcaaaagcaattgtggtttttgccgtaataataactggagaaattttaaagaatatattaaattaaaaagcatgactaaaatgtaatctgactaaaataacattttcttttttttttctcttgagacagggtctcactctgtcacacaggctggagtgcagtagtgtgatcttggctcactgcaccctccacctcctgggttcaagtgattctcccacctcagcctcccgagtagctgggattacaggcatgagctaccgtgcctggcctgaaagtgtcttttaaaaccttgaagtgactctctgacaaactgaggaactttaactttgcctccatagattgacagaaaagtatgagtagtagcccttttgaaaatgatagaccaaccttatttctctgacagccaacagggttatgatacttattttataaatggtaacctccctctgacccttacttggagtgagttttcaatagtatgcattcaataaacattcaccatttttattccagccattactgtccttgtgcctcttactggaacctgtactttcatgctcagcaggtgtccagcattaaaagaagtaaagattactagaaagactcctcactatatac

SEQ ID NO: 164999 - DNA, 772 bp, Homo sapiens
ctttcagtcagatggctcttaaatctcacccaatgctgccatctaatggttgtagtctcagtaatagtgtttctttaatttagaaagaactgaaaagtttgtaaatgagctgccccctaatttacccatatttttgagtttggattgtcatatcagatttaccaataatagtatgcattgacatgttgtttttaagtttatgaacacattctctaattgccaacttttacttctttaggattacatcatttatttcacagtttatgtaccctttaccaatgttatattagaatcaagtgttttaacatatcattttacaatttgctgtgatagtaattgcttataactgcccataaggaagatcagtattctaatctatatttattagacaaggaaactaacccactagaaagtgtatgttcttaactgcagtatttagtggatatcgaataaataataagtaaatattcaaaaaactgaaagtggaccttatttatttatttatttatttatttatttatttattcattcatttattgagatggagtcttgtgatggagtcttgctctgtgcccaggctggagtgcagaagtgtgatctcggctcactgcaacctccaccccctgggttcaagcagttctgcctcatcctccctggtagctgggtttccaggtgtgcgctaccatgcccagctaatttttgtattttttagtagagacagggtttcaccatgttggtcaggctggtctcgaacttttgacctcaagtgatc

SEQ ID NO: 165000 - DNA, 531 bp, Homo sapiens
ttcagtctccatgctcatctttagtttattcttgcctgtgggtaggtaatggtaaagacatatcctaatatgaatctattatgaggtcttcagaggaaatattcagtaacaacccagagtactacaatgtttcattataattttgcaatatggacaagaaccataattttctaagtaccttcagagtaccaagactctcctagagatttcatatcaattcactgtaatcatcacaccaacagtggccaactatattaatccattttcacactgctgtaaagaactgcccaagactgggtaatttagaaaggaaagaggtttaattgactcacagttccacatggctggggaggcctcaggaaacttacaatcatggtagaaagcaaaggggaaacaaggcacattcttcacaaggcggcaggaaagggaatgagtgcaggaggaactaccaaactcttataaaaccatcagatctcatgagaactcattcactatcacgagaacagcacgggggaactgcccccatgattc

SEQ ID NO: 165001 - DNA, 436 bp, Homo sapiens
acagagccacctaagctgaagattcccttgagaacaagtactgtcctgcggtttcatggcctttcttccatttgtggttcttgcgaagtggaatttaaatgacatcttatcaagatcgataaatactagtttcccagtgctggaatatagaaaatggatggacaagtaaatcccactcagcacccatagtccaggcatggggacctcaacacacctgagccccaaacatcacctttcattctggacctaccatgaaagacttctgaatccaggaagagaaactgactgggcaacatgttattcaggtacaaaaagacttggactgtaactcaaaaatgatcaaataatagtgcatgcatcaagtgcaatgggaagctcttctggagagggagagaagcttccagttaaggtgacattgaagccaagtcctgtaaga

SEQ ID NO: 165002 - DNA, 400 bp, Homo sapiens
atattaatcttggtgtattcacacagtgaatgttcagagcaatagtgaacttaagcttgcccagcaatatggataagtgttttaaacacaatgttcaattaaaaaaaagtactagaagaccacctgtaatagtttgccattttggtagagctcaaaaacaggcaaactaaaccatatgctttaagcattcatgcaattataataaaactgtattttaaatgaatggatcgttaaacaccaaatccagaatgactacttctggttggggagaggtaagggcttaggctaggagagaaacacatgtactgggatggtttcataagagttcattgtgagtgcattcattatatactttatgactaacatactgtgttatgaatatgtataaaaatatagtaaa

SEQ ID NO: 165003 - DNA, 586 bp, Homo sapiens
ttgattaccacatctcccagggctgattagcaggtcactttggtgtgggtgtcccatgggtcaccccttgggtagcaggtcttcccttttcactaagcctctgttgcacagctccatggacattttgtggcacagggactcccctaagggggagccaaagcccaggcctcccctacaagggaaagggtcccagtctggtatgcccccttggtcagcaagtcttcctggcatcagttagagtatgtctctctcccctcggcctgttcactgtcattttcctcttcttcattggtcaacatgtgtgtcctgttgctgattttaaacatctctagtttgtagtctgtatctcccttgcactggcctttatacaatctttcccctggtaactcctggagcatctgtccagtggggccaggaagaatgcagagcaggagtggagctcctctcctccatatctgccaggtggtcctgggtccgcagcccgccctcacaggccctcctcactcccctaggtagatggccccctcagggcaggcccggcggacacccctccctctggctggcggatgcagtgcctagcggccgc

SEQ ID NO: 165004 - DNA, 187 bp, Homo sapiens
atcacccccagtttttacttttcttaaaccttaaagcgcggcagtcaccatgggcgttgtccatgctatccctggtgattctattttggaattgttgacgggcttccttcgtttgtcatatggagaaaataccttaccctgcagaactgccagagttcaatgacgtggcgtagctaagtacctccta

SEQ ID NO: 165005 - DNA, 623 bp, Homo sapiens
ttgctctgttgcccaggctggagtgcagtggcacaatcacggctcactgcagccttgaacacctggccttaagcgatcctcccacctcagccccattgagtagctgggactacaagcctgtgccactaagcccagctaatttttttttttgtactttttcacacagatagtatctcagtatgttgcccaggctagtctcctggcttcaaacaatcctcctcgccttgagctcccaaagtgctggggttataggcatgagccactgtgcctggccagcatggttactttaaatgctatcttggtgaacttaacgtaaatggaaaaatataaagttgtctcctaagacatcttttcatcgcatcctttcctccatggctgacaatgaagagaaagaagaaatatataactaagactctaatgggtttaaaaagaccaatgcaggtgcagtctcgccaataactgtaccagcttcgggagattctccagcccctttctctttatactcacctggggaagaatgattttggtgagaatttactcagtttaggctgtaatttaattttgcctataagaatcttcccctttctatgtctaatcttccctgatctagtaaaaagaccctg

SEQ ID NO: 165006 - DNA, 295 bp, Homo sapiens
ccagttgcctgcgtcatacagcctggcatctcacagttccctgtcattgctgcgtgtatttctgtttgatcttactgactagatttgctgcttactgatgacagagatcctcatgttttcctttttctcctttaaagcctcaaaagaggctagtcacacagaaatagcaatgatgatcatattgcatcaccgttcatcaaatttgagcaagtactttcaaccatgtcatctcattccatgctcacagtaagtgctcagtggaaaatgtgtggccccaagatggtaaagaactctg

SEQ ID NO: 165007 - DNA, 447 bp, Homo sapiens
ttaatataatcaacagggcatttagcacagtcaatatttctaaatgaatgaataaataagtgaataaataaaaccttatttagtatcctctgttctgaatgatccttctccaaactcaactattatccttaagctattgcctaattctctgcttcctttcatagaccgacacctcagactagggtcaggaagatgactcccagataggtttggaagaaatctgagaatatcaggacatgtgttgagttttctttgcaagcctgcaagcccctcagagaaatccaacctgtgggactggagtagtaaagtagtgtctcaaggagatgccttggaggtagatctgggcagtctcccagaatcctactcactatattgtggtacagagaaaggagctgagaatttgcaggcccagaaggaaggcaggaaaaggaagggttaagagaatta

SEQ ID NO: 165008 - DNA, 322 bp, Homo sapiens
taactttctttcaatccaagtttgccctgaattctatccacagatcctctgaacctccagttaatgctccctggacttcagtggggaaagtctgggcagctctttttgcctctagagcccaattcaattccaaagcttcgataccatttggaatcattttgaaatttaagaagttcttctacattcactatgcaacccagagcatcatgatacatgttcgaggtcacctgtttattcagagttcctgggaaatcaaaactctaggaaccaaaaggaaaacaaaaaaaagcaaccatcaccttatttaaaaaaaaaaaaaatc

SEQ ID NO: 165009 - DNA, 348 bp, Homo sapiens
tggccattataggtgagtactgaagaccaggaacttctgaggcagaggcctaagctaggacctcagtttcaccatcgtattcatttatatgtgaccatatgacctagaacaagtcacagcttgctaagactccatttccttctctgtaaaatgggccgctgtgagatctcatcaaatcacatgtgcaaaaccctgagcctggcacagtacagggcttaagaaataggatcttgggctgggcgcaatggccaacgtctgtaatcccagcactttgggaggcagaggcgggcggatcacaaggtcagatcgagatcatcctggctaatgtggtgaaaccccgtctctact

SEQ ID NO: 165010 - DNA, 545 bp, Homo sapiens
ttagtgggtaagtgtccaacagaggtctaataaactatgaccaggcaattgataatgccaagcggtagagacacagtgatctctcttcaaaatgcagtttccttcatcagaaagctatgtgtggggagccatttagaatcaagtttcaggcatagcaaatgtttttgatctttcctatccatacatatgtccaaataaatatagtacctggcagaatgtattattatcgtaagtaaagtacataagtgtgctcttaattgttattggtgttcagaggaagacgggctacttttgcctgagacatcctaacaggcctcttgaaaaaagcattggagcattaggtctttgaaggttggctagaatccaaacaagttgaaggggagcaaaacattttaggcaaaggaaatggcatgagaaaaatcacagaaatagaaaatttcatgtggaggacaaataatacttatggtcagatattgaaagcaccatccatcaatgttgaaatcctacacttttgtacagaaccatggattgaagcagttaggagt

SEQ ID NO: 165011 - DNA, 613 bp, Homo sapiens
caaggtttttctctgattaaactgtttgagagcaggctggcttctattcctttttcaggctgttgagcagttctctatgccaggtgctaggctggactattttctaatatttgttcccttatttaacctcttagctgctttgtggactgatgcttattatctgcatttgtaaaatattaataggaaagtggcttatgaaagccaatcagtaaagctatttcaaaaagaggagaaaaactgaacccgtttaccacctgttagctctgggaccgtgggcaagttctttatctgctccatgcctcgtttcccatgtctgtaagatgggagcattattattattattatttttgaaatggaggttgcagcgagcccatattgcgcctctgcattccaccctggaaaatctgtctcaaaacaaatttaaaaaaataaaaaataaagaaaataaaaggtaagaacataacttggggtgcatgaaagaagcagaacgctgtgttagacttctggaaaatacttttgtgtaccttagcctgggctgaaaaagcaaacagcttctcaaaatcagacattttaaatgaactcatttctgtgtggaaaatatggcttcatgatg

SEQ ID NO: 165012 - DNA, 579 bp, Homo sapiens
agcggccgacctattttttcacaattctataatgcacaagttacttttataatccaacaaggatatgttttcaaaatgacaagcttgcgcgggcgtggtggctcacacctgtaatcccagcactttgggaggccaaggcaggcagatcacctgaggtcaggcgttcaagaccagcctgaccgatatggtgaaagtccgtccctactaaaaatacaaaaaaattaaccagacatggtggcaggcgcctgtagtcccagccactctggaggctgagacaacgctggaggggcaggcaggagaatcgcttgaatccgagaggtggaggttgcagcgagcccatattgcgcctctgcattccaccctggaaaatctgtctcaaaacaaatttaaaaaaataaaaaataaagaaaataaaaggtaagaacataacttggggtgcatgaaagaagcagaacgctgtgttagacttctggaaaatacttttgtgtaccttagcctgggctgaaaaagcaaacagcttctcaaaatcagacattttaaatgaactcatttctgtgtggaaaatatggcttcatgatg

SEQ ID NO: 165013 - DNA, 501 bp, Homo sapiens
taaaatacaataatttcttgaacttcagtcacttatgcctataagcgggcatacaacaggggcacaataaatgtttgttaagtgaatgaattctttcagaactagatgggatcttagtccaactctcttatttaacgaggtccacagaggttctgcgattgtctaagaaagaaggctgtgttcatggcctttgttgtttacgtggccctgtgattctcttggctccgtgaaagtcctgatgcagacattccggccatctagaaaggcatgcagacaagccatccagctggcatgatcctgagtccagctttctttaaaagagcttccaaaactgcttaagctttgactgcacaaaacctgcatcacctccagttgagaaactcaagagaataagtaagttatggagttggagaccccagcttaactactagttttaaaatagtgaaatcaacattttcaaatctttgacttcactaagatttaataaagtttattaatcat

SEQ ID NO: 165014 - DNA, 581 bp, Homo sapiens
  misc_feature (198)..(198): n is a, c, g, or t
  misc_feature (204)..(204): n is a, c, g, or t
  misc_feature (285)..(285): n is a, c, g, or t
  misc_feature (299)..(299): n is a, c, g, or t
  misc_feature (335)..(335): n is a, c, g, or t
  misc_feature (344)..(344): n is a, c, g, or t
  misc_feature (359)..(359): n is a, c, g, or t
  misc_feature (363)..(363): n is a, c, g, or t
  misc_feature (368)..(368): n is a, c, g, or t
  misc_feature (370)..(370): n is a, c, g, or t
  misc_feature (391)..(391): n is a, c, g, or t
  misc_feature (406)..(406): n is a, c, g, or t
  misc_feature (416)..(416): n is a, c, g, or t
  misc_feature (476)..(476): n is a, c, g, or t
  misc_feature (494)..(494): n is a, c, g, or t
  misc_feature (502)..(502): n is a, c, g, or t
  misc_feature (512)..(512): n is a, c, g, or t
  misc_feature (515)..(515): n is a, c, g, or t
  misc_feature (535)..(535): n is a, c, g, or t
attggattaagtgaggagttgggctctgaacccatggctatccagctctaaagctcttctgtggagcattgagaccacgaggacaccccctaaagacagaattccccagggctttttttttttttttaaaaatggattttcgctcttattgcccaggcgggggtgcaatctcaactcattgcagcctcagcctcccangtagcngggactacgggcttgcaccaccacacccagctaatattggtattttaagtagagggggggttctccatgtgggtctcgaantccccacctcaggngatccagccgctttggcctcccaaagtgcggggatnacgggcatnagcctccgcgcccantggnaagantncagattatatggccaaaattncagtggctatctgtnaattttaatncttctcgctgtccccagcacaggctttctcagcctcagcgctactgactttatgagctanataatccttggtgggggnaaggaggncctgtcttgngcntggcaaattgtgtgcagcanctctggcctctacacactaaattcggttagcaccccaagcagcgac

SEQ ID NO: 165015 - DNA, 394 bp, Homo sapiens
tgttgctacttacagctcgggcttggagataagacccactactctgcaggtccacttgaacttctttgtaagcccacttgaactaatctggaagagtttcaagctttggtaccctatttgccaacagctgggtacaaaaccacctattgggtatgattttagggctattgtcaaggtccctgaaggtggatagactgaagacatctcttctactggtagctttatctctttaaaacattcttttattgtatctcactcaaaagactagctgtttatttatactttagtatgagattccatttgtttctttacaaggttttgataagggtctaagactactagatgccagtttagtgagggagggcactctgggggaagtaagcaggtatatggg

SEQ ID NO: 165016 - DNA, 485 bp, Homo sapiens
aggagaaagaggagggagagggtgatgctagtagtagtagtgtagtaaggatggcaatgttctgaaatgtctacttttctatgtaataactgaaatttttcttggaggctgagtcattctcatgaatatcaaagattgagcctgttattcattgaagagctcttgcaatataatatttgattctgtttgccccctaaacaatgtcttactcctatacaatcagcacggccactgagttcaaaagttatgtgctgtccccattggcagacaggcatccgcaccacagactagactgcctgtcccctgccctcactgctctcgccccactggccttttctcgaggtcccggccctcacttcatcagttccattcagtatatcccccaaacagcatttccactcagcctgccaaggagaaggaaagagagtatttagaatacgtccttcactttcctgagagaacagctttaagaaaagaaaacgtca

SEQ ID NO: 165017 - DNA, 120 bp, Homo sapiens
ctgggttttgccttgcggcttaggtctttctatttctctctctatccctcactgtcggtaacgcctaagaaccaagtttacttaatggtgtgtgtgtgtgtgtgcgcgcgcgcgtccgtg

SEQ ID NO: 165018 - DNA, 306 bp, Homo sapiens
ggtcttgaactggatcctggttggaataaagcagcagtgaaggacatctttagaacaactagagaaacgtgaaaatcaactgggtattcaatgacgctagggaatcgctataactctgttcaatgcaatgttattttgctacatagaaaaatgttttgatttttttaaaaagatgcctaggccaggcatggtggctcatgcctgtaatcccagcactttgaggggccgagatgggtggatcacttgagcccaggagttcaagaccagcctgggcaacatgatgaaaccctgtctctactaaaaata

SEQ ID NO: 165019 - DNA, 688 bp, Homo sapiens
aagtagacattattgtccccattttgtaaaggaactgatgctcagagtaacttcccaaaatcacacagtgcatatggcagtgctgaaattcaaacccgcatgtatctgcttcaacacctctcttcctgctatcataccagcattcctcctcatagaaattttgtgaaaaagcacagataacctccttgatttaaactagaaatttttgagagtcctgcattgtttctcttaataatccactacttatcatttatcatgagttgtgagatcctgctaggttcaggagagtgactgggaccagagctacagactcaggagtcataagaccttaagagctcctgggtgctgtgggcattggtgaggtggtcctgggaagaacttgcagagtaagagaagtagtactataggacctaatgaaacatgagctggaggtgggttagaaagagacagagtggtttttatttggtagaaggaaaacctgaataggaacctgttaggggagcccaagagcatagttgaagaaggaaagtgtggttgggagccaggaaccaaaataggataaggtggaaaataagccattggagtggatggccaagcgggaagttatgctcgcctctgtagtttgaaatcaaatttgcagaatctttaccttctctgtgagtatgccatgaggtgcggtgatagaacc

SEQ ID NO: 165020 - DNA, 333 bp, Homo sapiens
aggtaatggagagcgaaagatctgggatgctaatgataaagtcactaggaagttttgggggattgctggaagtgttatcagcagtaaggaaggcatttactcccttggagaacattgtgaaagaaatacaatattaggaaaagagcttaggaagctgaaagagcgcagaccaaaccagcagaggatggggggagctacaagtgtagagagagatactaggaatggacacctgtgagttgagtatggatccaaggtctgaactaaatagtatcccgagcagtttacacacagagtgacaagttagcaaacagggattgaggaggcagatggtat

SEQ ID NO: 165021 - DNA, 605 bp, Homo sapiens
ttggaaacctatcccagggagtcatctcagaggtctttaagctggattttaaaggatggatagggatttgttaggttgagtaggacagggagaaggaacagcatatggggaacaacatgggctgtgtagcataagacacagggatgagagggacaggaagagtggtcagaaacagcttgtgaatagttgtagggtcttttcttaaagtgttgagatttcctgtatatgatagaaatccagtgagagtttaggtggatatgggtgagcaagtggttcatgtaacatactttttcaggaggcacataatgaaaatgtagaagctggattaaaggagttagagttcatttacgtcctgtgagagctcaagtacatcagcataggggatagaaaagcacaggataccagaattagggacagactagccatgagctataaaaataggaaagagttgagtatgattcagaacttgtttagcttagagaactgttggtatgatttaacttgggaaatagaagaacagatttggacgaggaaagtagaatagtttgactttttgatcctgttaacgtttgacatacctcctggatacttaggtggatatgtct

SEQ ID NO: 165022 - DNA, 201 bp, Homo sapiens
cctgaagtaaagacataatatgcagatcacatttaagtaagggagcctaagggccacacaggtgatgctgtacccatgacaaagacagagtcttaaagaggttagagaggtggagaaagagaaaggaaatgaagtcccagttgcctagagcaacagatgctgactagaattttcatgcttgagtggaatgcgtccctgcat

SEQ ID NO: 165023 - DNA, 631 bp, Homo sapiens
ctgctaactgccccgtggacagaggcagaccctgtgatttgggcttaatttaagcacgtctcttccccacagggagcagccacatggcagtcctagtgctccagcctggccctgtggtcccagcttcttttctttcccagatagcctgcaggatgcaccttcccaagagtggacagccaggatgagcttattcagctctctcccagcaggataagtgcagctcaggaacccaagcagaggactgtgtgaataaccctgagtttccaggcaatctggctctcagcccccacactgcgctgccccttggacagtcagggagttggcagtcagcagacgctggctgagtttggatttgtttgctgatcctgtcatgatatgtcattaaacattcctggctggaagtcagacatgagagtgctggagggtgttctcacacccctgtgctgtggggaggccttcccttctttctggctgccctggtaccctctagagcctcctatctgctgctcggaggcagtgcctgcagcggctggactcctgcagcagctggaggtggaggaaagattcttaggccgtgagtcctcttcttccgacagcgaatttgagccctggtggagcaatgtccggcacg

SEQ ID NO: 165024 - DNA, 573 bp, Homo sapiens
ccccctccccgggtatagggttagaataagaattctgattatgaaagagataaaaagattcatttcaggagacgggtggtccccagtaacataatgtcaactgaaataagctggtaagaaattccctacagcaaagatggtggtgtcattataaaggcagtgagagtcaatatgctgtttggcatgctgcaatagaatgccttttatttctttcaaaccactaatgcttgcagcacacacacccacacggtgatgaaactcttgagtatttggcagtagaagggaactcaactgcagaatgggaggaaggcccaagagggtcagagcaaataccttctgtacactgtgcacaattgtgccttctttgttttgtcactttgtttctatagcctgagatgccctgtccaactccagaatcatatcttctgcatccctcacaaaccagctgaaatcctatcttaactgtgaagtcagttcctgcctactctagctcacactgaacttttgtcttctctgaacagctatagtactactcattttcctacctaatctcctattgttacttaaatgttt

SEQ ID NO: 165025 - DNA, 349 bp, Homo sapiens
tcggctcactgcaacctccgacttccgggatcaagccattctcctgcctcagccttcggagtagctgggattacaggcgagcgccaccatgcctggctactttttgtatttttagtagagacggggttccaccatgtttgtcaggctggtctcgaactcctgaccttgtgatccgcccaccttggcctctcaaaatgtggggattacaggcgtgagccaccacgcctagccaatcaattcttttaacattttttttacgtggcaggtctcctgtcaacaaatttttttttttttttgagatggagtctcgctctgttgcacaggctggagtgcagtggcgcgatctctg

SEQ ID NO: 165026 - DNA, 467 bp, Homo sapiens
cttaataatggtagaaaactggaaaatgaaagcaaaaacataatgttcacaatagtgttgctctttataatggtagaaaactggaaacagcctaaatcttaaaaaatagaggactgagtaaataaaatacagtaggttattactgtggaataccacacagctatcaggcatcatgttggaaaaggacatttaatcaaatggaaattgctcatattttgttaattaaaaagcaagtcagtgtctttgttcttaaaagaattaaggagttttttctttttatataaaacagttgagtttgtaattgataatgtaaataattaacatcattctaatttcatgagtatttgatctacaataatatattaactgattacaaagaaattcagaactaaataagggttatttaagcagtaaactgttctgtgtgataatttggacccacatttaagttaacccccaaagacagc

SEQ ID NO: 165027 - DNA, 468 bp, Homo sapiens
gtaagtctttgtgccaggaagttaagttagaaaaatgaataagataatatttaaagtagagacccctatactgaacactaaactaattggggtaagagtgaggacaataataatttctaggatagaggtaggatacctagccagcttgacataatcaagaaaagctgagcaatctgagatgggacagggagcataagcagggattagcctggtgaatacaagagaaaaagcattcggagagagagagcactatgagcaatggcatgatgttagaaacagcatgcttccatgattttgatgctttgactgagtgggtttgctttaagaaggaaaaatggccaattttataaaaattctacaggtagctgcaaaagaagaggctgctaaaagaagcatcatgtgataatgagaaatattctcagaagctgtacattttctgatttggtagataatttttttttttttttt

SEQ ID NO: 165028 - DNA, 292 bp, Homo sapiens
aggcaacacagtgcaacccacaacagatacacacttcgctgcaccttatcattttaggactcaagggggcagtgggtttgctgccacactcaagctggtcaacttggcagtgtcatgtgttcttcgtgagcgctaggaagctgcctggacctagagtaagtaatactagcagctcacttaagtaattatgaagggaaggtgcacaggacctaagcagcaggctgtggagaactgaccaaaaagacgagttagggcgctattgcaggtgagaaataaggggaccttaagtaag

SEQ ID NO: 165029 - DNA, 226 bp, Homo sapiens
cattatgatggtggaaatgactggccagtcaagcattggccattaattttgaatacatccttgaaaatcatgttgaaaaataaaatggtcagcttcttttaagtatctgatatacctctggactgattatggggactactgattattttaaagctttattttgtcaatggaattttacaggttttgacaatgaccttaatatatttttaaataagaataaatatga

SEQ ID NO: 165030 - DNA, 524 bp, Homo sapiens
aagtagctaaatttgaaagggaagaaagatacttacttctggatgaaagaacactggttctgacaaagaacaccttttgggaccccggaaacaggttgaataagaaacaagagtagtttatagtgaggtgttgagggatgtgtttagtagtaagtgtggtaatcagggcagtttgtgatcactaattgacagtcaagttcaaggaaaaggaacaatgagtgtggcaaggaagagacaatttatttgaatgaaatgataattgagagtccaggtctctagctgagggaaaggtgattgggtaagaagagcggatgggagtggtgctagatcaggaggtggcatttgagacagctggagatttacagggctggctggcactttaaaatgaagcatgtcagcatctatggtatgcatgagaactgtgaccagagactgtgatggagaagacaatgaaagagtaaaggtactgtcagagaatatatgctaataaagcatacaccagttggtccagatgtcatatttgt

SEQ ID NO: 165031 - DNA, 297 bp, Homo sapiens
tgtgtgacccccacctgtgtgactctgactgtgtgacccccacctgcgtgactctgactgtgtgacccccacctgcgtgactctgactgtgtgacccccacctgcgtgactccgactgtgtgacccccacctgtgtgactccaactgtggactgactctaactatgtgactgactccaactgtgtgactaactccacctgtatgactccaactatatgattgacttcaaccgtgtgaccccacctgtgtgactccaattgtatgactgactctaactgtgtgactccaactgtgact

SEQ ID NO: 165032 - DNA, 403 bp, Homo sapiens
gctgcagagtgtgtgtgtgtctgtgtggccacatgtgtgccgtcaccacgtgccatgtgtacacacgtgccaggcgctgtcttgagacattcgcgcagtgcacggcactggggacacgtggcactggctgaactgccacacagccccgttccagggcctcttgtcaaagccaagagggctcgtgtgtcgcatgtctgtccctcttgggtgcctgtgtgtggcttctgtctcatcggggtacggccgccctgcgtgtctcacatcaccacatcctggccgtccgtgtgagcgtccatgtgaccatcggtgtgagcatccgtgtgagcatgtgaccgtctgtgagtgtgcgacggtccatgtgactgtccgtgtttccgtgtgtgtccatgtgagtgagcgtcca

SEQ ID NO: 165033 - DNA, 192 bp, Homo sapiens
ccccgccatcctcgaggagaaaaacaaacatcctgttcttagaaaatcgtgttaagtgctgttcattcttttcccagaggaagcccattgcatgcgacagtgaacaatcacaggctttcactggggacaatagctccctagcttcctaactgacacttcatttccctcctaacctgaaactaagaaccttgt

SEQ ID NO: 165034 - DNA, 126 bp, Homo sapiens
tcttaatatttttaaaagttaaatattccaatcatgaaacaaatatttcaatcatgagaagttaaaccagtaaaataataataatttcctgtcttaggatcgtgtcccaaagttattaaaacttgt

SEQ ID NO: 165035 - DNA, 298 bp, Homo sapiens
tgcaatgtcagaactcccttctctctcttatttcttatggcaggtatgttttcatttcattttgttttagaggtcttttatgatagatcagaacttaaaagatgtttctgacatttgataaagtgaagatagttgtgaaactgttaaggaaagacagtagccatcaccttgtgtattagagccagagttactctttgaaagactgtattctgtataatatctacaattaaaatttttaaactttttttgaggccaggcgaggtggcctgattacaggcacgagcctgtaatcccagca

SEQ ID NO: 165036 - DNA, 643 bp, Homo sapiens
attctgtatttgtcttgattggctagcaacttagaactttttaaaagaggcaaagatagaggagaacaaaggaagtaacttatggaatgctgagaaaggtaagaacacttttaaataaggaagaggaatacgctatgacctaatgcttgcttggaccagtataagcatgccagggcaaatatttaggctaaattgtgggagctaagaacataaagtacactgatttgtttattatggctagcagatatttaagaatgtttgcaagggtctttgaataaattttgcttctaagagaagttactatttattcctaattagacggggaggaaagtctttgaagaggaatagctactttactttttacagctggaaacaccaagatagcttaaaaccacctggaggtagtcaaactaccttgggaaaaggtgagtcatagttggcacagtcaattattcttagatcaataataagaactgtcagaaaaggtaaaatgtaaaattataatttacaacaaaagaagttgaaaagccttagaacagtatggatctgggccccttccacactccctaatctgggagttactatgtgggtttgattgactattgattatttatttatttttagagacacggtctcattatgt

SEQ ID NO: 165037 - DNA, 170 bp, Homo sapiens
aaactgttaaagaatgttttgccactaaactattgttttacaacatttcattatgaaaaatttcatacagaaaagtggaaataattttatagtgagtacttgtacactgattgccaagattctgtaaacaatatttccctctgcttgtgtcatctttcatttgtcaattc

SEQ ID NO: 165038 - DNA, 310 bp, Homo sapiens
aatggtgtcaagaagtagatgacaggagatgatggccttgaatggggggaccaccctcagctaaacacatcggtgctgacaacagggaatgtggagtaggcggggacagaggtgtgtgcatggggtagagggaattctcctctggctatttctattttctcagcgagacagcagcagggctatcagctgagagtaagcgtggaggggaaggggctgcaggctgaggggagggaaggaggcatgccttctgggagaggggtgaacagagaaatgcagaaagacgtcaaaccacatcataggctcactgtgg

SEQ ID NO: 165039 - DNA, 369 bp, Homo sapiens
tgagagcaagatgaggaaagttgaggagctgatggcagagcccccgcgagggaggccgagctgatggcggagcccccatggggaggcccagctgatggcagagcccctgtgagggaggctgcatacttcgtagtgataagataggaagggggacggaaagaagacaggcggcgctggtgtcctgggaagactgtgagcgctggcctcggactctgcaggttaaacacaggcagcaggggcaggaggctgtgctaaccaagaggagaatggccctgggtgctgcggggagaggaggccccgcgtgaatggctctgccccatcctgtgggcttttgtctctgtggtcttagagacccgccttctttcctgg

SEQ ID NO: 165040 - DNA, 324 bp, Homo sapiens
cagatagcgtggttggcatttaggtatgaccatagggttacttaatcttgaagtagtacaagtcttcttgtggtgggaaaaagtatatttttgggaataagaaggaaggatggtttatacaataaaaaaattaggaagtcttccttgagggagtcattcattcattaattgatccattcactgcaatgacaaacagtctgcttagtgatagaaatcaaaagttgagtaggaatccttgtcttcccttgaagggtttttggtttgtgggggctgaaagaaagtcagtgaagaaaaaagtcttgtgtttactttagcaatgtaaaa

SEQ ID NO: 165041 - DNA, 443 bp, Homo sapiens
atccatactaacttgcccagtaaaactttctttagtcctttactgattccaagacttattttaatttttgcctttcaattcttatttcctttcccacagatggtactggctaaaacagaagcctgtaaaagtaaagcttaaaagacgttctttcctttttttggctttaaaatgtttcacatgactacatgatagtcccacctcatccacccacacttacatttttcctcttcctagcattaataggtctaaacatgcagttaggcaggaaatttagaataagaaactttattattttcttgcctcttagaggagttttcaaaaaaatattggaggggttctgattccaggtacaacggagtaagtgtactcacaccaccctgttcctcccactgaatgcggctaaaaaacctgggcagaataagtggagcatctgaggactc

SEQ ID NO: 165042 - DNA, 392 bp, Homo sapiens
agtgccgcaataaacatacgtgtgcatgtgtctttatggtagcatgatttataatcctttgggtatatacccagtaatgggatggctgggtcaaatggtatttctagttctagatccctgaggaatcgccacaccgacttccacaatggttgaactactttacagtcccaccaacagtgtaaaagtgttcctatttctccacatcctctccagcacctatttaattttcaacctccttttcaaacacataattttaaataccattataaatgagctgtttaatatctgaacatgtaaagtcagtaggaagattgtgttatgaatttttaaaacctaatcatttttagtcattttcgtaatctattttttcatttgttacactggtttctgga

SEQ ID NO: 165043 - DNA, 350 bp, Homo sapiens
gtcaaaggggccctggggacttaccgagcccctgcctattggccaggcactgtgattgtcctcggtgccatgtgccatggaagccctctcagaggtcgaggggaggcaggtggagacagagcctctgtaggcctttcaagctgtagccccagagcccagaggcagccgaattcatgtgtgcagtcagagagcacttagtgggcactgtagtcaatcagtgagcgcttactggacaccacaggcagctcgcccctgagttagcggcagctcgtccctgagttgagcagctccccctaagttagcagctcgcccctgagttagcagcgcgcccctgagttggggatcctcta

SEQ ID NO: 165044 - DNA, 447 bp, Homo sapiens
aaaattataaatggaaggcaggtgaataaacacccccaaatccccagctctcttctggtttcccataatattaacctgacgtactcacttatttactattgggggagagaggaagaattttagatctctttaaaaatatcctttttagtatattgcactattttcaagacttgtaccaaatgcatactgtggattctcattatcaaaacattaaaatgctggtttttaagaacctacgaataagaaagcaaggtttaccaaaactctgtaaaaataaaatatgaatggtcagagaaggagccaaagttttactctagacgtgagttacttaaaaatctgttacaactggaatttttggatgtatgtagaatttttaaacataaaaattaatatataaaacatagtaattttaaaaaataaaacggtactgtttttactaataccata

SEQ ID NO: 165045 - DNA, 374 bp, Homo sapiens
gtttctccgtcttttccagtacttgatgatttttagacttcagatattttgccagtcagattgtttttctaacatatttaccttttctctttgttgttttttaaggttgcctcgatgatactatgtgttctagatagcaattgtctatatatgcatgggtctctcttgtctatatatgcatgggtctctcttgttcttatctttaatttttccatccctggttaatgttacactgtttttaactactgtacctttggagtaagtcctgccatcttggaagacaagtgacctgttctccgtcttcctcctcctttgtcagaagtttgataattttcttcataaaggttttacaccatttttaatagatatatttg

SEQ ID NO: 165046 - DNA, 117 bp, Homo sapiens
acgaaaaagagatccaacacaagagagagggaaagggaatccctagaatgatagtaaaggaatatggcaactctatactgggaaccgacagaagcaagttcagattgggatgtaaaa

SEQ ID NO: 165047 - DNA, 707 bp, Homo sapiens
agccctccttgattcacaagccctggccaagaggtcttgagtgtaaaacagaggaaaggtttagaggtggggtatgagctgggtggtttgtaaaaagatgtaataagacaaaataacttctttcaggagatgactagttaggagacaactgagtacttactatgtaccagttcatgtgctgagagatttgtgtgtatttatctaatttaatcctcacacttacactttgaggtaagttttattgttatccacacatgtaggttgatgaaagcttgcccccgccccacttgctttaatgttttctcctaagcattttcagacttatgggcacatgtattcacagggtcagtgatttaggtgttttaaaaggataaaattgctgagggagagcctgagttgccagaactgtagtcgtcaaaagcttgtgtaaggctacttgtttcactgtggaagatgtctttgcattggggcagggcagctgaaagcaattatttattcatttaacaaatgtttattgagtctctattctgtgtagggtatttgggatgcaagataaaaatcccttcttgaataagtttattgtccagtgggagtcatacaaagtgaacattatatcagcatgataaggccttttaaatctatatgttagtgaatggtctgaatattagaatcataattttggagaagaaagggtattcgaatttttt

SEQ ID NO: 165048 - DNA, 416 bp, Homo sapiens
aagacgcatcaggagacagtacttcaagtgtaagcgatgcggcgaaaatcctcgcttccttgtcgttgccatgcgaacatagtgtaaatatataatctcatctattcttagagtgccaccaaccttgaaatataccagaagctagttagaaacacatttcccagttcatcacaacattatatttagtttatcaataaaaccttatctctacagacttactttaatagctcacatctataagttaaaaggatatcatagattggacatccctaaaaagtagatcctaaaatgaggaattgcattgttatgggatctttggggtgctgcttttctggctagaaaactctgtggttagaggtgtctttgcctgagttcatgtaagggcctgaagggactcacgccaacgtaggagtgag

SEQ ID NO: 165049 - DNA, 509 bp, Homo sapiens
tttctcttccccaggggcctcaccttcccttcatgggctttctgcccgcctttgggtacccctagcgggcccgaggctcaccctggtttcgagccagggatgctagtgtccccggggcccagcgcagtgctgatgggaagggacttttgtccgtggggaacccaggacccacttctccgaggtgagctttttttttttctgccgcaggtgcctcacctctcctccctcaaagctcaccttcccctcatgagccctctgtccgcctagaggtaccgctagcggcccgaggcacaccctgtggctgaaccagggactccagggtccctgcggcccagcacaggcgctgatgggaagacacgttcgttcgtggaggacccaggccccgtttctcagtggcgtggttttttttctctgcccgggtgcctcaccttcctctaatgggccttttgcccgctttggggtacccctagcgggccctattcgcaccctgcgctcgaaccagggtcgca

SEQ ID NO: 165050 - DNA, 860 bp, Homo sapiens
ggggaataagcttccaagagaagttttgttctatgactacacaaaccatgcattctttagaatgattttctaagcctgttagttcacaaggggagtctgggagccagtgattcaacgtaagtaaattgcactgaagccccaggcatggtactagaagctgtcttagtggagcagtatatatgcttagtggagcacatttacaaacaatgacaccaatttatactgcaatctacttctcctcattgagagttcttcggtttaatcatgaataaattagcaagggtgatgccataaaactcaggggtgtaaaatcttacatcttggtgcattgcaacttttaccaaataataaataacatctcgacaaatttttaaatgcttactttctaaacagtctatgcctggctaaaaatgaaacaattcaaaccaaaccaaactaaccttactctggataatgtgaccgtactataaatttattttataagtagcctcttttttttccttttatctcacagcttcattcaaattaaatgattcaactagaactttctcagtatctacttctggggccatctcggtgcaacgtgctctacaggataaagagatggagaagacatcaacatttcttgcttcaagagtttacaaatcacttgcctggttttcctcataagaagtcaacagtatttcttgctgaaatttaaattttacatgtaatttttagtatacatttgtctatgcctgtaacaagaagcacttgtggaattccaaaggaaaagttcaccaacgattcctgctaaaactttcagcactcaatgttgtggcatctcagtgatctcagcagaaatcacgctcaatcccggc

SEQ ID NO: 165051 - DNA, 808 bp, Homo sapiens
ggggaataagcttccaagagaagttttgttctatgactacacaaaccatgcattctttagaatgattttctaagcctgttagttcacaaggggagtctgggagccagtgattcaacgtaagtaaattgcactgaagccccaggcatggtactagaagctgtcttagtggagcagtatatatgcttagtggagcacatttacaaacaatgacaccaatttatactgcaatctacttctcctcattgagagttcttcggtttaatcatgaataaattagcaagggtgatgccataaaactcaggggtgtaaaatcttacatcttggtgcattgcaacttttaccaaataataaataacatctcgacaaatttttaaatgcttactttctaaacagtctatgcctggctaaaaatgaaacaattcaaaccaaaccaaactaaccttactctggataatgtgaccgtactataaaaattaaatgattcaactagaactttctcagtatctacttctggggccatctcggtgcaacgtgctctacaggataaagagatggagaagacatcaacatttcttgcttcaagagtttacaaatcacttgcctggttttcctcataagaagtcaacagtatttcttgctgaaatttaaattttacatgtaatttttagtatacatttgtctatgcctgtaacaagaagcacttgtggaattccaaaggaaaagttcaccaacgattcctgctaaaactttcagcactcaatgttgtggcatctcagtgatctcagcagaaatcacgctcaatcccggc

SEQ ID NO: 165052 - DNA, 263 bp, Homo sapiens
ggcattttctattgtgctgctattgaccaaggaggaactaatttggagcatggtgagtctgaggtgcctggaggaaacctgagtggagactaccaggaaggaataggttctgaaggtctgaaaccccacagtgggatcttggctgtagatgagccatgcaattactacggggctggttggattcccaaaagagaatctatacagtcagaagggattagactatgaggagcaaaactgaaaaggaactgatgggagaaatatga

SEQ ID NO: 165053 - DNA, 243 bp, Homo sapiens
tttagaattaatggatgagttcctcaaaaaccataaaccagcaaaactaaaccaagatgaaagagataattcgattcatcctataatcattaaagaaatttaatttatattttaaaagaaccccaagagaaatattcatgcctagatggtttcactttagaatcattccaaaaattttaaaaagaattaacatcaactttacttaatatttgacagaaaatagcagaggaaaagcattttaag

SEQ ID NO: 165054 - DNA, 602 bp, Homo sapiens
gcgggcacttatggcggtacattcctggcaggccctgttccatggaaaactacagaaacccactaaagacaaggccatccaagactcactctccataagaatcaagatttgggttacactgcaggtaacaaataacatccaaaggaggttttggaagtgggaagacaatgtggaatgtactggaagaaagcagctctaagcaccagcagccccgcccccaggacctcagcagctgtattggaagccatctcctccccatctttctctcattgtgggtgaagaactggtgcccagcacaatgggaggaggacatcactgtcaccatcacacactgttactgtgacagagggaaggactggaattgtgtgtcatctgtacggaggactctgatttatttttcccccttgagacagggtcttgctctgtcgcccaggctggagtgcagtggtgcagtcttggctcactgcagccttgacctcctggactcagccttctgagtagctgggaccagtagagggagggggcgcacaccaccacacccggcttatttattgtattttttgtagagaagcagtttcactaagttgccgccaacgaatggt

SEQ ID NO: 165055 - DNA, 601 bp, Homo sapiens
gcgggcacttatggcggtacattcctggcaggccctgttccatggaaaactacagaaacccactaaagacaaggccatccaagactcactctccataagaatcaagatttgggttacactgcaggtaacaaataacatccaaaggaggttttggaagtgggaagacaatgtggaatgtactggaagaaagcagctctaagcaccagcagccccgcccccaggacctcagcagctgtattggaagccatctcctccccatctttctctcattgtgggtgaagaactggtgcccagcacaatgggaggaggacatcactgtcaccatcacacactgttactgtgacagagggaaggactggaattgtgtgtcatctgtacggaggactctgatttatttttcccccttgagacagggtcttgctctgtcgcccaggctggagtgcagtggtgcagtcttggctcactgcagccttgacctcctggactcagccttttgtgtagcgacgggccagtacgagggatgggagcggcacacacaccaaactccgggcatgatttctctttgtagattttgcggtagagatatgcatgtttcatctat

SEQ ID NO: 165056 - DNA, 301 bp, Homo sapiens
agagtaacagtggtagtcacaaaatagcctttggaatttgatgatcctgattttgagttcccttttgatcacttctaaaaatgtgattttgagtaagttatttactgtgtatgtctcggtttctttatctaaaatgagtacattcataacatcttttttcataatattattatacaaatttagccagatattcatgtaaattgtctggctcatgttaaaaaatgatagctattattatcggctgttacgcaggtgccaaaacttgtagcagaaattgctattatttgacaacaccaaaaag

SEQ ID NO: 165057 - DNA, 805 bp, Homo sapiens
atggggtttcactatgttggccaggctggtctcgaactcctgacttcaggtgatccacccccttcagtctcccggagtgctggaatttacaggcatgaccattgtgcctagctctaattggttttttgaagttccttctaacatggattctactacctttagaggatatttgggaattatttctgttaaaaacctatacaataaaggatattttaaaaagttaaaatatattttaatatatataattttatgggcaattatagtattacaaaatatttttaaaagatacagggttctttaatttggaatacaaaagtaatcgtaatctaatataggtatttatgcattatgcagtctgatttaagagtttcctttacctttgcctttccagggttggagatgcctcagagagtaagaagtatttgcttgagccataacattccttttttttttttaagcttcaatccacaaagtttttctttgattagattgatttattttaataattgggaaaaatgaattatgatagtgttgaattaaaatattttctcaagggtgttgggtaaaagagcaggactatactaattgactggagaagccaatttaaagctgatccacagtagtatatgccatttcatatgtaaagggtaagttttacttatactattgcaaaggaagatactggaccatcttgggttatttggcatttcttccattctgtctagttttatccaattttcaatgttaataactttttctagagactatcttgaacataaggaataaagccaagaagaaaacaggg

SEQ ID NO: 165058 - DNA, 305 bp, Homo sapiens
ctacaatcccagctactcgggaggctgaggcatgagaatcgcttgaacccaggcggcagagtttgcagtgagccaagattacaccactgtactccagcctgggtgacacagcaagactccatctcaaaaccaaaccaaagcaaacccttttttcagtactgaaaaacaaaaacaacaacctctggttactgcctcatttctctgtttctcttcaaggagttgtctattcttcctcttcctgttaattcttcacttttccttttcgccttaatctgtgctgatacagttgatgcctccctctttct

SEQ ID NO: 165059 - DNA, 271 bp, Homo sapiens
tccatacctgtgttcattagtttacataactgaattgattctaacttacatataactagttattgttaagaaatgcctcaaagaggccaggtgtggtggttcatgcctgtaatcccagcactttgggaggccacagtgggaggatcaccaggtcaggagatcaagaccatcctggtcaacatggggaaaccatgtctctactaaaaacacaaaaattagctgggcatggcaacgcatgcctgtaatcccagcaactcaggaggctgaggca

SEQ ID NO: 165060 - DNA, 369 bp, Homo sapiens
tattatattgtagaggtctaaggttctggagtcaggcccccaatatccatcttatgataagtctgtgcccttgcaaaaatatttaccttattgaaccttggattttatcatctgtaaaatcaacatattaatagtacttaacctcccaggttgttataaggattaaatcagataacctgtgtgcctgccacacaacaaatgctcaataaatgttggcttttgtagttatttccagaaactgtatttgtctagacttatactcgagaacatagaccagttattgtacttttggaaagtttaaaattcattattgtatcataacacataaaactcaattcttagttgccctatttagctttgtgttcttta

SEQ ID NO: 165061 - DNA, 300 bp, Homo sapiens
tagccatagaatgttccgttactcaaaacttattaaatgtattgtttttgcttaaggacagaggaaataataaggctgcctctattaggacatcgagatctgtggtcaagttcccgagatagaaaaagaaagaaaaagcatgctagaacttgagatgtcccaacttccatcttcaaaatatatcagcaaacacttatatcaaaacatttaaaatcaaagatcacagtaaatttaaaggtttagtctcttgtccttaatttttgaagttagacttgcatgactcccatttagcattctatg

SEQ ID NO: 165062 - DNA, 567 bp, Homo sapiens
tctaaaaacatatcatcgagaattctatgtccacttgctgtaagctgtgaatctatcccagtagtcctcactagttctacagaaatgcatgcctagagtctgaggtatgtgtcatctccagaaacaggttgacttttaaatgtgaatagctatttttaatgctccccaaaacaaaacctattaaactaaaactaaaaacagtttccctagatgatgtggttaggctatttacatttaggttattaaaaaattgcattttcccagatagttcaaaataaaattatgtaatgtagtagagatttataacaaaaaacaaattaatatattatttgtaatctaatgtttgcaatgatacttttgatataaggcaaagaaacataagcagagcagaagcccatttttgaaaatatttcacccatcactctggtggaagtaacagatcataggtacaattaaggattagctactaaattaaatgcaggaagtacaaagatgagcaagtcatgctcttgaaatatatttacatttcaattgtaaataatatatatggttaataaagtttccaaa

SEQ ID NO: 165063 - DNA, 333 bp, Homo sapiens
gtaaagacgaggttttgccatgttgcccaggctggtctcgaacttgtgagctcaagtgatccgcccacctcagcctcccaaagtactgggattacaggcgtagccactgtacccagccttggcccccctttttcagcacagcccatacatgggttcctcagtgtggcagacaaacattcgttagttgttttctcaatatccattctttcttccctactggcagaactccaggcagtgtgaccacctgaaaacttacacttcctagcctcccatgcaggtagggatcgctgataatataggtgaaggcactgggaaatgggcacatctttttgc

SEQ ID NO: 165064 - DNA, 214 bp, Homo sapiens
tgtttttaatattaatagtagaagttttcattacatgttaggtgacctctgactgtccaccagggcaggatgctaaaacaatgactattaagtgttttgcccagtggtaaggcttgtcaactatgagcttactttgggtgctctggccatttctttgtggtacctctaatcccaagtttcttcaatgttgtctcttgtattggcagaatcctct

SEQ ID NO: 165065 - DNA, 175 bp, Homo sapiens
gtatgtacaaacacagaaaggttcacctgtttacagaatacgtaggaggccaggtgcaatggctcatgcctgtaatcccaggactttgggaggccaaggcaggagtatcacctgagcccaggagttcgagaccagcctgggcaatatggagagatgccatctccacaaaaattaa

SEQ ID NO: 165066 - DNA, 296 bp, Homo sapiens
tgctctagccggcctcgtcctcaggctgcagccctgaggtccctgggggctcaggcgggattctggagtctttcctttccacacacactccagaaagtgggactcactcctaatcatcgggatggctgttctggttcccagcactcactgggtgccaggctccaggctgggccctctcctgcagtctttctctcagctccatgaccataaccggcagctgggctctaggtgactccccagcctgcagagtcagttcagagatatctctgccaccctgagaagcccagagcataagg

SEQ ID NO: 165067 - DNA, 640 bp, Homo sapiens
ttagtaaaaattgatatgttttggtgggaaatgatacatcatctctagcctttaggcctgatttaagcaaaatcattgttctgttcattgttcattgttccttgtctgaattattttgcaacttcttgtaagttgaaggtaactgatatataaattctactctgtctgttagacatttggttcatccacttcaccttggaaaaaccagttttgtctccatttgtcaacattcctttactccataaaaattttagctcttttgacttttattttgaaccagttataatatctgcctggttccctcataccatatgaataaaataaatccttaatcaatttttgtgtctgtatgaaagtcatgattttaccttgttctgaaagtgaactttctgaaagtgaacttttaacaagatatttaattcctggttacctttctgagtttaaatcatagagctagttatgttccccctagtaaggaactttatgatttaacaaaaagtatttacaaaagaagtgcttgatctgccatgacatataacttggattataacttaagtagagcctcaagtgtcattatagtatcatagcttgttgttcatgcatctttcattatgattccatatagcaaacaagtctaggg

SEQ ID NO: 165068 - DNA, 456 bp, Homo sapiens
  misc_feature (443)..(443): n is a, c, g, or t
gcagattttaacagtcggcagaaacccagagctgaaatgggttccagccagtggcatacaaaggaggactgtcttaaagggacagagccctctttccaagccagaggacgatacatgagcacacggcgggctctagtctaaaatcctgcaacccgcactccaccggccacaggcagatgcccggggatatgccataaagttccacggaaaacgcagctctctgacagcaggttctgcttggcagacacatagcagctgccaggaccacactgtcctaaatctaccgtcagggtggtgccattcatcagagccatcgccagcgcggaggtgaagcggacccaggaccccaacaccatgttccgaggaaactcactggcgtccaagtgcatcgacgagaccatgaagctggcggggatgcattacctgcatgtcaccctgaagcncgccatcgaggag

SEQ ID NO: 165069 - DNA, 565 bp, Homo sapiens
gcagattttaacagtcggcagaaacccagagctgaaatgggttccagccagtggcatacaaaggaggactgtcttaaagggacagagccctctttccaagccagaggacgatacatgagcacacggcgggctctagtctaaaatcctgcaacccgcactccaccggccacaggcagatgcccggggatatgccataaagttccacggaaaacgcagctctctgacagcaggttctgcttggcagacacatagcagctgccaggaccacactgtcctaaatccccgtgggtaccgtcaaatgaacgtgtccaaggcatgctttaggaccaggatgtctctttgaggtcatccagtataatgattaaccagcatccttcttacagcctctgcctttcaatggataaaaaggtccatatttaaaccaacaatgcggggaaacattttataaagtaattaaggagtgagccctcatttgcggagaaggtaaatatacaaaaggtaactaccttagtcagagttgctcccaggccaaggaggtcattgccatttccttttcatccctcca

SEQ ID NO: 165070 - DNA, 320 bp, Homo sapiens
atgaacgtgtccaaggcatgctttaggaccaggatgtctctttgaggtcatccagctggcaccagacccctctgcctagctttcaaatacatcacttgccttatttttttccactataatgattaaccagcatccttcttacagcctctgcctttcaatggataaaaaggtccatatttaaaccaacaatgcggggaaacattttataaagtaattaaggagtgagccctcatttgcggagaaggtaaatatacaaaaggtaactaccttagtcagagttgctcccaggccaaggaggtcattgccatttccttttcatc

SEQ ID NO: 165071 - DNA, 585 bp, Homo sapiens
cctccctcgctctgatccagccacactggcctccactcttcttcagtgtgccaggtgcactcggggcctgtgccctcagagaggcagctccccccacagcttcacaaatacgactgcttttcaaagtgtcatctcctcagggaggccctccctgaccacagtatctaaatcctgagccgcaaagccccttcacttccttccctgcctgttgtcctatgagctggtcttgcgcattccttgatgcaggtctctgccgtgacttggctttgctcacgtggtgtccttggccgcgagccagtgcctgctaggtggtgggtgctcaacattcatcataagccttttgctggctaagcatcctttgtgctgggtaacggggggcataggggatgattgcccctactgccatcccccaccccagtgaagaccatgagtgatagggatgctacaagccagtgctctcagggctggggtgggcctcccaaggcccctccagctggccagggaagagggcaggctgaaaggcaggctcaggtgtgtcagccccctgacctccccgcaagggcaccatcaggagcccccatgcta

SEQ ID NO: 165072 - DNA, 121 bp, Homo sapiens
ctcacattcagacgatttgtgttttccccataaccaccgtcctagattcaggtttccattgccctacactcaagttgtttaacaaaataactaacttacgtctccatttccaatccccttt

SEQ ID NO: 165073 - DNA, 496 bp, Homo sapiens
atttacaggaataaagaggctttctcctcttcctctttttctctttatctctcaatgagtacgtttgtctgcagttttataaagctgtattgtgtgtgtacactctttggtgttttgcctagcattatttaatggtagttatagcagcagcattaacacatcttgtacttattaatgtgccaggcataatttttatgtactttatgcatatattatttcattcagtccttagagcaaccatgtgaaataaatattatctccattttcggatgaagaaacagaacaaacaggttaagtgactgcctgagatcacatagccagtcagtggcagaatcaggattgagctgagacactcttattccagcatctgtgctctattttcatgtattgctattgctctcaaacttatgtggtgtgatggaaatcaggaaactttgattggatacttgattctgccactaatttatttgtgaccttggtcaagtcacttgtcgtc

SEQ ID NO: 165074 - DNA, 363 bp, Homo sapiens
ctggtggcccctcctaacctttagtaccactgtcctgagctctacaagccactcttactgagccagactctgtctgtccagggaggagatgaactcttgttttgtttctctttctgaagaaaacagtttttgttggagggggatctatacagtggtgagaatgcagtatgaaacgtgcttcttccatgggccatgaggaagatgactcatgttcccttaccatttaaatccggagacggatgaaaagaatttctcttctgactctgaatagctggcacatggaatcaagttgtggatgcattaagccaaatgcaacgtaatggataaaaattgtaaaatctttcagtggcattccatgccttg

SEQ ID NO: 165075 - DNA, 382 bp, Homo sapiens
agaaaatggcagccagtgggcagggcagccaccggcctcttcttgctaatatatgcagcggatgtggcatttctgacaatattgcttctgcctcacttgccatttaatgttaagaggcttctagaatctcctgcatttaaagagtaatgactgttttcagggtaaatgctctgttaaataaccctggattattgtgtcgtgttattacatttataaaatggcatttcaaaaaataataattgttttagagttaattgatgtttttaaccatcactgtgtggagaatttttattcagaagacagggagtgagcaagggagaaagagatttccatcgagagagtcggtactgaaaatagaaacctttcctgcatgtgaaatcct

SEQ ID NO: 165076 - DNA, 795 bp, Homo sapiens
ggtatcgcccatggaaaacagaatggaggttcctcaaaaaattaaaactagaattaccagcaattatatgaccagcaatcccattccttggtatatatccaaaagaactgaaaacaagatctcaaagagatatttgcacatccatgtatacagtttgccaggggggaaaagggaggaggggcagcaggagaaaagaatcttgtcctcactccagatgaaaacaattgcaggctcctgcctgctgtgtcactttcaagtaatgacagtctgatggtcacatcaagtcacaaacatggtcttactagagtaattcagtgagtcagttcattctattcatcaacaattccattttcactcaaaagatttcttccccttctttgcgagagctggcagttcccagggaggtgaggggaaagtagtcattttcttctgtcttgcaccatgcgccataatcctcctccactcactagctactggcttggatcccatgcccaaatggacagacggcaaagaggtaagtggttatgtctggagctactttaattggcttctgagtggcacagttgtaagctgacttcctgctcactgggctttgcagctatataaagctgcctctcacttggggcacttttcttgggatctttggtgattcccatctctgggaacctctccagttgtaattctcagaacaagggagaagcattccattccagctgctattgccctcagcccctggttctctggcaatcccgtccactcagacttcactctttggcttcctctcaccctcccaga

SEQ ID NO: 165077 - DNA, 542 bp, Homo sapiens
tactgaggctgctcaccctcagaccctgctggacctgggggcttcacctgactacaaggacagccgcggcttgacacccctctaccacagcgccctggggggtggggatgccctctgctgtgagctgcttctccacgaccacgctcagctggggatcaccgacgagaatggctggcaggagatccaccaggcctgccgctttgggcacgtgcagcatctggagcacctgctgttctatggggcagacatgggggcccagaacgcctcggggaacacagccctgcacatctgtgccctctacaaccaggagagctgtgctcgtgtcctgctcttccgtggagctaacagggatgtccgcaactacaacagccagacagccttccaggtggccatcatcgcagggaactttgagcttgcagaggttatcaagacccacaaagactcggatgttgtaccattcagggaaacccccagctatgcgaagcggcggcgactggctggccccagtggcttggcatcccctcggcctctgcagcgctcag

SEQ ID NO: 165078 - DNA, 435 bp, Homo sapiens
ccccgactagcccgacaggcaaaagtatggcagtgaatcataaggtgacaggcgcatgctggcgatggaataacgattctcgggtaatagcctgattctttgaaatcatgtgcatttgtttatcatcgattataatgtttggtttgatattcatctatgcctgccgctttgggcacgtgcagcatctggagcacctgctgttctatggggcagacatgggggcccagaacgcctcggggaacacagccctgcacatctgtgccctctacaaccaggtgcgactgtgtgtcctgcacatgcctgcaccagcgagtgtgcatatacttgcctcttctgggggtgtatgtgtgtgtgggcacacaggtgaccctgtacggtgattgcatgtgtgcaccgagtgtggatatacttgcctgttctgggggtgtacgtgtg

SEQ ID NO: 165079 - DNA, 271 bp, Homo sapiens
ccgcgaagactccaaagcacctgggatgtcgaaaacattgctcctgggattttaaaaagcagagaaagcagaaaaagatgccttcatggtgggctcttcaaattctactagcagaggcacaagttaagactttcccaagtggatcctgctggttagattttattaaattaaccacaatttatatgttttataatatattctcatgtgtctgtttaggtataacatgttacagtttccaaatacagaaaaaaaaatcttatctaatttatct

SEQ ID NO: 165080 - DNA, 455 bp, Homo sapiens
aaccagaagattaagaaggatagcttttctgagctgtatagcacccttgtgtttacattttctggaggaaaggaaagctgctttgttttattaggaacgacttgatgtcacatttggaaggcagactgtcataattgttttttcccgttgccatctttggcatagtactctttcttccctttccttatgtaataaatatatgcctggaaagttttacatagatcaagacatattaaatgttttcaaagcatctgtattattatgttaagacatggtgatgagtccttttgtaaaatgaaccctatactttggatggtttaaatatacagtgggttaaactgagtgtatatattaacaggggaacatgtagcaagggagtaatgtttttttaaaaggttaattacaaaaggatttgtataggtggattttaaggaattctaaaggaacaacaaagg

SEQ ID NO: 165081 - DNA, 468 bp, Homo sapiens
ctgcgcaagggaaacggcctgggcacacggaacaagtaaatgtatctggttcaattgaggcttctaggccctcatctcagccgacttactaaagcgcaggttacttccagatgtcactagaatcccggagtttctaaggggaagtgtgagaaggtgttgcctaagatgagtgcagtggcgcaatcacagctcactgcagccttgaccctcccgggctcaagtagttcccctgcctcagtctcccgagtagctggaaccacaggtgcataccaccatgctcagctaatttttgattttttgtagagacgaggtttcactgtgttgcccaggctggtcttaaattcctagactcaagggatctgcctggctccacctcccaaagtgctggcattacaggcatgagccactgcacctggcccttcttcctactcttctcatcatttgatcccaacaccagcctgtaagtgg

SEQ ID NO: 165082 - DNA, 468 bp, Homo sapiens
  misc_feature (18)..(18): n is a, c, g, or t
  misc_feature (22)..(22): n is a, c, g, or t
  misc_feature (464)..(464): n is a, c, g, or t
ccatgcgagctcggcacncgcncaatggcagccggcccaatggcagccgaaatgtccattttgtacctcaggagcacatgggaaagatgcagaccattggccatcagaggctttagactaaggagttttcaaagagctcaggctgccttgtagaagcaaaatacaaggtaataatagagtcaagataacaggaagtaaaagaactctgcaaagcacagttagtaccactctgaaaatcactgtttcctgtttgctaacaaatctcattctcctgaaggaccctggtcaatgtgaacaggtcccatttgccagtggctgtaggtcaatttgctgaatgccagttgtttccattttacatgtgtagtccctgccagtcccaccccttctcttcctgtccctctaagtttcttcagttgtttccaatctctcttgttttttttcctttgccgggttggatttccggnggga

SEQ ID NO: 165083 - DNA, 426 bp, Homo sapiens
gtatgcctaagctcagtgcacctgcctcagaccccatctggaatcccccactgcaccatgaatggaggacacaagcagaatactaatcggattctctgaagactaagatccaggagatcattcagacagcaaagaccagaccccagattcagatccaaaagatctggaaaggctggctgaggcaaagggctgaaaggaagagaccactagtgacgtggctcccgagagagccggctcagctgtcccagcagcacagcccagggccacctgctccttccacatcagcaacacctgcccctgcagctgggtgactggggcagcttcaggaaggaaacatggagccagaggggtgcagaggtcacatccccagcacaacgtgaaagaaaagaacaatctcagaggggaggagacggccgcctgcaaagg

SEQ ID NO: 165084 - DNA, 561 bp, Homo sapiens
gctggagtgcaatggcacaatcttggctcaccgcaacctccgcctcctgtgttcaagtgattctcctgcttcagcctcccgagtactgggattacaggcatgcaccaacacgcccagctaattttgtattttcagtagagacagggtgtcttcatgttggtcaggctggtctcaaactcccgacctcaggtgatccgtacgcctcagcctctcaaagtactgggattacaggcctgagccaccgcacctggcccacacatttttacataccaagagatcctttaatccacccaaaggctgacgttagctgcatctgtaacacaactttttcctcaaatatatggagttttttttaggcttccacttctatacttccctattctcactccctgttttaatttaacatagacatgcaatgctagataatagaattgctctctaccagctgaacatttgggagcctgtgcagtttctggcccttcttgttgcacatagataaatacatccggtgttatagagactcagttgtaaaaatcaataaatgtgctgcctggttaaaat

SEQ ID NO: 165085 - DNA, 320 bp, Homo sapiens
gaataagtcaatgaatagatgaatgaaatggacatttttttttctaggcaaggagtaatacagagaggaaacactgactctgagaatgataaaatccagtttagaagaaatcaggagtgggccaggcatggtggtttactcctgtaatcccagcacttttagaggccgaggcgggaggatcagtttaggtcaggagttccagatcagcctggccaacatggcgaaaccccatctctacaaaaaacacaaaaattatccagacgtggtggtgcacgcctgtaatcccagctacttggggagctgaggcacgagaactgctt

SEQ ID NO: 165086 - DNA, 653 bp, Homo sapiens
ggataactcaaacaggggattccaggacataggtgaattctgtaaaccaaaagtacctgaggtctcaatcaagttagaaatttattttgccaaggtttaggacatgcctagaagaaaagaacccagaagcacggaaacagtctgtggcctatgcctttctgcaaagatgattttgaggtcttcaatatttaaaggggaaacgtgcctggaggggaaagaaggagggtatggtcatacactgtgcaagagaaaaaaagcaagtagggaacagtacattatgtactggtctcgtgctcagtaaatcagcattttacataaggtgaagatgtcccttttctgcactgtctaatatggtaatcactaccaagtgtggctactgaatacttgatgtgtggctaataaagctgaagaaattttaaattttaaatagtttgatataaagtaacacataaaattaactctgttaataccaaagtagtatgtctggagtaaacaaatttattgaccatatttcatagttttctgcctcagaaaacaatatattatttagcttgattgatgcctgctgtcatcaggaaactcagttatcatgtacacaatgacagactaatgcctctaatatcaaagtcactcaaagagaaaaaaagaaaaaa

SEQ ID NO: 165087 - DNA, 441 bp, Homo sapiens
ccttgatatttatggtgggcaattaacccgaattctcaggttcccaaatatggaaagaatgacatgttcagatagaaaggcactgtgggggacattacccaattccctagccctgcaaggatgtctatagcaaagactgccagttgcctatccaataccccttctgccatcttctgccttttatggctcacagctgcccagtccctcatagctagatgtgaccttgtgactaagttctggcctatgagaagtaagacgtatctcatggtgttttgagaaatctacttaaaaatgtaacatgacaggaaacagtggctcatgcctgcaatcccaacacttttggaggccaaggtgggataattactttgaggctaggagttcaagaccagcctgggcaacatggtaagaccctgcctctacaaaaaagaaaaatgaaaaaaa

SEQ ID NO: 165088 - DNA, 201 bp, Homo sapiens
tataaagtaaacccctcccaccaaatatatccaattttatgagcagcatagctattgctgctgacaaatattcgtaaagctcacgtatcgcataacgcagaacttctctatttaaggaatagatactattggggtaggaacaagtacagcagaagatgagcaaatgtcttaaataaaagtttacagtttattattatttct

SEQ ID NO: 165089 - DNA, 513 bp, Homo sapiens
gtcccgtttgggggatgggcagatgatgagagttgggagaaggaggagctgaagtaaacacccccatccttgtcagtctttggttaaagactctcctaggggtatgtaagtcaccaggcgaggctgggctctacagctacttggtaaagtttctgagcagtacagcatctgttacaggcccatttcagaggagttggttctagagtctattttattaatatctaagcatatgttaggttttaaacagaaagcgtcaagtctctggtggatgtgcaataacatcacaccatatttaagttcttacaaagatgtagaaggaagatgtgggtttcagaaatgttctggaaactagaaacacttccctgtgtgtcatgctgcgacggtgccatgtcacgcagcccactggagtggcgtgtgaggtaatgacattgacttcaggtcctggtgagaagactattgctaggaggcatctggctggctggtggctgctcatatcctacgcatacccacctg

SEQ ID NO: 165090 - DNA, 352 bp, Homo sapiens
gcacagaaagatttgggattagtccaagatggcccagctaggttgttaagtggcagagctgggattcaaacacaggtagcctggttctccagaatccacatacatcatacatccagagtccagctttaccgctgtgcaaggcagcctcaatcttcacagtgtcttgacttccccaggtgaggaagcccttctggttcagccctttgattctgtctaatggcaccccctgcatcctacctcctcccgtgagattctgaagttggttgctttggccttatcctcccctccttccctcatttcctcaagcccatagctcatatcaatcattaccttacagttgagtgcttttaat

SEQ ID NO: 165091 - DNA, 403 bp, Homo sapiens
gagcgagactccgtctcaaaaaaaagaaaaaaagaatattcttaaactgagacattaagtaactgttttctcttttgtgtgttttttctttattcaaattttctaagtgaacatacttttatagttcggaaagaattaatgtgatacatactttgaaactggcaggattgttggaatagttttatagcctctcctaatgactactgatactttaaagggaacagtattcatttttatctgtggtcagcacttggcatttgtggatttaacattatcttctaagcttctagaaccattctaaatacctgtcatgagtagtattttgtaatagaaatcattatttctacctcataagagtttttagaagatgaaattggataactttttttaagcctccaggtgg

SEQ ID NO: 165092 - DNA, 341 bp, Homo sapiens
accctcatctctcttttaattcttaagtttataaaattttccctcttcccacttctctacctttttctagtttacttagatttcttcttccttagccttttactttttgtgacaacaaagtcagattttctttcttagagagaaatttaggtcatcctttataattcatcttcttcccgtgttattagaaaatccagaactccatttaaatttgcagagagagaacctcactaaaaacgattgtggaaattacctcatgagcttaggtctcttcttttggcaataggtacattcaaaatataagaagagaaaatgaactaacatataaaaactcctctggg

SEQ ID NO: 165093 - DNA, 254 bp, Homo sapiens
tgcacagggctattgaacactgggactcattcctaaaccctggtgacactgtgggaagagaaacaaacccagtcaactgaatccaccttataccacagtgaaatccctaacggcatgacagaagataaaagcaaagcaaagcaaaacaaaacaaaacaaaaaacatggaaagaatagcaactccagagactgaaagaacatcaacccacacagatgacaaagaaccagcataataactctggtaactcaaaaat

SEQ ID NO: 165094 - DNA, 348 bp, Homo sapiens
cctgtaatcccagctactcgggaggctgaggcacaagaatcgcttgaacctgggaggcagaggttgcagtgagccgagatcttgctactgcactccagcctgggcaacaaagcaagactcccatctcaaagaaaaaaaagaacaagcaataaaacaaaacaaaacattaccaagagataaactgtgtgtacaggggaagagcgagaatcaaatgagattctggatgtgaaaagctttcataaacagtgctgtaaggctgggtgcggtggctcatgcctataatcccagcactttgggaggcccaggcaggcagatcacctgaggtcaggagttagagaccaacctggc

SEQ ID NO: 165095 - DNA, 671 bp, Homo sapiens
gcagtgtttggttttttgtccttgtgatagtttgctgagaatgatggtttccagcttcatccatgtccctacaaaggacatgaactcataagatggatttttttaaatgacaaagcagaatcagaaaaatggctaaagagaggatgaatggctgccttcttttccatgcatggtgtcaccttataaaggatgtgaaaatgtcaggcagggcagctggatctttatttcatggtttcatacagagtgacctggccagaagcccttgggaaactgggtggtacagggtaatttattctagcaccttcaaaggagaaaaggccagtgtcctcccttctcaactggcattgcctagcacctagtgcataaccgccacagcccaagcatcagcctgcctggcatcccctgcccccagaagggccatgccactgtctccacaaaaacctgcagcctaggccactaaagcacttgtaggcacttcttacactgattacagccaaagaaatcacatggagactacactgctgcatccacctaccaccaaagccaaagcacctacccagccaacgctataggacacatctacaggaaaaagtctttgcctatgaatataaaattggaagaggcaactgtcccaccagatgcacagatatcaatatagggacacagaaata

SEQ ID NO: 165096 - DNA, 609 bp, Homo sapiens
ttgctggaacccaggaggtggaagttgcagtgagctgagatcgcaccactgtactccagcatgggcgacagagcgagactcttcctcaattaaaaaagaaaaaagaaaaaagaaaagaaagtaaagaaacaaaagaatggctactccatagacagagtagccctgaggactgttggtttattttaaggtggttttttgatcagttgctaagcaagggatggattttttaagagttttctggaaaaggagcgagcaagccccagaactgagggttcctccctttttaagcaatatagggatatagggtaacttctgggcattgccacggcatttgtaaactgtcacggctctagtgggagtgtctattagtatgctaatatgttatacttagcatataatgaggttgaggatgactaaagttccctttagtcgctgtgttggttttggtgggtttgggctggctctttttcttttacagcatcctgttgtatttattatcagggtctttatgacctgtatcttgtgataccagtcctgaggacctcctgtctcatcctgtgactaagaatgcctgacatcctgggaatgcggggcagcaggtctcagccc

SEQ ID NO: 165097 - DNA, 307 bp, Homo sapiens
gagctggcccggcgttactgactgtcctgcctgcaagtgggtgggcgcccggcttgctgcttcgaggccccaggagtgcttgggagaagggagtcatttccctgttgacagtctcctgggagaggctattcttgtctgtcaaaccctctccgcttgtgaactggagtcggcagagccggtccctggtggagaaggtgggccgggtgggccctgtgggccaaatgccgcttctgctgcactttggccaagctgagcctctgcttccgtctcgtcatccatgaatgaagacagtacaacctgccggtgg

SEQ ID NO: 165098 - DNA, 613 bp, Homo sapiens
gtattttcagttgttgtgggaaatatacatatatcagaaagttggcatgtactaaggaatagatttatattgaacaggccactatccattacataacatcttgggattagtagcataaacacagtctgtatctggatatacttttaattgagaatctggaagtgggattgagaataataaatagctctttcttctgcaaatctttctagtagtaatggtgttattatgaggaaattgtcaggtttttgcagaaattactcataatgaaataccagatctaggaaatgatgatcagtagtttctagtgtcacaacccccaccacccttttttaaaaaacttttccaattgtatctattatcatcccaagtgaaaagtgttgggatgaatacttggttaggaaatgctgacttctccagtcttataatcctattatgattatccactgtttcctatcatttccacactggaatgataccaaatgttatacatctttgaacatatcttgctgttttctctctgtctggattcctctcttcccccgaccctccctgagagtatctgtttatgattctttgaaaacttttttgagcatttgggactacacatttaccc

SEQ ID NO: 165099 - DNA, 496 bp, Homo sapiens
gaggaggagagtagctgaagccaaatttctcctgggtagtgagacttacagccagagacagctttgtgacctgaaacccggtctgcatgtatcatttctgggtgctctagtctgttcccttggtgagttagggaacagtgtcccaccagctctgaggagcaagagaaaggtggaacccactcctctaatctaactcttggtttggtttgcccctaagggagggtgaagtgcagcccactaaagctcctgttagcacaataaaaatgcaagcatggcaccagccactgacagcagctccaccgaagcccaggaatggatgtagagacaaggttatctcttaccccttgccatgtgtcctcaatgcactgttgtggacttagcagcagctactcccttaagggcccagggagcatgggcagaaagagactgcttcttgggcttctccagcagctccacccccaacgaaggcaaacacacactggagaagggtgctttt

SEQ ID NO: 165100 - DNA, 1116 bp, Homo sapiens
  misc_feature (665)..(665): n is a, c, g, or t
  misc_feature (668)..(668): n is a, c, g, or t
  misc_feature (671)..(671): n is a, c, g, or t
  misc_feature (674)..(674): n is a, c, g, or t
  misc_feature (677)..(678): n is a, c, g, or t
  misc_feature (765)..(765): n is a, c, g, or t
ataatcgcctggtcgccgtcaggtgccggcccaggtggcaggcgcgcccgttgggcactgggggacgcgggcgcgtcaggtgaagactgggggctgcaggcgcgctaggagaactatgccatttttgggtcaggactggagatctcctggatggagttggattaagacagaagatggctggaagaattgtgaatcttgtagtcagaaacttgaaagagagaataaccattgtaacatcagtcacagcattatcttaaatagcgaagatggagaaatactcaataatgaagagcatgaatatgcatccaaaaaaagaaaaaggaccattttagaaatgacacaaatactcaaagtttttatcatgaaaaatggatctatgtccataaagaaagcacaaaagaaaggcatggctattgcaccttgggagaaacctttaatcggttagacttctcaagtgcaattcaagatacccgaaggttcaattatgtggtcaaactgcaggacaaattcgagcatcttaaaatgattcaacaggaggagataaggaagctcgaggaagagaaaaaacaactggaaggagaaatcatagatttttataaaatgaaagctgctctgaagcactgcagactcagctgagcactgatacaaagaaagacaaacatctnacnatntgnacnngacagcaaatgctattgtcgaagttttctaaagaagaatctgaagtgaaatgacatcaagagacctatcaagacctgtatccagganaagaccaaaccaatgcagaccaaaccaatgcagaactcctatgtgctgatggtgggtcttaacattttcccctaaggtttctggcggactaaactgtgcacccgttctcagggacctccctggaagctgggtccccgggccttaatccaaggacccacccaagagtttggcttttctttcgcctggggcttgtggtccaagcgttcctggtggaggccaggttggggaacaacgctctcccatggccgacgctggtctgcggtctccagggggtttgcccctgctccggcgttgctggccctggctgggtccgacggggccccctccccccttgggggcccgcgggggccc

SEQ ID NO: 165101 - DNA, 963 bp, Homo sapiens
  misc_feature (512)..(512): n is a, c, g, or t
  misc_feature (515)..(515): n is a, c, g, or t
  misc_feature (518)..(518): n is a, c, g, or t
  misc_feature (521)..(521): n is a, c, g, or t
  misc_feature (524)..(525): n is a, c, g, or t
  misc_feature (612)..(612): n is a, c, g, or t
ataatcgcctggtcgccgtcaggtgccggcccaggtggcaggcgcgcccgttgggcactgggggacgcgggcgcgtcaggtgaagactgggggctgcaggcgcgctaggagaactatgccatttttgggtcaggactggagatctcctggatggagttggattaagacagaagatggctggaagaattgtgaatcttgtagtcagaaacttgaaagagagaataaccattgtaacatcagtcacagcataggcatggctattgcaccttgggagaaacctttaatcggttagacttctcaagtgcaattcaagatacccgaaggttcaattatgtggtcaaactgcaggacaaattcgagcatcttaaaatgattcaacaggaggagataaggaagctcgaggaagagaaaaaacaactggaaggagaaatcatagatttttataaaatgaaagctgctctgaagcactgcagactcagctgagcactgatacaaagaaagacaaacatctnacnatntgnacnngacagcaaatgctattgtcgaagttttctaaagaagaatctgaagtgaaatgacatcaagagacctatcaagacctgtatccagganaagaccaaaccaatgcagaccaaaccaatgcagaactcctatgtgctgatggtgggtcttaacattttcccctaaggtttctggcggactaaactgtgcacccgttctcagggacctccctggaagctgggtccccgggccttaatccaaggacccacccaagagtttggcttttctttcgcctggggcttgtggtccaagcgttcctggtggaggccaggttggggaacaacgctctcccatggccgacgctggtctgcggtctccagggggtttgcccctgctccggcgttgctggccctggctgggtccgacggggccccctccccccttgggggcccgcgggggccc

SEQ ID NO: 165102 - DNA, 544 bp, Homo sapiens
ttgctgcggcgactctagaggacccctataggcgctagggttcatgatagtgggtggttggtgtaaatgagcgaggcaggagtccgaggaggttagttgtggcaataaaaatgattaaggatactagtataagagatcaggttcgtcctttagtgtggtgtatggttatacattgtcattctcatgccaagatttgaggttatagttgtataaaagaaatacacagcacattcttgttgtgtgttggattaccttccatattcttcctttggccttctctacatattttttatagtccctcaacatgcacacaactttttaaaaacatttttattcgggaaaggtggagtagatgtatgatatggtttagctgtatccccacccaaatcccatcttgaatggtagctcccataattcccacatgtggtaggagggacccggtgggagataattgaatcataggggcagtttccctcatagtgtactcatggtagtgaatcagtcccacgagatctgagggttaataaggggaaacccctttcac

SEQ ID NO: 165103 - DNA, 261 bp, Homo sapiens
ctctctattgtaacacatcacaaagaacacttgaaatgttacattaattgtgattatttttttgaatctttccgtcagtttttgcacccaataaatagaaattttagaaagaggccagtctgttgagacactgatccagcatatagaaatgaaatcagtaaaggtgcttagaaccatagctggtgtgtggtaaatgctgttgtattagctattactaccaattctacagctactactatgcagttccaatgttaatactac

SEQ ID NO: 165104 - DNA, 169 bp, Homo sapiens
ataggatatgaaggaaggatgattatattctacccaaatacaattttggctatgttatataaccattaaaatatattttaaagttaggcattgacttattatgccaaaaagttagtgtgatcatggcaatttcatgtgtttaaacctaatatattgctctgaggatttt

SEQ ID NO: 165105 - DNA, 277 bp, Homo sapiens
tagctggaattacaggcacgtgctaccatgcccagctcatttttgtattttgtatttttagatggggtttcaccatgttggccaggctggtcttgaacgcctgtcctcaagtgatccgcctgcctctgcctcccaaagtgctgggattacaggtgtgaaccactgcgcccggcccatttcaggtttcttggtgctctctgctgtcccgtctgggcccctgctgccactttctgcactggctctcacggctcgaagcaccaaatgaagcatcacctcc

SEQ ID NO: 165106 - DNA, 142 bp, Homo sapiens
tctttcactagctctgggatcctggctactaagtctataagatctgaaggggatggatgcaactgatgcttctatgtatctaaatttaaacattattggtttaatgttgaggcttattccttcattatagctatttatgcca

SEQ ID NO: 165107 - DNA, 469 bp, Homo sapiens
ctcccaccagaagagcatgaggattcctatatccccacacttggcatttctcttttttgtttttttcccattctaataggggaaaagtgatagttcagatacgcatttatctgattactaatacttttgaacatgttttcatatgcttgttaacctttcagatttcctcttttgttaattacctgttcatactgtttacccatttttaagttgtgttttctatcccttttttggtctatttgcagtgattcctcacatagtccagatatttaatcttttgttggctttatatatttcagataagttctccccactctgtcctggtctttcaactttttcttttcttttcttttcttttttggtttctttttgagacaggagaatctcttgaacctgggaggaggagcttgcagtgagccaagatcgagccactacactccagcttgggtgacacagcaagactgtctca

SEQ ID NO: 165108 - DNA, 598 bp, Homo sapiens
tctcagaggctccggcgtcagtacattgagaggtaagtgaagtcagttaaaagtttaaagtatatataatcagctttgttttgctgaactttgttttattgagagttttgtgcaatttataatattgtttcattgattttctttcttattgcatcttatatggactgttgtaacattctgtgagtatattttgttcatgtcatccatttttggtgttcagtaattttaaaaatgaattttaagtagggacaggagcttgaatatgtaatttggttttatgtaccagaagatccatcagaaactgagtagccaaacttgtaacaacctgtattggtgcatattctgccagactatgaattttcttaagtaatagagaacagaggtctttaaaaaattgtgaactgagatttttttaaaggtgaaatgaaagcagtactgtacaggaaattaagtttttgggtaaggaagtggaattggtttgattgaaattgttaatgtctctttaatgaggggttatatgaaaaatgttaggcagaaagtgtgatccagttaaaaatcctaaatatgaaattgattcagtttgaacaaacagtatttg

SEQ ID NO: 165109 - DNA, 460 bp, Homo sapiens
gtggttctgggtggcctgagcgctgcccagcacccactccccaagccctgcaggtggtgactccaatgagcaaaggccaatggctgttttacagaaaacagagggcaccttcctggccatcacccggcctcctgccttcacacagaatcccccagctcctggtgcagcagtgctggcctggcctgtggctgcccactcccaggcactgccgttcccatcatggtcagacctctgcgttttgctgttggcctcccccgcgccctgttccagcacagcgctcttgatggcccgcagagaggctctggggagcactgagcacccacggccagggcagctcaagaatccttttgtgtctctggtggtgccaggggcagagtcgcttgggtttcaccccgcacaggccggcctcgctgcccctgtggacaggttcgtgtgtaaggtcctgcccacgccacaccag

SEQ ID NO: 165110 - DNA, 825 bp, Homo sapiens
agcctcacctccacagctttgcttgtctcagttcactcctgagcagctctcacaggttggagttttgtgcctatagatctcccagactggttttgtgaggcagcacagggcagtgaatgctgaggtctttcaggcacctctctggaagctttgaccttaaggtcctaacttgcgtaacttctggtcctaactccatgatctcggaaatatcttccaggtcattctccctttgtcttatgaatagaacttggcttccttctagccagattaatattttcagcaaatgaccacttggccaaacccttcttattctctctcgaacatgcttttttattctttatatggccaggctgagagttctccaaatttttctattagtcttcacttttcattataaattccatctttaaatcatttctctctcctcaacattttactatatgtgcttgaaagaagccatggagcccactgaatgttttgctgctgagatgtctcttccatcagatatcgtagttcacctctcttaaattctgccttccataaagccaaagggcatgaacagaattctgccaagtttttttgccacttcataacaaggatgatccttactccagtttccaataagacatttctcttttccacctgagacctcatcagaatggcgtttactctctatatgtctaccacatctcctcgggcctaaagttactcctagaaaggcgaagttcccgacaagttcccactggacccgggacccttaaaaagtcggcgcatgggttagcggccccacacatcgttaacggggggcccacaaccccgcggtac

SEQ ID NO: 165111 - DNA, 202 bp, Homo sapiens
ctgtgaagaggaaccattcaagggaccagtaatgaccttgggtgggatgtttgtgggctgttcttctggactaaatattgtgcagcaaaaaccaaagtgttattgcctccagatgcccacattcatggctttcttcttagaagatgacagtcaagtttcttttactccctaagaccatcaaagtggaaacactaacttcagc

SEQ ID NO: 165112 - DNA, 543 bp, Homo sapiens
catactttcttcgtttgatttttaaaatacttcactggctctttgtggggactaaatgggatatttaatatttcacttactgtgctctacaaaattcccgataagttctcagtaagggatagccatttacattcttatcctctgtaattttcttccctgtgttatgtttaagtaatttttttttctttcatggagaaggtactaggaaagtaagatgtgggaaaatgggactatttacatatcagaaaaggaagattagtaaaaaattaatacgtgtttatttcctctgcttgtccatgttgatttctcctgcaagaatgaacttgtctctttttgctcattgcacccaggagggacaaaaccatgtccagaggtccccttgttgaggctctgacatgcgctatttttttactttgttttggggctcaccaccccctgggaacactggtcttgcagtctactgggaggcggaggttgcagtgagccgagatcgtgccactgcactctagcctgggtgacagagcaagactccatctccaaaaa

SEQ ID NO: 165113 - DNA, 372 bp, Homo sapiens
gcgatcttgttttctttatctttacccagcgttttcatactatggtacttgaaaacatccgaggcatctgtcatttcacccaaaaatactcagggccgggcgcggtggctcacgcctctaatcccagcactttgggaggctgaggtgggtggatcacgaggtcaggagttcgagaccagcctggccaacatggtataaccccgtctctactaaaaacacaaaaattagccaggcgtggtggtgggcgcctgtagtcccagctacttgggaggctgaggtgggagaattgcttgaacccaggaggcagaggttgtagtgagccaagatcatgccactgttctccagcctgggcaacagagaaagactccatct

SEQ ID NO: 165114 - DNA, 506 bp, Homo sapiens
gcttcctagtacttgtcttaattagcacagccaatagttctacccagaaccaagacttgggcagattccagtagatctctggcccaggtttttaccatctgggggctaactcaggctcaaaacccttggggacaccctgtctcattttctgcccatgcacgcccagatccatttctggcatgtgacacaagagaaaaaataatttattctttaattttctaagaaatctagttttccttggccataagagtagtcataatttccagacctcagaagtttggccttgcccaattatcttatgaaattgaattttcaagatagatggcttcctacaccgaaaatagcctaggctcaagtttgcataacaatgatcatgctgactactagatcaaggagcagctaaacatttaatgaagtgcctcatggagtcatggaagctcctatacactggtgatatattgtcaaagttctgctctctgtttgcaagcaatgctagcaatgatgcc

SEQ ID NO: 165115 - DNA, 226 bp, Homo sapiens
acctcggtcatctttcccaaggtgctggccaacatcctcacaggatacaagaccattccctcccaggctgcttcctgcaaagtttgctctattttttcttgggcaccacagagttcttcctcctggcggtgatgtcctttgacaggtacgtggccgtatgtaaccctttgcattatgccaccatcatgagcaaaagggtctgtgtccagctagtcctctgttagtg

SEQ ID NO: 165116 - DNA, 332 bp, Homo sapiens
gagatcatcaagtccagccctgttgcacttcagctgagagtactgagagtcagaatggctggtgacacagctgcggtcacagattaaagtgaaaaccaaggccagcgttcaagtctctgtctccgcagtcagtctttccactatagactattcagaattccttagctagctcactctttcactaaggcagctcctctctttctaacactggagctttacagaatagacacatggtggagaagagcaagcccttccttggtggtctttgttggaggataatctgcttctcagcactgccctcatcctcttttcaaaaactcctcgaaccctga

SEQ ID NO: 165117 - DNA, 386 bp, Homo sapiens
gtaagaattacatcttgcagcaattagcctttgccacaatggtgtattacaaacaacttcaaaattcagtgactgaaaaaaattattttgtttctccagatgtttgagtcagctgggcaggttttgcttcacattgcaggtctgcaggtctgggtcttcctcacatgtctttcatcctttttggtcccattgagttattcagggtacattcctctcatggtgatggcagaggcacaccaaatggcaagcccaaccacgcaagcacttttcaaactgctttttgcatcacatctgctaacattctattagccaaagcaaaacacatagtccagcccaaaattaagaggctgagaaggacattccatctttagttgcagaaaatgcaa

SEQ ID NO: 165118 - DNA, 150 bp, Homo sapiens
aatgtgagaattagtctttcaggtatgtaattttgttttgttttctaaaaatcaattactctatgtgttcacttagaactggtgaaaaaagttagctaacacagagatagtaaagtctttaaacttacattaaattctaagtatttccgc

SEQ ID NO: 165119 - DNA, 1118 bp, Homo sapiens
gggattacaggcgtgagccatcacacccggcctggatgctggtagttttattttctgcttagaaaacgcaaccatgttgatgggaccaaaaacttagttgaaagaagccatggcaaaagatgttgacgtacaactggctcctgaggctgtcaattgtttagagctcccaagtagtactgcattacggaatctactacttagaagaatgtacaagatgtaagttcccatcggcaccgtcatggtaagaagaataagaaactctcaaaggaaaagaaacttacattcactttttcctggtccattttggttcctaagaatagataggccattaagaaggatattaggtttctaaggacaattttaacacaatactgctttaaaaatctgaagtttaaatagtttagctatttctgtaggttaattcaggcactgactaaaatcagtctcattatcatatacaaatgtaaggaagttaaattttaaaagcatgtataggttgtccttaaattatacaaaagcttttagtttcatcaggattatattccagttaacctttcatctttttttttttcccaaatgaactagggtctttaaaattcctaagtagattcttttgagtggtaggggagtctgtatagattacagatataatttattgtgataacaaatggcttcctgtttgacctcatttccaggtgtcgcatccgtggctgatttatttcacagatgtacatttgcatgtacttgttgaactttgctaggaaggactcaatttttgaaaaatctgttattttcactgtgggccttatgaggcaatctactgcaatggaaaaagggttccttggtcatttcaagttttattttctattagagtaatatctaacttcaattattttgccaggtttaaaccttctctctgtgtctgtggttagaatttgaaaataacaatgctctgcttaaagtaagagtcacagtcagcaaaaaaagccaatggattttaaaaagacatcttagttaaagctagaggaagaaaacttcaaataagcaaagaagtattgaaggatgcccacgaattcctttgcattaaaatcaagatgaggtaagaggtagaatataag

SEQ ID NO: 165120 - DNA, 1151 bp, Homo sapiens
agttccttggggtcagtacaggcctcacttagataccaaccagggagtcagcttaaaccttggtttcatctcctttggaggcactttcttgcagatgtggatggtgagtgaatcaacattaactcaggtgagggggctctgatcttaaaggtctactgtgaagacaagtaacacagcattggttcttctggctaaagacagccaaagggagttagattgctcctggacctggcacagtcttggggtgtcacaatcttaagaggctgagggcagagatccacgaattttagcttgcttctccctttccttggtattacagaaggactgtctgtagcactccctgtgtgaagctgaggaccactacggcatggagctggcccagctgcagagcctcatcagcagtgtagaagagcagctgtccaagagttaggctgacctagagtggcagagccaggagtaccaggagcagctggatatcagggcccaactggagggtgagatcaccatgtactggaaccttctggggaacaaaggctgcaagtatgtgtgatgtcaagtagtgtcttcatttatgagtatcagtgttgcagtgtctccaggtagaacgatgagggactgatgtttgtttcacaactgtccttactatgtgaggttggcatttctgacgctgttattgcagacaaggatatggggctcggagaataattagtttgccccccgtcagagttagtaaggggggagggacataaactaaagctgggtctgtggatgaactgtctccatgtgcatctgctgcaagagccatgtaatccatgtaccacacctggaggtcacgtgcaagagtgctcacatgacctgcaccccaagccccacatagcaacactttcttgagctcaccctacatacccaccagaggctgccagggcagcagcagattctgcgcacagggtgggttggaaccctcctctcattgcagatgagacggaggcaagggaaagagactcacctgcggctgaggcccaccttgtaaatggcttaccttcgagaagaggcgggtaccttgtgactctgcagcttctcacaacttcgacttgtgttttcattttcaaggagtttgctcagtggggccacttcctttctttaatgcttag

SEQ ID NO: 165121 - DNA, 523 bp, Homo sapiens
gttccagagttactgactgagatttctgagcttttttccccttttctgtttggtttcagagtggagagcagcccaaaaatatgcaggtaactgaagccaggaaactgatttgtgttttggtttggccggatcttaaacagaagggaggtggagagatctgagattagaggacggggctttataggagccaagtatggggcctgcacacacaagacacacacgcacacttgcaaacacgccacacgacacatatgcctgcatgtgtatgcacacacatgcacacgtgagctcccaaacacatcgctccttggggttacactaggtttgtttccatctggcttgaggctatttgcaggcgagagtgcagagtctgtaatgaacctcccagattctctgacgaaggggtcccctaggttcccatctgtcaaatggcatggggtgttgaaatgtggggcactggactagatgatctcaaaggtccttttaaaatccttttaaaaacttttctgaaggactgtatgta

SEQ ID NO: 165122 - DNA, 228 bp, Homo sapiens
aatcccaactttgacatccaaggcttcatcaatacagctctgttctttcccacattttttatctttccttaacacagaccacgggcttcggcccaactgaactgctattttctacttctttgctcatgcttttgctccacttaaaaggcttcctggctcccatttcctctggtctaaatcacacccaaaatgaggaaacaaaatacatttgaaagagcaagaacttag

SEQ ID NO: 165123 - DNA, 357 bp, Homo sapiens
ctgagcctggtagcatgtgctgtaatcccaactacttgggaggctgaggtgggaggattacttgagcccaggaggtagaggctgtagtgagccctgattgcaccactgcactcagcctgggtgacagagtgagaccctctctcaaaaacaaaaacaaaaaacaagtataagccaaggtgattaatggcctgctaatagaggtattttgtttggccagctcagtggtttaaaaactattttttaattagaatgcttttaggcaagacatggactcttctgttgccactgacctaccattatctattgcgttacataaagctgcttcacatgtttagttatgttgcctgggcctctgaa

SEQ ID NO: 165124 - DNA, 349 bp, Homo sapiens
gagatattttaggaggtaaaatcagcagaatttggtgggtgttggaacttgagtaaaagcaattaaggactgacttcctctaggctgggtagctggctgaatggtggcactgacttcaagggaaaagaaggcaggaaaagaagcaggtttggagaaaaacattacatgtggtgacatctacaaaagctgactagatttatatactgggctgtgttatcagccccagcttatctcatgtcaatatatagtggtatttaagttctcagccctggctcattcaacccagtggtccctgttaaggttgtcactatggattctcttgtgaatcatttcaagaccataggagctt

SEQ ID NO: 165125 - DNA, 258 bp, Homo sapiens
cattgtctgcgctctgcctcttccagtttcttcaacaggtcatgcactttcctgtttcctatttctggagtgttccccctcactcctgcctgccagttatctttcccatctcatctcaaaggtgacttcctcaaacaggccttccctgagtggccaacctccctttaggcatgctcagagagattcttcttctgaggcttaccacagccataattaagtaagtgatcatctaatgagtattttagtttgccttttttt

SEQ ID NO: 165126 - DNA, 128 bp, Homo sapiens
tttctctttgatcctctatactgtccctggattaaagagaaaagcaagaatctctgtccaagtccaatcagaagaccctgcaggcatccccaacccatcagcagctggtgagaaaagagtgccctgtg

SEQ ID NO: 165127 - DNA, 307 bp, Homo sapiens
atcataagttctgtttgggttagggaactttgatgctcatattcatggttcagccttccctctgtagaagtgctaataatttttactatccctgtgattttatattgagagggctcttaggtatgaaattttcaaaagatttgcctcctgtaattttcttaccctttcttctggcattctcttttaatctaggacttttccactttattttattttaagttgcagggtacatgtgcaggatgtctaggtttgttacataggtaaacgtgtgccatggtgggtttgctgcacctattgacccatcacc

SEQ ID NO: 165128 - DNA, 383 bp, Homo sapiens
tgactgtggcaagaggatccatttatatgatggtcacagagaaaaaataagtttatttcagctttctaattttcatacactttgatgatgagatgtaattacatgtgaaagtccaaggcaaacagaataagcgcacaaactctttgtgtaaaaccacactgaacattaaaaagctctccaaatgataatttatttagaggattcacttatcaagttttcatcaaatcatgcattttacttattaaaagtagtacactgcccacactgccccctaaaaaagtgatgaagtgaagatattattttctatgtacatacattacattgtgtgttcaggtcatgccagtggtgctggtgactatcttgaggaagcctcaaggtgaagc

SEQ ID NO: 165129 - DNA, 477 bp, Homo sapiens
  misc_feature (386)..(386): n is a, c, g, or t
tcagctatggattgacaacagtccagaagaattagacatttagaaagggatcaggaggtgggtttggccaatgggaagctagaaaaaaaaaatttgtagaaagaaagggaacagaaggaactgtccacaatccgaatgactcagtaacccacaggctttaacactattacaaacctaagtgtcaatcaaaatacaaaatacatatagtcccagtataggaagtctgctgactatccacattacatcttttattttattacacagtatttttttttaaaaattttaagagacagggtctctgtcactttggctgactgcatcctcgacctcccaggcacaagccatcctcctgcctcaggcccagctactcgggaggctgaggcagnaaaaccgcttgaacttgggaggcggaggtttgcagtggccgacatcgcaccactgcactccagcctgggtgacagagtgagattccgtctc

SEQ ID NO: 165130 - DNA, 548 bp, Homo sapiens
acaggaatcaatgattcacctacaggacaacaggactcatgataaccattccacaggaagtatgggcgatgcagcctgaggccaggtgtctgaacatcaaagccaggctcttcccacaacctagaaccactcatttagactctccttcccctaaaaccctgaagacacagaaaaggcatcagccaccccataggtggctgtcaaccgtcacggaatgttgatgcctgtcatgagatttcccacactggacttgcaggtacttgcaggtactaggtacttgcaggtaccaggttctctgcaggagtctatgctggaagacgtgcctaagaagccacaggactggcacagggcatcttcccagagtaccaattttttggaagtcttggtaggtagaagagtggttctcaaagtacggactcccgactaccagcatcagcatcacctggcaacttggaagaaatggagattcccaagccccacttcagacttccagaatccgaatctccagaaccagagtccagcaatctatgtttgtaagcacccagatg

SEQ ID NO: 165131 - DNA, 327 bp, Homo sapiens
agagctgtatctaaataaagtgcccctgaagtcttcaacagtgataattgagcacccagtactataaggtgattcaatgatgaaaaacagatatcgcatccaggctcatggatctatagtgtaatcgaaattagagttcaacaaagtgaagtagaagagacacgtggatgcacgtaaaagcaaagacttccctcggaggagacaggatttgtccatgagcacaacagcatggtcagattttcatatatttattttgacaggattttttctagtcattcattcactattcaaaatgatcataaaataaactttactttcttattttta

SEQ ID NO: 165132 - DNA, 420 bp, Homo sapiens
atttatattttcctaaattattagaagattttagaaaaagattctgtgttatgaatgcccaggtgagagttaattactgtatgcattttgacacctatgctgttaaaaagctgttgttgatagctgaaccaagaattggtctttgaccttctgggcacagttaatgagctactaatcttgtagggcatgtttctgttggacctctgcctgggctcattgtcagtatttattgacactcatccatgtatgcatggagggtttaaatgcagtcaagactggtgttctccagccaagctgttgctttcagcattcacaaaaacaaggtagaaaggagacctggacaacaagcacaggcacttggacttttaaaaattattttattttctgttttcccctgatatgataaatagtggtctaaag

SEQ ID NO: 165133 - DNA, 175 bp, Homo sapiens
cctgtccctacagtgatacaaccacccctcaataaccccgggcaccacctggcacccactgggggccaccagggagcccaccaagcccactccgggcttggacagagggcaggcctggaggaaggcacatccaaccccactgaccggcatgcacctggggccaggggcctgctgc

SEQ ID NO: 165134 - DNA, 255 bp, Homo sapiens
cgagtagctggggttacaggtgcctgctaccacacctggctaatttttgtatttttattagagacggagtttcaccgtcttggccaggctggtcttgaacttctgaccttgtgatccacccaccttggcctcccaaagtactgggattacaggcatgagccaccgcacccggcctcatgagtctttctaatgaccatctaggtcaagaaatagaactttgccagccttgccagaagacacttcatggtcctagtc

SEQ ID NO: 165135 - DNA, 422 bp, Homo sapiens
agcattaatccctgaaccacactagctctggcaagggtataaatgagcagtgattactaactgacttaaaacacaataggaattatccccagtgaattccaacatataaagggacactaattcttgccatagaaaatctatttgataagtatgaacaagaattcccaaggttatcaaaaataatttctaatagtttaattctttaaaagaaatggtgtatctcatggacacaggaaggggaacatcacactccggggactgttgttgggtggggggagcggggagggagagcattaggagatatacctaatgctaaatgacaagttaatgggtgcagcacaccaacgtggcacatgtatacatatgtaacaaacctgcacattgtgcaaatgtaccctaaaacttaaagtataataataata

SEQ ID NO: 165136 - DNA, 1888 bp, Homo sapiens
caagtgggaagtagccgagcccgctggtgtcggggaagccacagggcacgcggaggccctgctggatgatgtctggcttcagccctggctcatggttctgggcacctgtgttcttcctaactaggatgtccgggttgagcgccatcctgcgcttcattttgtcccatgggagttggccccgtgggatttccaggctgtgctcctgcggccctgccattggccgctggaatagggtcagtcaggcagttagggaaagtgcatggactttttcattctcctgaggctgtttatttttttactgggcccatgaagcaactttgacataattattcaggacatatcctaaacgccgtcatatcctggattttccaggtaaccaattgctaaactcacaggcatctttgccaatgtatttttaagaatgatatttgctaccctagagttcagagtgtttattgtgtattatttcatacaatacttgtagaagcccagtagaaggattatatccccatgcttacagatgaggacattgaggagacgggtgttggcgtccctgctttccttcagggagcacaggtcaggttgctccctgaagtcagtgatgggtccagcacgttccacacggcaaggggacaggccctctcccagggcggcccttctgccgcctttgctccttctttgagacttaggggcggggcatgggcaggagggagagtgctggattgtagctgaccctctcgggacttgtaaatactgtcaagtgattgggagtcctagacaaacacgagtggccgcctcggggccggcggcgtggccctgtgacagcaagaacttcaggaacaaatgctctctacacccactggccctccagggtcagacccttctagttcctgcctgccccttcagtagcgaagagagaagccgttgctcttagggcagggctgggtttggaaatgacagcatgtgttcaacaacctgaaaaccaagctgaatgtcgcctgagatgtttctttcttccctgaagaggaggcggtgtccatcacaaagagcctcttctgttgagttctgagccatgctgtatcttgacttgaacagctcttattttcacagttcacgtttttgggcctccagagagagacttggagttgaccttcaactgagggaagtgtctgaaggcactgttgtgatttctcttgggagtagaggtgccaggaaggacactggagattcccagaatttaaggctgccacttatttacatgaaatcaaatattttgactctactctggatcacaaaggcagtttgctggagtttaagaaccaacccattaacattaggaagtaagcagtgttgagatcagaataacttaggataggctttgaaattgcttttctggtacaaggttatggttgaaataggaaaacagcacagagaggacagtccatcacggtgagacttgggaaaggcacacagagagctagtcgtctctgttctggcctcgaacagtaatgattatggtctgatgattgccctgtgtatacataactgctctcagagcatttgaatcacctttcttcaaaaggaacccgggccgggcacagtggctcacgcctgtaatcccaacactttgagaggccgaggcgggcggatcacttgaggtcaggagttcaagaccagcctggccaacatggtgaaatcctgtctctattaaaaatacaaaaactagctgggcatggaggcaggggcctgtaatcccagctactcgggaggctgaggcaggagaatcgctggaacccaggaggcggaggttgcagtgagctgagatcacgccactgtactccagcctgagcaacaaagccagactccgtctcacaaaaaaaaaaaaaaa

SEQ ID NO: 165137 - DNA, 242 bp, Homo sapiens
agattcgagtgaaggatggacctgctgcccttccccggagctgtgggtcgggctgaaaattgaatgggctgtggggttgatgtttttctttttttctcatcccccaacctcaattctcatcatgacattttccaaacatacaagttaaaaatgagcataatgaatatctgcaaactcaacttccagaggttttaattttttttttttttttttttttgagatggagtttcactcttgttgcc

SEQ ID NO: 165138 - DNA, 533 bp, Homo sapiens
ggcgccggattctagtgtcttaactgtgaccaccctaaacattttacaaacaattgtcttgtttgaatcctcttcaaaaaatgatttataatcaactataagactttaataaatactatcaaatacaggtttctaataacagaaaaacatacggaactcataaaaaactttaaaatatttacaaatatcaaacagaaccaaagttaacaaaataaactgaactaataaaaaactgaaagaatgtttttaacttttacttagaaagttaaaacttttaacaactaagcaaaacatactcctataaacaaaatttagaacatatttatttctctttgcctggttcctctagaattcagaaactgattatgaatatttttaacttacaacaatatacttatttacatcaatacaacaaaatccattttattttacaacaggacacaattttaaaaactggttattttacaagacttttacttgaaagatgtatttccctttaaaaaatcaaactggattcacaaaaccaataaaag

SEQ ID NO: 165139 - DNA, 462 bp, Homo sapiens
ggcatggtagcaggtgcctgtaatcatagctactcaggaggctgaggcaggagaatcacttgaacccagggggtggaggttgcagtgagccgagattgtgccattgcactccagcctgagcgacagagcaagactctgtcttaaaaaaaaaaaaaagtatgcgagagggggaaaatgtcatgcactttaaaacaatcagatcttaatgagactcactattgcaaggatgacactgaggggatggtgctaaacaatttatgagaaatccaccccttccaacaggcccccacctccaacatggggattacatttcaacatgagatttgaaagggacatctaaactataccattccacccctggccccctgaatctcatggtcttctcacactataaaagacaatgatacctgcccaatagtcacccaaagtcttaactcattccagcattaactgaaaagtctc

SEQ ID NO: 165140 - DNA, 197 bp, Homo sapiens
tgctaggattacaggtgtgagccaccatgcccagcccatatgttgaatttttaaacactgagtactgcagaacccaggaattatttggacatagggtctttacatgggagttaaaatgaggttgttgtgaagggaccctaatccaatttgactaatatctttgtaaaaagggaaatttggagacagacacacgtaga

SEQ ID NO: 165141 - DNA, 469 bp, Homo sapiens
attctattccttttgtttcttcaataaatgatactatacaacagaatattcatatgttaaaaaaaaggaacactgacctatgcccatattatatgcaaaaatagtaaaaatggatcatatacctaaatataaaaccaaaaacaataaaacttctaggaaaaagccttgtctttatttgtctttacattgggtaaagaattattagacaaaagaccaaaaacatattccacaaaagataaaattgataaattgacatcatcaaaattgaaaacatctgctcttcaaaagacaatgttaaagaaatgaaaagccgcagactgaaagtttgcaagagtgacatcagcaagacagcagactaggagacatcagccttcttccacccacaaaaaacaacaaacagacagctatacacaaatacagctctggaagaactcactagcccaatcagcctacagcaataaagggaaaa

SEQ ID NO: 165142 - DNA, 522 bp, Homo sapiens
ggtccaggcacctgccttggagccgtagtcccggtgggcatgggcagtcaggggcttagacagagctctgcgtccctgtgggcggaggggaggaggactgcccccttcttgggccctttgattaggcgggtctggctgcatcagggaggaacgagaggaacttggcttgcctgggagggtgctgcaggtggctggggctccagggggcctccaagcagttctggggaagtggtttctggcatcaaggggtccaggcagggggccttggcagggggcgttgacaggtgtgcagctgtaggggggccgccggccctggcacccgtctcctccgctccgtctaggctgcctggggtgaggagtgtttaccatgctgaccacggtccagggctgagaggcccgcagtggctggagcgaaaggcaggctgaggccccgggagcgagggtctgggactgcccggccgccagcgcagggagtcgccgagtgccgggaagctccgggccggcccgcgggcgccccctgct

SEQ ID NO: 165143 - DNA, 236 bp, Homo sapiens
ggctcattcttccaaactttggctgaaatctcagaggtcccatgacctttccggtgacattagacatgtccttcagttgctccctcaagattcatttctgtaacttacatgtgcaatgccatgaataattgaaaaccgatttaaagttgaccctgtcctctcatctagctcgagagggcagtgctggtggcttgtggtggggaaggcacgtggtcagcgtcttcatacttctcacc

SEQ ID NO: 165144 - DNA, 189 bp, Homo sapiens
acagttgcctattgcctcttaaatgtgtcctagacacagcatgaagttggggcactggtggtgagaggcggaatccaaaaaaattcagaaatgacttggcctcattttggatttcataatgtgaagtattcatgattttgaactggtaatataatctaaatcaagattaccaaaataatttcagaggtt

SEQ ID NO: 165145 - DNA, 436 bp, Homo sapiens
tctctcttcctctttcttttctctctcttcctctttctttctttatctttcctttttctattatctacctattgatctatctatctatgtatgttggtggttctcaccccctgccacacacatacctgggacatttggtagtatcaccagacactgtgattgtcataaccagatctagtgggtagagattggtgatgctggtaaacctcttagaatgcacagaacagcccctcccttcacactcccagcacaaaattatccaggctaaaatgtcaaaagtgccaaggttaaaaaagtctgagctacatccttggcatttcctgtgggtaacttacagaactattatagttatgctatagctgatattttagtactttttactttatgttgttctaaatagtatgatttgattaagtgggttcatatgtctccatag

SEQ ID NO: 165146 - DNA, 456 bp, Homo sapiens
gagacattgctcatagccagcaaaaatggccttggaccacagccttccagccatatttccttttagaagtcctgctcccagcaggcctccataggatccaagatgatgggaagagctatttttcttagtaagttgagaaaatgactcggtgctttttgttttatactgtgactggccactaaattagtagaatgatagaattttggagtctgtaagatttttagatgtcacgtaatgctccttcccaagcagtatagtagtcctctctatgcttctgctgttactatcactactgttactattaataatatgggtgatttttttaaaacagactgcatagtactttatcttattaatcaatatcctcagtaggaggttatgcaaacttgacagacccctcacttgcccctatgatacttctgtgcaaattagagaagggcacccctacttgactta

SEQ ID NO: 165147 - DNA, 464 bp, Homo sapiens
cctgggtgacagagtaagactctgtctctaaaaaaaaaaaaaaaaaaagcaaaatatatatatttcaaagttcagagcatatagctaaggacaaagaagataattaaatgatcttagaaaccaagaaataatgacagactaaaatatttttgaatacattgatttattctattcatttgattagctctattcccattcctctccctttttctctcttctgtattcccctttcccgtgccagaaaccactgtcttttcacatgtttttggtaaacagatttattacctatttttgtgtgacaaactactccaaaacatttattttctcatagttcctgtgagtcaggaatttgggagcagcttagctgggtggttctggctctgggtttctcctgagggtgcaactaagataacagctgaggctgcagttacctgaaggcttgactcagctggaacattttcttc

SEQ ID NO: 165148 - DNA, 431 bp, Homo sapiens
gtgaacgaggcatgcagcttgcttcctgtcatgtctgactctatagtgatacccattactccttgacggtcagccttgatattctggaaaggcaacctcctcagagagagggcactggcctgcccacgtcacacagcagagggtggaaggaaggcagagtccgtcatcaccagcaacccccagggctgcaggcccaggcttccagctcctgctcaggctgtggtgcctgctgtctcttgcgccctcgtctggccactgctcagtactgcactgacctctcagccaggaacccacagcggcaaaccgaacccctgacccagcctggacttggtcttggcatctccggactcagcttcctaaccggcccgtggggcacgggttgcaggggaccaccccccccaagagtgcactcagctcagcactttgctgtt

SEQ ID NO: 165149 - DNA, 502 bp, Homo sapiens
cccaagactgtctaatcagtttccaaatggatgtggcccttctcggtgtctgtggggctcaggaccacagggattagccaggatctcacagcttagtaagagactaaccaggatttgaacccacctgcatggctccaaagtcagccttgatattctggaaaggcaacctcctcagagagagggcactggcctgcccacgtcacacagcagagggtggaaggaaggcagagtccgtcatcaccagcaacccccagggctgcaggcccaggcttccagctcctgctcaggctgtggtgcctgctgtctcttgcgccctcgtctggccactgctcagtactgcactgacctctcagccaggaacccacagcggcaaaccgaacccctgacccagcctggacttggtcttggcatctccggactcagcttcctaaccggcccgtggggcacgggttgcaggggaccaccccccccaagagtgcactcagctcagcactttgctgtt

SEQ ID NO: 165150 - DNA, 307 bp, Homo sapiens
attataggtgtgagccactgtgcccggccaacttttttctttctctgcctcctactatgagagttcccatctttgatggatgactcagaattcaaattacacctagaagcaaacacatcaggcttgagggtagagagggagagaaaagaacaactgtcccatctgtgtttcatcctgagtgggaggttcaaatctaggtattggcagaatgagataaaggaaggagagattgagaaagagtggaagtgggatggaaagttattaagggaagtcattccaggacagttttcacccactcagtagatta

SEQ ID NO: 165151 - DNA, 144 bp, Homo sapiens
gtcctagtatcccctgtgctcaaaaaagccacttccaaatagcccaacagacagaggtcccccaaatttataagcctgttaaccgctcagcaggcaaaaagggtgtagagaggtattatgaacaaaagcactggcaaggtgggc

SEQ ID NO: 165152 - DNA, 430 bp, Homo sapiens
ttcttgtatctccttccagaaatattttaagaatataagaaaagacacatattatttgtctataggaggaggcattctctaaccccacagctgatgttcagctgtcaacatcactgtggtgataaaaaaaatgtgaagcaatttctctattggttcaaaagttccggccaagtgcagtggctcacgcctgtaatcccaacagtttgggaggccgactgaggtcaggagttcgagaccagcctggccaacatggtgaaaccccgtctctactaaaaatacaaaaattagccagacatggtggtgggcgcctgtagtcccagctactcaggaggctgaggctagagaattgcttgaacctgggaggcagaggttgcagtgagccaagatctcaccactgcactccagcttggagcagagcgagactccatcc

SEQ ID NO: 165153 - DNA, 129 bp, Homo sapiens
atttagaaaacaaataactggtgtgtgtgtgagtgtgtgctttcttcgcataagactttgtctttttatccagttagcttctcagaatccccactagccagaactgtgtcacatagtcattccagttgt

SEQ ID NO: 165154 - DNA, 402 bp, Homo sapiens
ctccacgcctgtgcccgctggctgcccacctgcagaagcccactcacacacacgccccacacgccctaaaacaagtcctgtggctccacatcagcacttcccaaaccctgggtccgcagaggtcatctggcgcccttgttcaaacataggtgatgcattccatgctccttggtcaagggctcatactctgaggaataagactccagagagcagtggtcctgaaacctgtttgctcacgcaccccctgtatatctacttgtttgctgtgtgtgtccatgtactattgtaactaacacatcatcctgtactgagagagacaaagtggaaccttaaaggatgagaaaaaaaagctaccaaaaatgcaaataaaagttctaatactgccgggcgcggtggctcacg

SEQ ID NO: 165155 - DNA, 181 bp, Homo sapiens
agtgttaagtgaaaaaaactaagatataaattgtaaatatggtataaactaaattatgtaaaaatatgcatagaaaaatctctgaaatacctttaggattatctctgagtaatgggggttatcattcatttttaatcttttaatgcaaaatttaaaatgttgttactatttttaagtattt

SEQ ID NO: 165156 - DNA, 536 bp, Homo sapiens
caaacaatcaatgaaaataaggaaaaatgttcaaccttacctaattaaaatccaaaaaattaaaatgaggaccattttcaaagcactaaattttaaattctacttctcagaattgattatacacagacttgtgcaagtatagaaagatgtctataaataggttccacaattaactttgcttcaaatcactccaaaaaaggaccaaagcaaaccaaacaaaacctcgggagactttaaatgtatattaataatagggacttaagataaatgtgagagcatcacttgggtacacatatacaataaaggaataggcagtcactggaaaaacagagctgtctgaatcatgctgtttaacaactcttaatggcacagtctctatcccaaattatcataatttactgtaaatcgtgtttcaagacttcttccgtatgaccaccacttaatatctacactgagtggaaagatttctgaattaatttgtcatagtttatttctatttatcagcatccatagtataaaaactttcactatacgct

SEQ ID NO: 165157 - DNA, 462 bp, Homo sapiens
aggttcatggaaaatgttcattatcaaaaacaactatgcatggatttccatttttcaccaaaataaactcacactaactgattataacatgtctgaacaggatctagtttgaggcactaagaagggtaagacatcagtttgaaaaagagcccctatcagggcaatatgagttctgctaaaactgaagcaagaacaaacatcaactttatggttaagcttgggtaaaaagaatggtgaaatcactgatgcttcagcaatagtttatggggataatgtcccaaagaaatcagcagtttacattttaagaagggacaaaatgatgttggagatgatgcccatagtggcagaccacataaattttcaaggaagaaattaatcttgcccatgcccaggaccaacaattttgatagtagagacaaaagccaacaccatagacatctcagttggtttggcttacacgat

SEQ ID NO: 165158 - DNA, 560 bp, Homo sapiens
ggtaagataactaacatttgtcgggtgtccactttgcatcaggcatagctactttatacacactattgcactgaaatcatcccaataacttatgaggtggatgttattgttccaatttgtacagttcaaggaactgtggcagagagaagtaagattgttgcttaagatgacaaggtcaagggtacagtcaggattaggatcctaggttcatttggctccaaagcctgtcatttctccactaaaactaccatgctgaatttttttttttgaaaatatggctggagtgccagcgagggggttttcagctcagtctttccattccagaatttttaagtgttcttgcagttgggtggtagggggtggagggagcaacccagctaaatcctgtgatttctgtgctccacaaataagtcaaacacgaggctctcaactgagaactttgaagtctgaaacctggggccaagaagtcttctgtttttattagtcaaagaagatgtttcaaaaaccagatttatcatgactggatttcagatgtgaaacccaatatacacacagacacg

SEQ ID NO: 165159 - DNA, 501 bp, Homo sapiens
cttctaccttggtccccgtggtcaccccctcagaaaagaagatgcatagtgtgaccccagtggagatttcatggcctctggacctcaaagtccctctggaggaccacagctcaactagggcctaccaagccacagaccccagttcagttgtctctgtaggcggaggctcaaagactgttcgcgcagccacacaggtgtgatcagagccagtggtctgccctgcacagggcgttttgggccagaacttcctatttcactccagcagcagccagggcctgctatgactgagggttggaccctgaaagtgggactttctgtctccctctcttgctgcagaagaagagtcttcctgtatttgtgcaagtaaggagatgtgacttcttggctgggaaactcttgctgatctaactgtgtggtttgcacaacctccaagcctctgcagcagacaggcagggcttgctgtgttgctctgagctagagagggagcttggccatgttctc

SEQ ID NO: 165160 - DNA, 653 bp, Homo sapiens
ctgtttacagtgactcaagaccctcttaggaacttcttcactgaactcaaggaggagatcaggcaagatctgtgctgtgcagatcctttggattgaggctgctgtgcacaggaatatgggtatttcctcttattccttactccactgcacctaatcaataaccaagaaccatgtaaccattgcttagagggacttgaacaggcagatgatgctggtgaattaaaggaagacagcctccaaaaaaaaaaaaaaaaaaaaaaaaaaaaaattttgggggggcctgggccccagaaaaatttttaagaacaccaatccgtgggggcggggggccccattacgagttgaaggtcacaactgggggtcctacaactgtggcgcccaaaggaaacacccggggtcagagaacgaagcgggcggtggagttcccacccccaataaaaaaaaaccgcgccgggcggggagccacccgagggtgttctgaggaaacaaaatccccagaaggggagtccccagaggcgcaaacacggggagtcaataacaagcagggtgtcccaaagaggacctctatattaaaataacgccccggcctggaggtcatcgaaccacaatcacgacgcacacccaacacacgaagtacacacatcaccacacgg

SEQ ID NO: 165161 - DNA, 150 bp, Homo sapiens
cagctgtgcagtataagttatgtgctctttcttttcttcttgacaactattatcaactcattcttaccgaaaaatgacttaataaacttctctcttctagcctcttttaaaagatctatgtagtttccaaaactcttaaacactgtagga

SEQ ID NO: 165162 - DNA, 142 bp, Homo sapiens
taattaggattcccattatacagatgaggaaactgaattttggagaggttaatttgtatcagggtctagcacagtcagagacctcttctgctatacacattgccttcctgagacccagttgtgggcttgctcttaacagtgt

SEQ ID NO: 165163 - DNA, 264 bp, Homo sapiens
tctcatggtgcagtttcaccatgttggccaggctggtctcaaactcctgacctcaagtgatctgcctgcctcgacctcccaaagtgctgggattatagtgtgaactactgtgccctggcctccctcagcagactcttgaggctggtcctgacagagccttagtctttcctttgatctcaaaatggagaagaaaccttgggattatttaatctggctcctcttgtggttatctttgagaaggcaccgtggtcctagactctttgc

SEQ ID NO: 165164 - DNA, 345 bp, Homo sapiens
aacttttaattacatagaatgtttatgctccctatacaagctttctgactcaacatcatcatcgagatgctcagcatcatcacaaacatcatatctgtcctcctgtacctttagtacaaacggctttaaagattaacttgtcattaatcctgttgactgggcacagtggctcacacctgtaatcccagcactttgggagtctgtggcaggggaggattgataccagcctgggcaacatgatgagatcccatctctacaaataatttttagaaattagccgggtgtggtgaatgcacctgtggccccagctactcaggaggctgaggcaggaggatcccttgagcc

SEQ ID NO: 165165 - DNA, 471 bp, Homo sapiens
gatattttagggtgggaaactatttttttggtagtgtcataaacaatatatgacagtatgtatttgtcaaaactcacaaaactttataacaaaaagagttagccttaatgtttgccaattaaaaaattatctaagtgactggtggatctcaggataaaatgcggaatgttgcaaaagactccaagtgtattagaaatgtataaaacaaccataccgcatggagagggagaaggtgggatctacataatgttgcaaatatgtggagtctggaatactaatggcaaaaggaactgtgcagaagaactgcactctggttggtaaaggtttttcacaatgggttatggatccacaattctgaaagcagcatacgtgcatagtgcttttgaacaattaggtacttaaatggtgagtggtgaaagtcaactttctcactgctggagtgggaggctacaagtaaggaagggaagagac

SEQ ID NO: 165166 - DNA, 516 bp, Homo sapiens
cccaccaagggggaaatctacttccccgtccttcaccaccagccctgtgacttgctttgaccgtgagaatgtgacagaagtgttgatgtgacagttccaggcctaggcttcaaggggccttgagcactcctctctctccaaacactgcctccactgggaacacaatcctggactagctgctggaaatgagagactgggtgaagcagggatgaatcattccagctaaggtcatcctagaacagccagctgcgctgacagctgacagcagaggcatgagaaagcctaccccaaatgactcaagaccagaactccccagctaattaaactcagcctaaattgctgatccccaaaatcgtaagctaaacatatggtggttgttttaagccactaagttttggggtggctttatgtagcataattctggtagtaggtaactgtttcagaagacaggaatggttctgataattagaaccacaatgactcccatatttatgtcaccagccaacacttctctcc

SEQ ID NO: 165167 - DNA, 664 bp, Homo sapiens
taactcagtgtgcttgtataactgtgctttcacataattagaaaaattatgtattgcctgttatttttatgatgtttctgaaactttcattcttgtatttaggtaatttttaaaactcttcatataccattgaatttcaggaaattatgtaaagaaaatagagctaatagtaacataatagattaacattaagaataattactttaacataaaacagtatgtaaatatgtttgatatttttataataataatgatattaataaattatgttattacacaatatattttaggtactgtgttaattatcttccatataatgactcaatctttattaacactgttttaatatatgttaataagcccattttgttgatgcaaaaattgaaccgcaagtattttaagccatttgctaaagttaacaaattcactgctgtagtctgaatgtgtccccaaaatttcatgtatttaaacttaatctccaatgcaatagtttcaagagaggaactttaagaggtgattgggtcgttagaacttctctcctttgaatgagttaagtccttcatgataaaaggcttcataaaacatttggccttttggccttttctgtctcttctaccacatgaagatacaatgtttggtttgtccccctctggaggacacatga

SEQ ID NO: 165168 - DNA, 346 bp, Homo sapiens
gcaatacttctgaaaactttagggctcatagttttgttgaagtgatagatgatggctatattctttgttacataacagcaaaacatttttgtttttacatttataaataccaattagaatgactttcagtggattggttttcatttttcacatcatctttaccttcctgttactttgtgtacatatctgtctttcatacttgtccacttacaaactttttcaagtaaattctggtgttacaagcataaaagatgaaagaacgttgtcacatggtcacttgtccttttagcaattatgcgatgattcaactgttctaggtacaactagagggagagtatcccaggca

SEQ ID NO: 165169 - DNA, 504 bp, Homo sapiens
taaattaagaatcttcagatggggagtttatcctgaaatatctaggggagcccactgtaatacagagagtcctcataacaaggagacaagagtgttaatgttagagagaaggctatgtgaggaaggaagcagccagtgaaggagatataatgacatcatgttggtggctctgaagacgaaggaaggagccatgagccaagaaatgcaggtggcttctagaatctgggaagggcaaggaaaccaattctttcctagagccttcagaaggaagcagccctgctgacacctagaggttagcccattgactatgcccggaaaacactcaacataccatctgatcccactttaaattcttgcctactgacttccagtgggctggaaggggtccctatctccgccaacactacaataatgcaatatttcccaccaatttaccctcctactctcctagacagctattttacagcttctgagctttcctcaaatctcccaacttctcttttg

SEQ ID NO: 165170 - DNA, 460 bp, Homo sapiens
caggagcctggagagaatggctcggcacagcagatgcagccgtggtggccatggagctgaccagcctcttgggagtgagctggccacctgagcacggtccactcagcccacacaagcagcagcaccacctcgctgacaggagcttcgtcaatgcctgccgcctcctccttccataacgagggaccacctagcagggactttcacttttatttccacagagaaccttgtggttagaagtccaatgggtctaggctgtgggaatcttcttattaaccacaaacagatgtcaaaaggatctttcctaatactgtagatactgcacttggctcgtgtgggagtccactgtctgtggaaacattactcgtctatttttcaggtctgcagagcccagactgaaaaacacattaaaaaaatggttttgtgaaaaataacaattcagacaccctggagcctaaggaaa

SEQ ID NO: 165171 - DNA, 236 bp, Homo sapiens
cttttgggggaggtttttgattactaagtcaatctcctttctcattataggtctgttcagattttctatttcttcatgatccagtcttgataggctgtatttttagtaatttgtcaatttcttctaggctatcaaatttgttggtatataattgtttatagtagtctcttataaacctttgtatctctttaagttgcaatgtctcttttatttataattttgagtcttctcttttt

SEQ ID NO: 165172 - DNA, 287 bp, Homo sapiens
tgttggacaatcactgcagtatgtgactttatagttttatgctccagaaaaaaaaaattctgtttggttggtgttaaagatacttgcatggaaaaggcccacctatcaaagtttgaagcagtgaaatagaatataacaaggacgtttacatttcttttggcacaaacattttcacacctgtctactcaggcatttattggccttaccattatctgcttgactgcaaaaaaggttttctgtgtacctcgctttcccattaattagaaataaaagtaacagatatctgc

SEQ ID NO: 165173 - DNA, 382 bp, Homo sapiens
cccaattgttttaaaagttagatagctattctccagaattcctgtacacaactgctcccactagttgagctatccactttcaagaatcatttatatttgtacaatgacctatttaagtacttgtatttttttaaactaataatgtatatatttataatgaatttatcacagtaaaatactatataaatggtaacatattagtctgaaacctgtctatagaagttgaatactttggaatggcacaataaatatgagcagcaaaaaactgtcaaactaattaatcaattataaaagattcaaaatgtattaaaaatgtacaattctgcacttacattacttcacaattgtttttaagcactggttccttaaatcattcaaaatg

SEQ ID NO: 165174 - DNA, 140 bp, Homo sapiens
gcccttgctaggctccagcaggtattagaaactgtcacaattgtccggcaggtaacagcataatcacattttgaatcaaaagtgttgttcaagctgaaatcctagtattcaccctcaattcctctgtttccctcacccgt

SEQ ID NO: 165175 - DNA, 350 bp, Homo sapiens
gatcaattgtcaggatttgcggtgaatatctattcaccttttctagtatacactgttatcattaccctccaatgacggttttctaaaccacctggtgatctaagagaagaccttcactctgctgtcaagtccttccatttttctaggaaacagagcactaaatacattatcttttttggccttggttggtgacgatttgaatgctactaacaaagcccttttgtccatactcagactccttgagtatatgacgggccagttatagaagcaggaagacatggttgccccaccatggtaacagcagttcaaagaccaactgcctccaactttcaaaacttagcatatttggc

SEQ ID NO: 165176 - DNA, 184 bp, Homo sapiens
aacagaaagcctcctcatcactagagcaactgcttcctggtcccttaagtgcttctaatgtttttcaataaaaaaattaaaaaccagtatatattaattttttttttgagataagagtctcactctgtctcccaggctgaagtgcagtggcgtgatctcagctcactgcaaccttcgcctccca

SEQ ID NO: 165177 - DNA, 224 bp, Homo sapiens
tttttgtccacagttgattttgcactcctgttctctgattcactgtgattgattttacagtttagctctcaaggtgaaatttatcttcctgccactcaaaatcctcaattcttatagcacctatttcagacatcactagttttcacataattctgagaaagaatgagcaattctaaagttcagtcaagactgattatgtcttttgagtatatttataaatatga

SEQ ID NO: 165178 - DNA, 262 bp, Homo sapiens
  misc_feature (14)..(14): n is a, c, g, or t
tcaaggacacaccntacacccctgtccccatactagttattatcgaaaccatcagcctcccaaagtgctgggattacaggtgtaagccaccacgccaggcctgttctgagatatcttaaatgatatagatttttataactggggagaacaaaggaccaataccagtcatgtgcttgagaactaccatatcagtgttgatgactcatttgctttcacccaaacgccctcttgagtcctttaaacttttttcccttcaacttta

SEQ ID NO: 165179 - DNA, 793 bp, Homo sapiens
attcctgggtcagagacaaagggtagttgattactcatggcacaataagcaacatgtacttcttgttggtttgtatcctttttctgagtcaacctaaattccatgggggtgacactggtgggcctctacattagcctgctcatgcagtacattgcatgacatacaatgggcattaggcttagggaatctactttaatagtggcagaaacaagcctgatattggtccaggaggagtcattgccttatctctccaggtggttatctgcaaatacaactctgagaaatggctcaggtaagaacatcacggtcttgcattggtggcatacgcagcaaggatgctcagggctgatgaagaagtgcctcttccaacacagggatatttttgaaatgaatttattacaatggagatgaataaagcaaacatttactcatcatatgcctgagaaaatgtcatgtcccaatgccaggatataagttgtctaagttaattttaataatcctgtgaggttatggttatttttgtcctattgcagatgatgaactgagggccagagagattagggagctggacagagttcaaccagccaggaagtgagctaggactggtggagcagagattctatcctggtttatctggccccaaagcagatcaccttgaccgttattgaatatttgacaggtgggacctagaggagggcaatatgttgaccaagggcacatagagcataggagacagagctgagacttgaatgcaggtctcttgactccaagccatgggtcttcatctcctata

SEQ ID NO: 165180 - DNA, 559 bp, Homo sapiens
ggtctcagatctgctggctgcttctggctggttcagtcatgggaggctttggtgggaaaatggatgatgggaggcagggaaaagctaaggtatttctcctcccctctctctgttcctagaagcgtctctgccaggtaaatccagcccctgggctccaggaaccctgcctcctcccatggtccctctggcctataggcagctgcagcttcctgctgctcccattctatggatgacctcactgctacctatgtggcttctcagctttaccatcttctgtataagcagcccctggattaaatccctgcagttcaaatacttaagagtagttcccattttctgggttggacctaacagacaacagcaggctaagttgtcatataactaaaatgtagccgcttgttcaacttgatgccaagagggtttccagaagttccttactggtcctctctgtgggacaaactcttcatttgacccctggtttagcagcagtcaactctagaagtcttgtaacagggcttaccttcaggagtacagaaagccaaagacaaccccttactaa

SEQ ID NO: 165181 - DNA, 315 bp, Homo sapiens
catgttgcaatgtctggggacagtttagtgtcacaaccaggtgaatcgtgctactagcatctggggtcagagaacagagatgctgttaaaatcccatgatgcacagaacagacccgaacaataaagaacaatctgtccagaatgtcaacagtgccaacgttgagaaactctgttttagattaactgccaaaaaagtacagaagataagcacagaagtaattacatatacaacataacttgaacagtaaattacaaataatgcttttttttttttttgagacagagtctcaatctgtcgcccaggctggagtgcag

SEQ ID NO: 165182 - DNA, 177 bp, Homo sapiens
ctcagaggggccaggaccattgagagggaaggcataggggatagaagttcacttcactgcatgtgttcacatgcctggcaatgtgctacgcacttttcatacaacattctcaatctcatcttcacaaacctctttgggcatctgtattaacaaaaacctattttaaagatacgaaaa

SEQ ID NO: 165183 - DNA, 220 bp, Homo sapiens
ctggtcttgaactcctgacctcaaatgatctgccggcctcagtcccccaaagtgctgggattacaggtgtgaggcatcacgcctggcctcttggcgtcttttggccctttggcagtgtccccaaccaggcagtctgctctgccactaccacacaggcatagctgaggacaaaagatacccagtccaggccaggcgcggcgtggtggctcatgcctgtaat

SEQ ID NO: 165184 - DNA, 697 bp, Homo sapiens
tcaaattttaccttgtgatgtatagataataaatacatttacatatatttcacttcactttagcaattttgtgagttagacaaaaattagtttttttccattttacatatgccacttaatgatgttaaaatatttgctaaagccacatagctagttaaaggaagaaccaggactggaaccctgaaggaaagatagccaatctccttctctacaaggatgaagccagatggatcatgtatctattaccgcaacactgccacataacaaacaactacaaaagctcaacagcatacagcaaagcctcatctttgctcatgtgtgtatgggacatatcaatggttctgctgatctgggcccagctcagctgaatgcagcttcacgggctcaaataccaaaaaaaacagttcttttttaaccagaagagtcatatttgtggttattctaatagttagttaaggatatagagtcaaattttatctcagtggctgcaaataagataatcaactgtgcagccaggcacggtggctcacacctgtaatcccagcactttgggaggctgaggtgggcggattgcttcaggttaagagttcaagaccagcctggccaacataaggagaacctgcctcatcgtacttaaaaaaagattatgtcctgttttacagtgcggttaactttatatctggtaattaatctaaat

SEQ ID NO: 165185 - DNA, 395 bp, Homo sapiens
tgaacaaagtagccccaatgaggaggttttttcatatcaggcacaatcttctgcacatatttgtatggtgtaaaatacttccgctatacccctgccttaatatctaccccatctagataccagtgttagaaatcccactattgagatgagagtccttcagatttaatatagcttttgtaacttagtattttttcccccaaatgcaagattctaggaaagtctgagctattcacactagccctgtgattttctttcttttattacttttctttatgattagaggtagtttatagaaatgaataccacctggatgggtcaagagataggagatgagacaaaagagaacatgaaacacgagaaaaactatttcacaaccttgggtacaactagttgct

SEQ ID NO: 165186 - DNA, 334 bp, Homo sapiens
atgccaaagcgtagtacccaagcaccttgtgatgtcccaagccacagctgcggctctaagtggcttcctgcgagaccgattgccagaccacctggtttggtgagatcagagtccctttattaggggcatggtgctggtgtctacggagcagtgattttttggagaacacagataacattacaccttccagtgtgcattgacaatgttacatggctcttctgcaggggaaccagggcgtggaggctgagttggcaagcaggaggtgtgcccctgggatgggctgggccagaccgggagctttctgggagttgggttgggtactacgctttggccc

SEQ ID NO: 165187 - DNA, 283 bp, Homo sapiens
ggctgccgtctcacgactgacggctttatataggattcacgaatactcaggaattttccctagggaagttcattctcaacctcaccattctgttctggcagggcatgttaggatcttatgtctttgtaaagctttagaatctctcatggaaataatagcagttttatagttgagaataaacagtcgggcgccgcggctcacgcatgtaatggcagcactttgggaggcagaggcaggcagatcacttgaggtcaggagtttgagaccaacctgacaacagaaa

SEQ ID NO: 165188 - DNA, 440 bp, Homo sapiens
attcttactgagtggctgtagtcaaagcatgatgcactctgatttttttctctttaaaaaggtcaagaaattttggccaataaatccatttaaaacaacaaaaacgaaatggagaggaacagctgaaaatagcaccagtaacaactgcaaacagtattctctataaataagctatttacccacacacaaaaaccgaagtcaggtcaacacggttggccttttcgtaattaacatatagttgagacaagtttctcctgagaaaagattttgcttagcaagcaatagatctgagtgcagaagagtttctaagttttatacgaaaaaagtgcaacaatacgccctttaaagcccaaatacttccaaatgatcaaagagtcaaagatgattaatgctattcaagaaaaaccctcactgattctttgcaagttctacatgcatca

SEQ ID NO: 165189 - DNA, 720 bp, Homo sapiens
cttcaagcccttcatcagtttaggagtatgttttgtgttttccctatagtttttttctttctgccaaatgttacctcccactagtattttaagtcaaaatttaattttattgtcctttaagactggggttttttgggccaatatttaactattgtaaagtatctctttgtaagatcttctgctaaaataatgcattctaagcatccggattgcgattttttttttaacatagagcattttagaaggtacagtaagctctacaaaacattttctttggattggttacattttaggaagatgaagtctgttttcctgatttttgtttaatcgctttatttctgagtgtctttattgttactgtaaactgacaattatttttactagtgagtctaatccaagattaatagagatcgtgacttattttaaaggaaacatattttttaaatctaaggtcttagtcccaagtcacacaaatcattattagaatttataactctctaaggcttcaactgtttcttcacttccttatatatttggttgctttactatgaacacattaattgattcttatacaaggagtctttatcttaataatctgcttaaaataattttgataatgtgtattttgcataagaacaatgaagaaaatcagaagttgaaaagttgaatctttaatttacaaagacttattttctcattagaataataaaggagtgtgta

SEQ ID NO: 165190 - DNA, 246 bp, Homo sapiens
agagattatttttcagacattcccagtgtcaccaaaatgagggcaacctgaccctggatgatggggtatctaaaattacattcctgaaacccattaacggtcaaacagagaggagagtttatttggcagccaggtttttaactttgttgctctagctgatgaaaaggtttgttgtttgaggtcagcaattacagtttgaggtttaggagtcctttggttttaacatgagcagagagataagtgact

SEQ ID NO: 165191 - DNA, 321 bp, Homo sapiens
attgtttaagagattagctattactgactcttgttaactctacattagatacaatacatatttctcaatcatgaaagagaagagatggaatgcatggaacacaagagtagttttcttgaacacaaagctatggatcaaattggagagatcatgtgatgtggtggaaaagagcacagcggggaggaggccgaattttcactcctaagtatgcccacagttgtgtaacctgcaagtcacttagcttgctgcagactcagtatactcatcataaaatgagaatcttgttttagacaaatctaagatctcttctttctctgccat

SEQ ID NO: 165192 - DNA, 522 bp, Homo sapiens
ctgagtagctgagactacaggcacatgccaccacacctgggtaaatttttaaattttttttttagcgatagggtctcactcattgcccaggctggtcttaaactcctgggctcaagcgatcctcccgcctcagcctcccaaaatgcttggactacaggtatgcaccaccgcgcccagcctcctttctggttttctaataaagccttttgttcacctccttcaaacacttccccatgctcttcaggtctcagctcaaacaggccaggcccggtcccctgggtcctctctgtcctccgtctcctggttccctgtacctctccaaaagcccccacgaccaaaagaagtaaagatgtagggccgggcgcggtggcctacacctgtatttcccagcactctgggaggctgaggtaagtggatcacctgaggtcacgagaaccgattgaaccccagaggcagaggttgcagtgagccgagattgcgccactgtactccagcctgggcgacacagagagactcaacctc

SEQ ID NO: 165193 - DNA, 891 bp, Homo sapiens
aggatgtaaatgccactgcttttgtaaaggccgggcttatttcaacatatttaacccttcactggacaaagtgttttgaatgctgatcctggcattttcagccaaccaggccaatccgaggacgtagacaggacagcatagaccagtgctgggggctgcgggacaaatgagtggacttttccatcatttgcctgcaattcctgaacaaggaaacaaccacccccagagagcagatggggatttcccactggatgacgaggacaggtcaccccagtgcccaccacccgacagggtgtctgggaaaagacataccatggcaagttacccaaactcactgagctgctgcctacccgtctggaaaatgggaacacggtccctagccacggaagtgcccaggacacacaactcaggcagaggtcgtttgtgaatggccttgtgccggcttaatacttaggactgaggcacagttctaagacaggtgggagatggtggcgaatgacatgggacacgtgggctgaggtgaaagttctgcttcttcctcccagacttacattccactgctagaaacattcaatcagaaaagcctggccaaaggctgggcatggtggctcacacctgtaatcctggcactttgggaagccgaggcgggtggatcatgtgaggtcaggggttcgagaccagcctggccaacatggtgaaaccatatctctactaaaaatacaaaaaattggctgggtacggtggctcacgcctataatcccagcactttgggagactgaagtgggcagatcacctgaggtcaggagttcgagaccagcctgaccaacgtggagaaacctcgtctctactaaaaacacaaaatgagctgggcatggtggcacatgcctgtaa

SEQ ID NO: 165194 - DNA, 544 bp, Homo sapiens
acaaaactcctttataaagcctgacatcatctggtactctttcagactaacttcatatattgccctccagatcagccatacagtccatttttcagtcattggttctcatattccatttcacccacgcgtttactcaacaaatctctgttgagtcccttttatataacaggacattgaagatacagcattgaccacaatatataaaaattcctactgtcatagagcttgcattctactgaggagagataataaataaatatgtaaaacacttagtaaatgaaatgaagacaaatgcagtggagaataaaacaactgggaaggggaatggggagtgccaggatgtgaggggcaaggttcacttttaaataaggttgttagaaaagacataatccagaaggggacaattgagatatgaagtaggggagggaataaaccatgtagatgcctgggcaaataacattctaatgaagagaattagtgcaaaggccttgggcagaagcctgagtgcgcatttgagaaatagcaagaaggctagtgtggctgg

SEQ ID NO: 165195 - DNA, 535 bp, Homo sapiens
aagatatgtgggatgatgacacttcatagatgaagatcctgagtttagagatagagaacaacatgttcacagccgcacagcgagagaggcctggaaatgaaggtgctggcacccttgactcttaaagggagccattcattttgcttcaaagcatttcacaagcccaaggtactcggaggtaaatgtaaacactgtccacctcctgggaagggaacagaagatgagagagggaaggctggaaaggtgtgttacctgttttatatcaaccatccaaccaaccaaccaaccagtacttattaactatgtcttggttttccaagtaagtacaaagacgaatagttcacactgattaaatgctgaatggtttggagtacctccacatgtcaaacaactctttggggaagggactgttagttttcttggtacagacagggaaatggaagcccagagaggttaagaaacttgaccaagattaggcagattgacctcagaactcggcttttaaccagaagtacagacacactctttgctatta

SEQ ID NO: 165196 - DNA, 201 bp, Homo sapiens
gcccggcagggttcattgacgtgggcgggaagactgggaagacaatgctgataatacacctgtagctcaagcacttcactgggctcagagattgacaggcgtcatttcttcctgctaaggccttcagaagtaggcatattattattattattatccccataggacaggtgagaaaatcgaggcacagaacaattaaaggca

SEQ ID NO: 165197 - DNA, 262 bp, Homo sapiens
cggcatcccaaagtgctgggattacaggtgtgagtcactacgcttatcctgggttctagcttctggctgctatatagtaactgcaaaaggactgtttttcctaagcctttgacccagaggtttggttgtgctcagtctttatggggacagaggagtagtctctcttcccattagtctgagtactgagtgattaggggacatttttgttcatctcaatatctttattccttttcctctcctcttcatcctgactttccctcta

SEQ ID NO: 165198 - DNA, 297 bp, Homo sapiens
taaaagtgtgtgggtatcaagagtaaccagcaggttggataaagaggggtattgtctcacaaactgaaatatctgcattgcgattgatcctatcaaactaaatctaggctctgggaatgcacaaaagaccttagggtgtttgggagtatcactcgataattcggagccctcaccctgcggaaaaggtctctcctgacctcaccaaacatttctggacattagaaacaagtgtcacaaacacaattgtttccttgaagaacaaccatggccaggcacagtggctcacacctgtaatcc

SEQ ID NO: 165199 - DNA, 262 bp, Homo sapiens
ttagtttataggagacactgtatgtggtagtttctttcaatgtcatgtccctgcacactgccccttcttacattgacacagggaaaatattaaatttcactccttatgttgtaacacattcaaaaacaagtggatattaaaaattgaaatctgtaagttgaagaattcccccccatcttccccactacatatgtaaaattatctagacataaaagtacttttggctgggcgcagtggctcacgtctgtaatcccagcacttt

SEQ ID NO: 165200 - DNA, 373 bp, Homo sapiens
ccacctcggcctcccaaagtgcagggattacaggcatgagccaccgcgcccggcactagaatataggtttgtgggactgttccagtaaagggggagaaattgacacatgagaatgaggggatgacagtattaatgaagtctttggataagggaagatggaagccaaaaaagtcacagggcgacgttaagagcagaagtatttcatccaccacactataagggaaggaaggcaaagaatgagggtggacaagcaggagattagtagattaggttatgggaaaataaggaaatttacttacttatttatgtatttatttattaatgagatggatcaccttctgttccccaggctggagtgcagtgtgcgatctcg

SEQ ID NO: 165201 - DNA, 406 bp, Homo sapiens
agcaaattcttccgttctttgcttgattagggccaggactcaggtggagaagcaagccactgagagtgcaaaatttaaggaactcactctccaggtggtggaaagcatctgacttgcctcaccctattcctggactggcctaatatataaaataaagcaacagaggagactagtggccagccatcaggtagcttgtactctgtaagaagaacaaggcaggggacaggtacagtggctcacgcctataatcccagcactttgggaggctgaggccggcagatcacttgaggccatgggattccttgagtccaggggcagatcacttgaggataggagtttgagactagcctgcccaaaatggcaaaaatctgtctttactaaaaattagccaggcatggtgatgcac

SEQ ID NO: 165202 - DNA, 168 bp, Homo sapiens
ctgagtcatatcttaccactggagaaactgaaaggaaaagatcccattacatatgagatggaaattaaaagtggtttaagaagattctgatttctcatttaaaaagccccaaagagtaggcgtagtgactcacgcctataatcccagaactttagggggtcaaggcag

SEQ ID NO: 165203 - DNA, 281 bp, Homo sapiens
cagcaggggccaggtcggggagtgggtgcagagagccttggagaggccagagaggggtgattcggtgcccatctagggcttcctttttggttagcgatgcttcagggcacctgggagacatgaggagctagaacctgtgttgcagttcccagctctgcccctgctccctgggtgtcccaaaccctgctcctttccaagaaatgttgggttctcatcttcaggatggtgggtgctaatagggaggctgaggtgggtggatcacctgaggtcaggagtttgag

SEQ ID NO: 165204 - DNA, 299 bp, Homo sapiens
tacaggacaagcgctaatggcagaagagggttggagaggggaagacagttgttagtgggaagggaagtgagaatgacctagagttgagtccacccgaaaagaggcttccaggtagctggcaaaagtgggcctgggtgttgggtggctctgcagggaggtgatggcagtgcacggccagtgtgggggcgacctggcagattctatgaacttcatgtgccccgccccttgccgcagcgtgtacacttctctgtctatctggagaagcctcagtcataggcaggagacggcgtgatggagca

SEQ ID NO: 165205 - DNA, 564 bp, Homo sapiens
ggcccgggaggattcagggcttcaggttagcacagtattgaaatagaagcccaggtatcccctgctcccggcggaaaccctctggccactccacgctaccctcaggctgagcctcccagcggtgtccaaggctctcctgggctgggtgctctgtccaccgcggactctcctcccttcaccaggagacaccgcatcccagcaatgccacgctaatgtcggtgtcctgtccacacggcgacagcaacgttgctccccagatccgtcctgacgctgtcggctttgtgtgtcctccctgtgctccctgtccctgcctggccagccccggcctcaacaggcgctcatccgcaccgtccccgcctgacgcctcgtctgagcccggtggagtcctcaggaacacccctggtggccgcgacatgcggctctcagcaccctggcctgggtctcggcgcggttccaggagtggcccggaaggtctgcaggccccaggagccggacgcggatggcgccgcatcgcagcagacccggcctgaaggcgcccggggacccccgcccggaggcggccgc

SEQ ID NO: 165206 - DNA, 177 bp, Homo sapiens
ttagttgtcatgttttcagtctctctggtatatgagtttgtcagtcttgccttgctttttatgaccttgacatttttgaagaatactggctagatatcccacagaatgtctcccaacttaggtttgtctgatgctattctcgtgactagactggacaaatgagtttttgcaaagaat

SEQ ID NO: 165207 - DNA, 352 bp, Homo sapiens
gtcagaatgatctgtacaaaatgctatttcacttgtattaaaatcccacatttatgatagcctatgaatccccatgtgatttgcacttgccctcctatctctctgacttcctctcactactgtcctcttgctcactctgctccagcccttttccaagaacacaccaggccccctcctgcctttaacattagagtatttggtttgtgttccttctacctggaacactctcccagcagataaccacctggcctcactacagcagctccttcagatctttgctccaaaatcaccttagtgggtcaaccccaaacatcgtattttaacagatgataatgcccttcactcgaaaccc

SEQ ID NO: 165208 - DNA, 327 bp, Homo sapiens
tccttttatatcatgcttttaaaccagatagtgctttagaaataaaatagagttttggctcacgcctgtattctcagcactttgggaggccgaggtgggcagatcacctgagctcaggggttcaaaaccagccggggcaacatggtgaaatcctgtctctacaaaaaatacagaaattatctgggtgcggtggcgcatgcctgtagtcccagctactcaggaggctgaggtgggaggattgcctgagcctgggagatcaagattgcagagagctgtgattgcaccactgcactccagcctgggtgacagcgtaagacctagactctg

SEQ ID NO: 165209 - DNA, 490 bp, Homo sapiens
ctgacaattatttgtgaaaggaacaaacattcctcttggaagggcaagccattgtgttactggaaatttgcagtatttgtcataataaagagagttttacagcaagaatgaataattagggcattataaaggcaaccaaaatagctggcctacctatgatgatccattctaacctcccatattgctctacaaatacagcagtgaattaacgcatttatgcccggtgttccgttattggaatgctaagcttgtgggagttctttatatcctactgcttaaggtcattgccagtgtcttctttttcacacacaaaaaaactgcaacctctggcataaatggattaagggttctagtctcaacctgcctcagaagtgatgtatgaatctggtctcatgtcttttaacctacttagcactcaagttttcttatttgttaaatacctataagtatagctatctacctatatctcatggagaaagggataagataa

SEQ ID NO: 165210 - DNA, 652 bp, Homo sapiens
tagctgtcttctcaactcaaccaacagactgggggttaggatatttattcatctttgtaattcctaatttaaatagagtagaagttcagatacaatggtgaacacattgtaagtgatgaataaatgattgcttgtatgcatgtgtatttttcatgttatattaagaaatgtgtgtgtacacacacacacacacacacacacatacacagtaaagcgtataaaccttgggtatagagtttaataatttttatatttggatactccatgtgacagccactcaataattccaacttcttagaggtttcctcatgctcctttctagccaataccttctccctgccactagaggtaacttcttttttgattttcatggaatgaattagattagttttgctggtcctgaactccatgtggactctataaatggagtcagatagcatttactgttttttgtctaactcaacataatgtttttgagatttatatatgctgttacatgtatcagtagttcattcttttgcattctggtgtggaattccattgcacaactatgccataatttatttatccattctcttcttcatgagcacaaaagctattcagttttcaattattaggaataaattactaccaatagttttgtacctattat

SEQ ID NO: 165211 - DNA, 489 bp, Homo sapiens
agttctatatttacagtttcctcttccattgtgtattagcttattagctccacttatcagatgaggaaggtaaagctcagatgttttagtgacttggttagtagataatgtgccactgaccagagccagtttgtctggctcagggctacatgcaaagtgtggctcagcatcacctgggagcttgctagaaatgcaaatttcttgggcctacctacggagtcagcatctctcaggatgaaacccaggaatctgctgtaggaagttctccaggtaatttgtgggcacaccaaacttcaagtagcactgtttgaactatgattcagagagctctcatcaatgtgccatactgccatctcagccccaacttcaaactaagacatcctcctggacaataggataaggctgaccactgtgggacacaatccggatcagcctctctcctcttcttccctttttcctgcccccacataaccatacttcagtgaacat

SEQ ID NO: 165212 - DNA, 275 bp, Homo sapiens
ggattaacaggaaacagctgcaaatataccgttaaagaaagatacgcaggggaaaatgctttgacattagaaaggttttgtttgtttgttgttgttttaaagacaaggcccttggagatcagcctttccataaatcaatgaataaggaagaaaggatttccatgaagatagtgccaggcacaaagtagatgctcaataaatacctttgagcgattggatagggagaggtggttgccttcgtttttaataagggagacataaaccaagataaacag

SEQ ID NO: 165213 - DNA, 111 bp, Homo sapiens
gtccgtctctctctctgtgtgtgtatgcatatatttttctccctacctcactaaaatgaaaaattcctgaggataagaaacaccttatttttaacacctgttttatagata

SEQ ID NO: 165214 - DNA, 358 bp, Homo sapiens
cctttactgtatataacctaatgttgataagtttaaaaagattaacaatttatagtgtattatccagttacaatgaaacctaattaaaaattagtgattgtaatctaggaaagcgaagctcttttaaatcatccattactcaaagaggaaatctctaaaatgtaaattctgtgaaaagggagtttagttttacacactgttttgttcccagcatctagacgagtgactggcaattagtaaatggttaacaactattattataagaaatgccccaggggacagagaaagaaatgataaggaaatatgcaacgatttttcatgagaaataaatgatgaacaggtttttcatgaaagatgt

SEQ ID NO: 165215 - DNA, 332 bp, Homo sapiens
cagggtcttgctatgttgcccaggctggccaccttgatctcccggcctcaaacaatcttcccatctcagcctcctgagttgttgggattacaggtgcatgccaccaagcctgacaaggatgtagtcaatgccacagttttacacaaacaaagaaaatacacaaccttggaacttaacctatgacagcactgactgcagtaagatccgactcataaaaaataagcattgagattagcttctcttgacacaatggcactaagaaaaaactgtcatgttttgaaacatttattttcagttgctcgggggaagaaaaatggaagtcccacacttca

SEQ ID NO: 165216 - DNA, 564 bp, Homo sapiens
tctctttccacaggccaaggcaagagagaagaaacttcacctaggtgctgagcctagtgatatgttacaaagcttcctattgacagaacccccccccccccaccaaaaaagactcacatcacctgggtgcagtacccagttatgtgtcacaatgcaccataagtgcagggccaaggcaatagaaggaagtcacatcacttacatgatgaatctagataaaagccgcaatgctctgtaggcagagttcaggccaagatttcacatcagctgggtgctggtcccagtgatatgtaaaagtgccctttgtcgcactgccaaagaaggtgttatacattgcttaggtgcttggtccccgtatgtcacaatttcaactgtgctctaggcctagaaaggagagtccaaacactcagatgctgggcaaagtcatacttcccaatcacacacttgaaaatgttcagaaaaaagtttcctagtgccacacaagtcctggcttcgggtatgagagtcaacacctcctatgagttgggtcgaagcacaggagtcacagtcccctgtggaaagatc

SEQ ID NO: 165217 - DNA, 558 bp, Homo sapiens
ctagagaatctttttttctgtaacaataaaatagtccaggtgtggtggctcatgtctataatcccaacactttgggaggtcaaggtggaaggattgcttgaggccaggagttcataaccagcctggacaacataatgtggtcaaattagaattctttaattcagatttggctggctcataactttgcctttattggtgatatatttagttcatttatatactgtcttgaacaaaaaagagctaccctttctcagatttttatttatgttcattttaaatttagatatagggtcttgttatgttgcccaggctggtgttgaacacctgggctcaagtgctcctcctgcctcagcttcctttaatagttgtgattatcggccacaccccgacctctcagaattttttaaaggtggattcactaatgtatgtatatatatgttgggagtacttgtttagtttaaaaattgtcattacctgaagcttaatatcccgtacaaaataagcaatttcagtcatgggtttttaaacttgttttagtttttgttcaaactaaatctc

SEQ ID NO: 165218 - DNA, 537 bp, Homo sapiens
gattgtgtcttctgaaatacagagtttcaacccctcattttatttccaaacaatcacttttatgttactctctagagaatgaggagggtcggatcttagatcatggggcatgctatagctgagaacggaaaaaggggagcagaattacttaaagacttcatctcttcaatgcagaggatagtaattgatattacttatcaaagtatctcttttctagctatgcaacatgaagtttcaagcaatttattattgtcattgatgtctcaattgtgtacataatccccttttcctgtcatttacgatactaaaatatactttagtaaaatatagtacatattttaggtttttatcgtattgttttcatggctaagagatttaacaatttcatcttttattataaatgttagaaggtttatgtgaaaatagtgaataatcagtaaataatctagcttctttttctaattgcaatgtttttcttaatatgacaatgtactgaaagctttgttgattaaaagtggaatgtaacacgttcatagt

SEQ ID NO: 165219 - DNA, 267 bp, Homo sapiens
aaccaccacccatttccccacctccaacactaccgcccacggctgggcgagaagttgggaacttcgggaccacgctccaggcgcgcgcagagagtcacttgcttctcctttaactttgggagccagggtcgcagtctagggcaggaggatcgtcctgggagccaaccaacaaggccgtccaggtcctggacttcccggaatagagtaacggctatgggatgggaaagaaatagggggatacacgttccgcctcccttctcccaaaag

SEQ ID NO: 165220 - DNA, 495 bp, Homo sapiens
attttacgtggcgccacagcgtttgttttcaaagtttgaacgtgaatgtagcaagcataattttattaatgaaaatattctttagacaactgttaatattgacggaagaagagaaacagagacacggaagctaaagagttgggaatcctaaaggtcaaaggatgtttctcagttactctgatgtcgtgtgttttctttcagttggtacaaaatcgtgagtagtttaattatatcctgcagtcaaaatggtggctgtggtgggaggtgccgcctgtgacagggccatcttgggtgctggtaaacttgcacctagtcccttttcttccttgcgagataaagttgaggtggtgctgggattatgagttcagagtttaaagacccatcctaaaaatattgttggaaaaactttatgtctcaaaatccatgtattcccattttgttgatgaaaagctagaggtaactcattttgccttaagtactcgcagcatatttaga

SEQ ID NO: 165221 - DNA, 324 bp, Homo sapiens
agaacctacctgagttcacatttctttgtgcttcagaaaaagcatcacattttatttctttactggatttcaagttccttgtgggaacggatgtgggtatcatatcattatgaccagaacattgctcgtataaatgtcagaggaattccaaattgcaagttgatgatgagagccaagctcagctgttatttctcaaagaggcaaagaatctaactgtgattatgttccctggaaatttctttttattgatccaggaatttttagatgtagtcaggggacagaagcatatgctgacatattcatcaagtcagggtggcctataga

SEQ ID NO: 165222 - DNA, 495 bp, Homo sapiens
agcagttggctctgacgggctctaaaatcccttctagagtggaactgttaacagtctttgaaatgccaaatcaaaatataggatgtaaacactcatttttacaactgaccagtgactaattaggaatctttaaaaggaatacaacattggctttgtcctttctgctatattctgtcttccctgagagggtaagtcattatttttgagttaattaatgcactggcaactttgctattctcttaaggcatgaacaatctctttgaactaaaaagttattactgcaggatttttgcaaatgtgaaaaagcacacttactttgtctttcgcagaagcctaatataaattcatgatttaattctcttctaaatgaatagccacagagcctgagtaaggaatattaacccttctattgtcctccacctaaattatataatcccatggttcagaggccattacatatctctgaatgagctttggtaaattcttcagctcaag

SEQ ID NO: 165223 - DNA, 340 bp, Homo sapiens
aattgggggaagtttccaccatggttcttacagacagaagatctgggttcattgtttattctataccttcaagccatgtctccccagcttctatcttttccctacatacaggctcaattcccatatctcttttttcttcaaatcctccccatcttaggaccctcttttgctatgaagctttccttggctgtactggccaacattaatccgcttctcctgatggcgaccttgtacatgccaggcaccgtgctagacacttcatacccaaccgcatgcttaatcttgccaacaaatctgggaggagagcttcccctttcacagaagaacaaagtgaagttca

SEQ ID NO: 165224 - DNA, 533 bp, Homo sapiens
ctcagaagcgaggcagccgtgaggcggaggacaggctgggggatcccaaagggtgcgctccagcccccaacccaggcactgggactctggtggcaccctgggtggcaggcaagccttgaaatcaagtgcacgagccttggaaaggaggaccgggagagttatggcatttatgaatgaagaagagaaagagaatcactcggatgggaaaagttaactggattgttcccacctgcatggatcaccgggatgaagctgtgccaccctgtaggaattagaagaccatgtccaggaattgagcactgggtgcaggatccagtcttctgaggccctgaaaccacatgtggtcctaatatgctatttagaaaatacaaagtggaaagaagaaaaatgaaagtcacgcatcgtccttcaacccggggacaactcctgctaacactcggatggatgaatttcacatatacatataaatattctcatctacagtcaaatttaataatgtgaatgccttaataaaccactaattcttcaatttc

SEQ ID NO: 165225 - DNA, 492 bp, Homo sapiens
ctcagaagcgaggcagccgtgaggcggaggacaggctgggggatcccaaagggtgcgctccagcccccaacccaggcactgggactctggtggcaccctgggtggcaggcaagccttgaaatcaagtgcacgagccttggaaaggaggaccgggagagttatggcatttatgaatgaagaagagaaagagaatcactcggatgggaaaagttaactggattgttcccacctgcatggatcaccggcagcccatgagggaatcagagatcattgatttcttcctgggggcctctctcaaggatgaggttagaaggattatgccagtgcagaagcagacccgtgaccggccagcgcaccaaggtatcaaggcatatggtggctatacggggactacaatggccacgtcggtactggatgttaagtgctccaaggaggtggccaccgaccatccgtggggccatacatcctggtccaagctctccaatcgtcccc

SEQ ID NO: 165226 - DNA, 939 bp, Homo sapiens
ctcagaagcgaggcagccgtgaggcggaggacaggctgggggatcccaaagggtgcgctccagcccccaacccaggcactgggactctggtggcaccctgggtggcaggcaagccttgaaatcaagtgcacgagccttggaaaggaggaccgggagagttatggcatttatgaatgaagaagagaaagagaatcactcggatgggaaaagttaactggattgttcccacctgcatggatcaccgggatgaagctgtgccaccctgtaggaattagaagaccatgtccaggaattgagcactgggtgcaggatccagtcttctgaggccctgaaaccacatggtgagaagttgaaggtcacacagctgaagcaacttagccgtctcgccttgcggcctggaacccctggcaatttccggagcaccggcaagagacttttgcacagtttctgcttggagtctaccgactgtctgtctcagaggtctggacagctgcttgttacatttggctcacgctagcttaaaaaaggaatttatggaccttactgcagaacgtcccaattcttcaggccaaggtgcctgtgttcctgctcggtttctggattgcttggtacttaaatgaaacatcttattaatcatttcccgggaatgctgtgcaggcaaaaggaaaacaaaggcattcaggagccacagaaaagtgtactggctcctgtcctggatcaactcagaaaatgaaacacatcggattctgtccaggccgggcacagcaacctggcccatccatgtggagcctgcagtgaccacttccgctgtctgcacaaaactggagggaggctgggggtgctccaagtataagtttcctcatcagcaaaccggaaagagaaagaccgacctggaggctggttatggggataaaataaatatgtccttatatatgtgta

SEQ ID NO: 165227 - DNA, 242 bp, Homo sapiens
agattaactaatttattgaaagtcagataatctatgtcagatctgggattcaaaacttcatcgtttgaatacatagcctaaacttttaaaagcagtactcatccaaaattgacctcctgatcatccttctatggctgtccaatcattttctccacttctaacacctcagagttaccaagcatccagtctaaatgaatctctgtcttctgcctcctctttcatctaaacattttactatctag

SEQ ID NO: 165228 - DNA, 584 bp, Homo sapiens
  misc_feature (102)..(102): n is a, c, g, or t
cttaagatgatcccatcaccagagaggtttctctaccattagcttccctcttccggccattcttcacaaagtcatttttctaaattctgtgtcacatacgangatggcatttctggaaattccttcaggtgctctcaagccctgctgcagagatccttttcagagcacacactgttccagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatc

SEQ ID NO: 165229 - DNA, 459 bp, Homo sapiens
cagaatctattctcttctctccagtcccgttgttatagtcttcactcatagacagcccatctgtctcaccctctcctgttgtatccagctccacgacaaacttctgccttccccaacacctttgtgcctttgcatatggtgttttcttgcccattttctgctcgactcgcccctgattttcaagttcaagacttaactcagggttcaggtcttccaggaggccttacttatgtcgtcagtctggggaactctccatgtgcttctatcactgtgcggttacctctttcacagcccttttaaagttctatcttccctttcccaccttttttgaccttccactagaccatgagcacctgggcggaaagccatatatcttattaagctttatatctgctacctggccgagggcctaattcatagtggagaataaatagtcaattgaataaatgaataaatatc

SEQ ID NO: 165230 - DNA, 369 bp, Homo sapiens
aagacagttatatgtggcttcttattgtggcttacacttcctcagtagatggtggctgggttccaagaacaagcattctgagagaaagtcagatggaagctctatcacctgttatgatactgtctcaaatgtcacatggtatcccttatgccatattttgttgttagaaatgagtcactaagtttagtccttattcaagaggagaggaattcatctctacttcttgatgagaggagttttaaagaacttgaagactaacttttaaaactctcacaactgcatacttacccttccccgtagcaccaaaccttctccttctacagtctctcctatttcaataaatggcttcagtaggccagaaaccttgga

SEQ ID NO: 165231 - DNA, 283 bp, Homo sapiens
ttcaagcaattctcctgcctcagcctcccaaactgggattacaagcacctaccaccacacccagttaatttttgtatttttagtagagacggtgttttaccatgttggctagactggtctcaaactcctgacctcaggtgatccacctggctttgcctcccaaagtgttgggattacaggcgtgagccaccatgtccagcctgggttctcagtcttttgtggaatatctttgttcttcctccattttccatcagttttccactctggggagatgagaattcgt

SEQ ID NO: 165232 - DNA, 286 bp, Homo sapiens
ggttgtttttcctggatgcattatttgtgttagtgaaagatggaaaatgtcagtctaatttattgaaattataaaattgttgtatagcaaaaccctaagtaagctgttttgtgtgtattcccttggatgatatttttaaaattatgttttacaattcttcttacttttgagtatttctgaagcactttttacgatgttaccctgaagtcatacagacaaggctgtgaggaggttagtgctattttgtaaacttgactcaagatacaggactttgctgtacaaggga

SEQ ID NO: 165233 - DNA, 198 bp, Homo sapiens
gaggacccagacctgctctcctcccacagcacattcttgagtcttggaaagagttgtgaaaatgccacaggtacaaacacctgcaggccactcccacagggacagctccgtgaggcggtgccgctcattcccacaacctcctgccacaggcaacacttaacacttagacagtgacccaaggccgaccagggaggacgc

SEQ ID NO: 165234 - DNA, 512 bp, Homo sapiens
atttctcataatagaagttaaattatttttcttttgttcaatatctgaagtttcagaaaatattaatgtctgtacttcactaaatttccattaaatagtttagtttccacagaatcccattctctagtgaagattgattttcttaaaattgctaagtaaactttaattttaaaaaatgtgtatacccactttagctaattctgcctctggagtctgcatttttttggatatttttatgttgtttacagtattccaagtgattgattttattgattggtcatgaatattcttaaagtatatacaagcttacttaggaagtaatatataaatgaaagtgatgtaagtagaattttacctgttctatctgtacgttaaatataccataagagcacacacatgctaattatatttccagaatacaattatatatacatgcatatatatacacacacatatacataattacatatatacatatgtatacacacattatttttataatggtcactgaa

SEQ ID NO: 165235 - DNA, 481 bp, Homo sapiens
tccgcctcccgggttcatgccatgttttcaattcttttggaaatgtattcccagaagtgggattgctgggtcctctaggatatttttaagcacatgtcgatggttcagtcagaagacctgagcttcccagggctcactctcctcctcagatcgtctgtctttgcacccgtctgacatctccattctgaattttgtggttccgattctggctgatggatttgtcttcaggggtagtgcatgattgtggagtgcccaggcttcaagctgattgctgcttctcctgttccttcatccctcacatattctattgttgagtcactcagatgtcacagacactcttctttcctgttcagtggcataaatcaatagcataagtgaagaagaaatccgtgaagcaagagcttagcagcgttgttgataagcctggagtcacagtggtgagagaacggggctgatgtattaatatttaatattaccacag

SEQ ID NO: 165236 - DNA, 337 bp, Homo sapiens
cgctgggattacaggagtgagccaccaagtccggcctggtgtgggcatgtatttattttgagatagagtcttgctctgtcacccagactggagtacagtagtgcaatctcagctcactgcaacctctccctcccaggttcaagccattctcttgcctcagcctcccgagtagctgggattacacatgcgcaccaccacacccggctaattttgtttttagtagagatgggagtttcaccatgttgcccaggctggtctcgaactcctgacctcaagagatccgcccgcctcggcctcccaaagtgctgggattacaggtgtgagccaccgcacctgg

SEQ ID NO: 165237 - DNA, 162 bp, Homo sapiens
tgctgggattacaggtgtgagccaccacacctggctgtaagatacctttagagactctgtaggtcagcccataattttccagggaagtgtgacccattgaggtatttgccaaaattacatagctacttttgacagaaccaggactaaactttgagttattaa

SEQ ID NO: 165238 - DNA, 138 bp, Homo sapiens
cactatcctcatcgctgcgacactctggcaatgaactgtttactgcccaataatcttaatgattaatttctgcttagtaagaacacttagcttctgtggagtctgagactgagctttatgcctcctttgtactcagag

SEQ ID NO: 165239 - DNA, 122 bp, Homo sapiens
tgagcatgtggccctgtgggcctagtcccagtttgttaatcttgtgagcagagctgctggcggctgctctcagtccgctaatcgggctctttctctgtcacgtggacaggagactgctcaca

SEQ ID NO: 165240 - DNA, 291 bp, Homo sapiens
cacttcaagatccttgcctctttcacttttaatctgctcctctttctgtagacattctcttcctgatgagtatctacgtccaatagatttccctggctaggaagattcttcagttgaacaaatggggtctttacatttggcaaggtatcctaaataatattcatgccaggtgctaagagagacttctcaaaaaggctgcaggcatttgtctctgtgccctttaatatacttcttggtatcatgggatttcttcagacctaacctgagaaagttgttctgttctattcctgc

SEQ ID NO: 165241 - DNA, 260 bp, Homo sapiens
ttggcgtgaggccaagcacctttgatacacggagggcccagtggccctagagcaggctgactcatggaccagagaccctctcacctagaaaagtcagcagtttcctttgagctggtgctggaagctttggaaagggaaggctaccacccaaatggccccaggaccagctcctgctgctgactcaccgaaggggttagaggcctctggtcgctggatgccatgcagcgggacgtgtggtgttataacgttatttggtttca

SEQ ID NO: 165242 - DNA, 468 bp, Homo sapiens
tcgtgaggatgtttgcagaagtttttacttttctgtgcacttaaatctgccagtctcttgagatttcatgtattgatgtgctgagaacagcctttcctacctaagatggcatgagttctggaagcttccctctggcccttcccactcatgtctaccccatgagcacctgcttttctgctctctgcctaccttgattggctttgcctgttcctgaattcgtggtgatggggccgtgtagcggtgctgttctgtgtctgagcttcgtggtgatggggccgtgtagcggtgctgttctgtgtctgagcttcgtggtgatggggtcgtggagcgggtgctgttctgtgtgtgagcttcgtggtgatggggccgtgtagcggtgctgttctgtgtgtgagcttcgtggtgatggggccgtgtagcggtgctgttctgtgtgtgagcttcgtggtgatggggccgtgtagcggt

SEQ ID NO: 165243 - DNA, 344 bp, Homo sapiens
actaaattcgcggccgcgtcgaccgcacgtggcctctaaagagtgggtcccaaggtcatgaaggcctgtggggtggagggcaaggtctctccttccaggctggaatggcggaagatgcggcggcagaggggctgcatgtcctcctcacagcaggcccctgaggacctttatcctcctgagccatgaatgtccctcaggagtgtctaaagcacccggtggggcagggggacccctataggccttaggagctctggccaattagtggtcagtaaaacgcagaggtgaacaccatagaaccacaggtccagggcagaggaccaacgtcgacgcggccgcgaatttag

SEQ ID NO: 165244 - DNA, 453 bp, Homo sapiens
aactttgagggaatatatttatttggttttagaccaccaggtttatggtaatttgtaatagcagtcttaggaaatgaatacagggggcattttaggattccgtgtatcacagtttctacaattttctaggctgggagacaattctccgtggatctgttgcatttttgcatatcctgcaaagcaaggcattgtctttttttttttttttttctgagctgtatctgcagcataaaacagacgtagttactgcttcttaggaaatatttggctctccaagctcaaggatcctctctgtaaaacagctttctgtgtatgcagactttcatctgggctcagttgcatcactgctgtgggttttgtggacaagaaagattggtgcaaatagtctgacaatcatgatgcttgctgtgtcacgagttaataaagttctttgtctctaacccaggagtctcg

SEQ ID NO: 165245 - DNA, 311 bp, Homo sapiens
ggtcttttcattatataaataaataaaaccagtttttgtcaaggctagtatgaattgggttttatattacttatcacaccttgacctaactctcaaattttcaggaacactgtgtgatcttttataagattttatcactatttgttcttcataaatatttatgcatatttcctgataaccatgaggctcataggttgaaataagatttatgaatggagatttttctttatatatgtatatgattcatagattgcagggatgttttaaagtaatagttcttatagtgagacctccagatcagcatcttcttg

SEQ ID NO: 165246 - DNA, 349 bp, Homo sapiens
cgtttagacaagtgtcagagttggctgggcccagccaatgagtggagaccaacataaacagcctgcacaggctcctgggtgatgtgggtctgcgccagggagagctggaggtgcagtaagagtccctaagggaggagtttctgtgttcgaaaaataaccgtgagcaggtagaagcaactaagaaatggctgaggccaatttcagggggttgaccaggaagagcgacagatccattccttgggtttgcacttgggcgctgttcccctccaggcagagtcttctcccctttggctgacctttcccctgccctggattaaagacccatggtcccaaaatcttgtaaaagcag

SEQ ID NO: 165247 - DNA, 312 bp, Homo sapiens
acaaaaaagaaaaacaattagctgggcatggtggtatgcatctgtggtcctagctacttgggaaacagaagcaggaggatcccttaagtccagtgtttgagtgctgcagtgagctttgattacacaattgcactccagcctgggtgacagagcaagacctcatctattgaaaaaacaaattaagcttttgtagggtttggggccaggccaggctggtctcaaattcttgagctcaaactatctgcctgcctttcctcccaaagtgctgggactacaattgtaagccaccacactggccattaactttctcat

SEQ ID NO: 165248 - DNA, 512 bp, Homo sapiens
atgttgggtgaatggctgtttcctcttattcaagccatgcaccctactcttgccggtaaaatcactggcgtgttgttggagattgataattcagaacttcttcatatgctcaagtctccagagtcactccattctaaggttgatgaagctgtagctgtactacaagcccaccaagctaaagagactgcccagaaagcagttaacagtgccaccggtgttccaactgtttaaaattgatcagggaccacgaaaagaaacttgtgcttcaccaaagaaaaatatctaaacatcgaaaaacttaaatatggaaaaaaatatcaaaatataaaagaaggaaactgaaccgtatgtaccgagcaaatgccaggtctagcaaacataatgctagtcctagattaattgattgaaaaacaaaaaacacaaaaaaaatagtaaaatatagaaacaaattagtgttttatagaccctgggaaaaagaattttcagcaaagtacaaaaatataaaacattcc

SEQ ID NO: 165249 - DNA, 453 bp, Homo sapiens
actgcctccactatttgcattatttcctcttctattaggttttattaataaaaatcattgtttcaaaagttaaaagacctaacttcagaacccatcagtatttatttcttgtcccatgtgacccctctaaaacagtgatccccttgtccatctgtttctcctagagacactttcttcctgactgaatgataaagtaagaaaaacaacaaaagggactgcagagctacacataacctagcttcctattctagcattgtcaccagttggtagactctggcaagcctcctctccctgtgtaccttctcagcccagcagccaacacctcattcttggcaggcctaccacagaactgcccagaaactttctgccttctgtatttttccccttctaatccattgtccacaatgtggtcagtttgtttcaagaattgtggccatgccattcctttactca

SEQ ID NO: 165250 - DNA, 366 bp, Homo sapiens
tttcatactaagttagctaagtccccccaagagactttacatgcttttatctacttaaaaacatttaataaactccatttaattaaaccaaataaatcattaatttaggctgtttaggaaaagttataaaatgtttgataatttttcttataataatcctaatgtattatatggttcaataatgtgctattctaggatgaaaccatttaaatctggttctttgtacattttaatgaacttttgcatcatatctccaatacttttatgaatatttatgatctcttacataagttgatttccacatagtggggagatttaggctttctaacactgctctgctttttcttataacttcttttaccattg

SEQ ID NO: 165251 - DNA, 495 bp, Homo sapiens
aagtggttgaatgaggacttgaatctctgcccctgtggtcccagtccctggttttctccgtaagttgcccctttgaagaatctgttttaacactgttgatctgaaaaaaaaaatctacagtatgattaaattgcttaattctctgtgggaattcaagattttcttattcagagcattgttccattctttctgagaataactggtttaatattcaaacagatattcccaaaaccacagtgtctctttccagaatctgaaaaggaaatgaggtaatcttcaatatgtgaatgaatgaatcccaagctatacaaaccacagacagacatatcagctttttccattttgctctcctttttgtttgttaagtatgataaagtaaaattttaaaaatgttaatggatcttggtttaaatgatacctcactaaataagctattcacaaaatttggttggtctactacctctactcaataaacattactgatgtaaagtccta

SEQ ID NO: 165252 - DNA, 172 bp, Homo sapiens
tccttaattatcccttaaaatgtattgctacttttccaaataaaatcaatatacccttgttagcttgtcagttaagtactcacacaagtcttagggttcaggcatcactttaagaatctgcactcacaagacattaaccagaacctgggataatcaagttcaacttcctgct

SEQ ID NO: 165253 - DNA, 114 bp, Homo sapiens
ttttaaaatgaaaaaaaaaagatggatatggttctataaatgcttcagtgaaaagatacctgtaatatgatgtcaagttaaaaagtcaggttccagccgggtgcggtggctcat

SEQ ID NO: 165254 - DNA, 162 bp, Homo sapiens
catatgttcaacagctgtgttgatgccatttgcctgcccagacaagcctcttgaggcatgaaagcctaaggaaggtttctcatattaaggatcaacagggactcttctgtatccgtcctaccagtgtcacctccccacccagcatcagccgagcaccacatc

SEQ ID NO: 165255 - DNA, 430 bp, Homo sapiens
cctatttagaacctgaaacatagatttaattatttggttatgttttattgcaagtggaatgtagtgacattacgtagaattatctcttacgaaagacaaatgagaacagattcaacttttagaaatgagtcttttgtatattgatgtgacgggaagaagaattttttttttaatccttgtatttaacacataaaagtgttaattggatacatgtgcactgttttgccaggggccaattttttgcagtcagttgtggcaaatgctcttttattttaaaacttagatatgctttctgttatctgcagtcctctactgttgcctctcctgtgtagaggtcattgtaggttgcatggacagggagcaggcaggcaaggagtacccttagacactaacttagtaccattaggcactaacttggattctcagtgcc

SEQ ID NO: 165256 - DNA, 336 bp, Homo sapiens
tgaggtgggaggatcacttgaggctgggaggtggaggctgcagtgagccaagatcatgccactgcaccccagactgggcaacagagtgagaccctgtctcaaaaaaaaaaaggaactataatatataaaagttcactcactgtttttaagttaaaggtaacctccatgacaaaacctagatgttccgaaaatcttttccctacttttttttttaatcgagggaatctttccccacattgagaagaagcatcatgccataaggtgaaaatgccagaaggctatattttccttcaaactcttaaaatgtggtaataaggtactttaaatataatacat

SEQ ID NO: 165257 - DNA, 259 bp, Homo sapiens
atgcaaaggagtatttaacattcaacaaatacttatagaaggcctcctatggggcagacactgttgtggtgccttgtgatacatctagtgaacaaagcggacaaagattcctcccctcatggaactcaaattttagtggggggagagagacaacaaacataataaacacattgtataatacgttacaaggagattaaaggtatagaaagaagaaaaggttgaatggttaaggaggatcaggaatgcctgaatggagtga

SEQ ID NO: 165258 - DNA, 617 bp, Homo sapiens
gatgcatgcaccatccaagatttactcattcgcgatgagtaaatcttggcaaagatctttgccaagtgtacttcttcctgcatgaggaagagaagtttgctccttgagtgctgcatgacctttaggctaattttactcctgtgtgaccctgggccgccagaagtctaaaagcccttctctcccaagagtggacttatattttccacatttcaggttgtcagaaacaggaaaggagagtggggctttctttcatttgtactgcaaatctatcaggaaattttgtttctttgtttttgtttgtttgagacagagtcttgttctgttacctaggctggagtgcagtggcacagtcatatggctcactgcagcctcaaactcctgggctcaagcaatcctctagtctcagtctcctgcgtagcgaagactataggtacatgccacacaccagttaatttttaaatttttttgtagagataggggtctcactatattgtcaaagctggtctttaactgctggcctcaagccatcctcctgcctcagcctcccaaagtattgggattacaggcatgagccactacacctggccaagatttactcatcggggtccgagctcgaa

SEQ ID NO: 165259 - DNA, 223 bp, Homo sapiens
tgagtaaaaaatctcacaaaaaaaggagattttgcttcattttcttcttctctatggtctgccctccgtgctaatgagaaacccccagctccagaactaatatcctcactctccactcatgaatcataacggactcagtgaggctcccactctcatcctgtatccagtatggcattgctatctgccctctgggagacttgagtcaattcccactttctgcctt

SEQ ID NO: 165260 - DNA, 376 bp, Homo sapiens
gctaaatacaaatactggcattctatgggtagtagattcaggattaatactgatttaggttcaagacaaccaggcaaaattacttttgtcaataaacaagatttttgcatattttgttctgttctatatacaaatgttagtcttacatagaaatcctgcaaataaaccgatacacagctggcttcaattatggggataattggtgataaaggaatcttctctgaaaaatatttgtggcattaggctggcatttagatgagatgaagataatgaagctcccatcagaatggattatgttactgaacactatgtgacacacttcattggggaaataaatgattaccaaatgattaccaaactgtaagcaaaataagaa

SEQ ID NO: 165261 - DNA, 234 bp, Homo sapiens
acatggtaatgtaaaggaacgtactggtatgatatcgctagggtggcgacagcgcatttctaggataagtcagtagaattagaattgtgaagatgataagtgttatgggggaaggtaatgtagtctaaggtggggctgggagatggatggaggcgtctgcaatctgagagtctgagcatacttccttgaggtgacactgaaaggcttctgtgatatctcccctttgactctgtt

SEQ ID NO: 165262 - DNA, 707 bp, Homo sapiens
tattagcactttaggatgctgaggtgagaggatggctttagtctgggagttcgagaccaccctgggcaacacagtgagaccacattttattaaaaaatatatatatatactggacacggtggctcacacctataatcccagcactttgggaggctgaggtaggcagatcacctgagcccaggagtttgagattagcctggacaacatggcgaaaccccgtctctactaaaaatacaaaaacgagctgggtgtggtggtgcacgtttctagtcccagttaatcgggaggctgaggcaggagaaccgcttgaatctgggtggcggaggctgcagtgagccgagatcgcaccactgcactccagcctgggcgagacagagtaagaccctgtctcaaaaaaagaagaaaaaaaagaaagaaaatttttgttggtaaacaattgctcatctaatggacaaaaagtggtaataacatgtgtcgccccttagaacgggcctggcccttaaaaagagtctctcagcattgcctattggcatcgtgaatagtaaaaaagtaggatgatcttgttcacgttttagttttcctaagcattcctaattgctctccttagggtactgggctgtctcccttcatcagtttccctcccaaaaatcatgatctactgaagtacctggggacttgctcctaaaggggaactgctcaaatggtga

SEQ ID NO: 165263 - DNA, 705 bp, Homo sapiens
ggagggtgaggagggaataaacttgggaaatggttgaatttggagtgaggtcaatccactgggtgtttttctgacacactcatctgtgtaggcacagatgcagaaaaggcactggcattgaagttttgcggtcaaaatgtaacaaaaacaagagggaggctaagaagctgagggtggatctcatcttacagtgttacaacaacagtgtaagctgagggtgaatctaagggagtgattatgaccgaccatgaaatttcagctgggcaagcagagaacccagatgagagagaggacagggaaagttggttacagatgccagtggctcaaagaattttcgggatttgagtactagaagggttgaactggacaaacaggcattggccaaagaatgaaagacttcacatcgagcttgtggaggagctgcatggtcagcaccgacgaggtcagaggaggcctagggaggctgtgtgtctgatttcagatggaggacaaggtgacgagagaagttgaggtcatggaattgggaagtcggagagttgggagtaccacccctgtgcacgctgagatcttccagaattgcaaactgaagatttgagaaatgagagagagagagagaaatggatgtcagtagctgacagcagaaggggaaatagtgcatggtgtaggctgatgggttgaaatggaaagttggagggctttagaagg

SEQ ID NO: 165264 - DNA, 701 bp, Homo sapiens
tattaaatatatgtgtagttaaaggtcctttgctattaggaatatgaaaataaattcctatgttttcataaaaagtataggttaacctctaagagacttcccactaatcgcatttgatttttcacccagacttcattctaaacttcaaactggctctttaatgatctctaccttactgcacaatcactccttgaacactggacacatcttctattcaaactgcttctcctcatattagtccttagcatggagcaatgtgttctcttccatctaatttccaaatactgatatatagggatcatcttagactcattgctatccacctacatgtcattctcaaccaaactggactaagtataccttctaggtagttctttgagatgtgtcctcctttcttcccacactgctcaaatgttaggccaattacagtggactaactggttacccagaccagggcctcctctcagtctgttctctgcagctttgccagggtaatcactgtaaagcctcaatctaatcatgccatttccctactgagaacctctttgctaacttccaatgcctacaggatgtatttcaaatctttcattgtgatatataagaatgctcaagatctagtactgctttcctttcagactcaccttccaccattcactcacacactcccaaaccttaacaaacacatacatgtgcagccaacc

SEQ ID NO: 165265 - DNA, 172 bp, Homo sapiens
tctcatcatttttatctggacttcttcagtggtccccaaacctggtctcccatcctatcctttcaggtccatctttctcacagctgcaagagtgaatcatctaacacagaaatttgacaaagtctgcatctgtagtgtgggaagccaaaaaaaaaaaagaagaaaaacacat

SEQ ID NO: 165266 - DNA, 244 bp, Homo sapiens
ctgatcaccagttaaggttgttgcctgattcatccctgtacaattactgtttttttccttcttagagataattaacagtctgtgggacaacactttgagatcaagaaatatcctgcttatcatcaaaatttcccctagattcagcatctgtaattagttacccactgctattatgccaaatcttagtagcctaaaacaacagatacttatgaactcagacagttcctatgggtcaggaatttgg

SEQ ID NO: 165267 - DNA, 114 bp, Homo sapiens
gaaactctagtcagggactccttgcagaaataaatgaccccagtctggcaggacaataacaaacagtggcccccttgatacagatcgtaactcttaagctgcaacaataatgac

SEQ ID NO: 165268 - DNA, 666 bp, Homo sapiens
tactacagggcagaaagatgtacagagagttggcttgttttacttgcaacgagtcagtgtcacagaatttcaagataatgttctaaaaagtccagaataacccccgctgcctaggctgggtcacagacgtcttagaatcagatctacgctgcttttgttgtccaacaggaagacagaatttaaacttgagaattaaaaagttaatcatattcaaagccaaatacttcgagaagtctgtatacaaaaaatggaaggcaaactcccaaagaaactgatacactgttcagtgctcatggtcagattttaacttaagttttaaagcatttcctcaaatcgggttatataataaaaactcctaattagtcagaaataaggaaacctctcgcactgtatagagagctcttctggccatccagtactcagaattaattgcaatgaattagaatgaagaggcaccattaacttttggtggaaaacatcggctcataaattgagactctagcagaaaaagaaccatacaagttaaatgaaactagaccgataagaaaaggaagaaattgttactggcgtttaaaaaacataacttgaacttaactaacaatttctgcagctgtttgtaaccactaactgcagattctgttagacaatatcctccctttgcattta

SEQ ID NO: 165269 - DNA, 213 bp, Homo sapiens
ttcaagataatgttctaaaaagtccagaataacccccgctgcctaggctgggtcacagacgtcttagaatcagatctacgctgcttttgttgtccaacaggaagacagaatttaaacttgagaattttttgacaaacccttgggaatctccctcaaataaatccaaacagacctaaggatgtatggcttatacatgatttcacttcttggtaa

SEQ ID NO: 165270 - DNA, 284 bp, Homo sapiens
agaatttacgttttaagactaacaagcaaaatgactgttaaggttatgtctcaaatttttgtcaaaatctggtggtgttttttaggatttgtttttgctttgtattgtatttgatgtttctacttttaatctagatgttttcaatgatgctattttatgtctctgacctcatttttgtctgtttacatttttagctaattatgcttcccggtagtgattctctgttatggagtatgtaactttacgtgtatatagcagctttaagtcgtttttagtttgatttt

SEQ ID NO: 165271 - DNA, 231 bp, Homo sapiens
aagtgatctgcctgcatcggcctcccaaagcgctgagattacaagcgtgagccactacgccttgccctccacacagccttgcttggtgttaaagattaaacaaagaccacaggtgatcactgtcttcgtggtgccagtttcaagggcacccttcttcccttcccagcctccgagagaaggagagagggtccacaagccagatccatccccatccacacaggtaaaaccacg

SEQ ID NO: 165272 - DNA, 335 bp, Homo sapiens
tccgaaatgcttgggaccagaagtgtttctgattttggaatacttgtatacttattggctgagcatccctaaacctgaaaatccaaaatcctccaattgacacttctgagaatcacgtcagtgctcaaaatgtttcagattttagagcattttgtatttgggatactcaacctgtggtaactaatgaagtaccttgggatatcttaaaaataagcaaaggaagacaagcaaagtctgaaatacatataaagcttaagactaatgatacttgtacagcattactccttggacctgctgaaagagatttaacacacaacacatttctggccaggtgc

SEQ ID NO: 165273 - DNA, 197 bp, Homo sapiens
caactcagcctccccaagtgctaggattacatgtgtgagccactgtgcccagcctcatttccacttttatatcacacaggtatctcaaaatttaacatgtcctaatagtcctccaggaacctgctcctctcacagtcttcctcatctctgtaaacagcaactcctttcttttggttgtataagccaaaaaccgtgga

SEQ ID NO: 165274 - DNA, 284 bp, Homo sapiens
agaaaaaagcaaggttccttctggtaatattagccccaaggccctatcctcccagcatgtagatgatgtccttgggttttttgtagcatttcttcataaaagggcacaacgttgttcgtagaagggctacagtgcagacatgggttgttgcttgtttttatttttccagaatcacctaggcttattcataagaatcaaatatgttatgattaaagcttgttcaaatgactttcaggcctacaatttctctattttgaagatttaaaagtaaaggagttcagata

SEQ ID NO: 165275 - DNA, 424 bp, Homo sapiens
ttcttactgttatctgtatgcaaatatatggtaatcttctttacttactaaactgtgtgtgcttggaggaaagttaccatgctttatacatatctatggtcccattacctaccacagtgtctcatacatgatactaaagtgctaataaatattgtgcaaatgaatattttgcagaccattaaaaattttgctttgaaaaattatttgattcttctaaatcctcagtgattcaatagaaagttctgtcctgctattattctaagcatatcttcaaaatgcagcttcaatgtatatataaataattagtctcaaaatatagtacttgaaacattcattcgattgtttcctttttaatggagtactccaacagtaagaaaaacaactgtaaaaatctcgttatttatagtaatgagcccaagcgcag

SEQ ID NO: 165276 - DNA, 562 bp, Homo sapiens
attcacctagtaaaaagagctctaaggaaaaacctgattgcctagaagtccattcagaggaaaatgaaatgtcacgtgctctggaacaaacacaattctaaaacacaaaagtgggagcatcacataaccctatggaatttcttggcttgctggtctcaaataatgcatgctcccaaagaagcctctggcattgagctgaccttaaatgaaattactgtccagtggtttccaaatcaaatcagctctgaaataaactgggtggaaaaattacctaaacacagcctttcagatgttatgcccaagagagatgtacacatatgacgtttatgttattcgtaataaatgctaacagggactctgtaatgtttttatgtctggcaacaactttatcttgaagacttgagtggattataaaatcttttctgttttttttagctatctttgtaccatacaactattgatttaaatatagtaacactatatttaaatggtacatatcatcgccactaaaatagttgtaaaaatactcctgattaaatttggttcttgttctttggcaaca

SEQ ID NO: 165277 - DNA, 482 bp, Homo sapiens
atgagtttttaacatttgcatacattaagtgtcactctttgtgctatgtagtttaatggtttttgacaaatgcatgtcttgcctctacaactacagtattatacagaataattttaccgccctaaagattccctgtgtttcatgtatttctcccttctccatttccctcaaacccttggcagtcatttatcatctgtctatagttttccctcttccagaatgtcatataatgaaatcatacaatatgcagtctttccatactagcttctttcagctattaatatatatctaaagttcctctatgtctttttgtggctggacatgcatttctttttattgctgaattatattccattgtatagatctgccacaggtgaatgtatccattaacctattggaggacatcttgactgcttccggtttttggcaattatgaataaagctactatgaacattcacatggcactttttgttgaacacag

SEQ ID NO: 165278 - DNA, 362 bp, Homo sapiens
tcttcaccagataatcctgcaatatccaatatgctgtcactctgatgggattcagtcatgtgatttgttttggccaataaatagggtgacagtagatgtcatgtaagcagaggttttttttaataccatgaaaagcacttgaacagttggacttgctctgctttgctctctgccatcaccagcccccaactactgccctctgctgggccagcctgctggtcccaatcaggggagaacttacacatcggccagaggcagggcatccctgtcatctcagctgaggccactttagatgagccaacaaccatccaagaccaagtgaatgggcccacccaagatcatcagaaacacccaattcacct

SEQ ID NO: 165279 - DNA, 217 bp, Homo sapiens
agaaggatttagcccaggaatgcaaggttagtttaacatcaagaatcaattaatgtattataacatatcaatagaatatggaaagaaaccacatgatcatctcaatagagacagcaaaagcctttaacatcttctcatgagaaaaacatttttaaaactagagatacaaggaaacttcctcacctgataaagagcatctgtgaaaaccacaaataac

SEQ ID NO: 165280 - DNA, 460 bp, Homo sapiens
agagcaagactctgtctcaaaaaaaaaaaaaaagtgtttaaataaatgcctctggctttatttgaacagtccaggaataattcaagggtctgtcacagaattttgacaaagaaaaaaggtgggagggatcatgtgaagaaggccttttttcccccaagagttaagcaggggccaggcacagtggctcaggcctgtaatcccagcactttggaaggccaaggcaggccgattgcttaaggccaggagtttgagaacagcctggccaacgtggcaaaaccccgtgtgtactaaaaaaatgcaaaaaaaaaaaaaattagccaggcatggtggtgcacacctgtaatcccagctactctggagtctgaggcgggagaatcacttgaacccaggaggtggaggttacagtgagccgagactgtgccactgtactccagcctggcccacagtgagtctctgtcta

SEQ ID NO: 165281 - DNA, 435 bp, Homo sapiens
accaccatgtgttgacactttcagagcctaagtcctcatggtggtcacaagcctgatttccaccgggggtggttgttggtgaaggcagactcccttcctgcccaactacagctgggacgcctggcttccttggactcggttaattgcctggatttgttcaccaggcattcctggaggacctgccatgcacttggcatcctgatgggccttgagaactgggcagaaagaaaagagaggcacaaagcttggctcctggccctgagactgcctagttccctggccctcagcattcctctcccccatcactcaagccatttgatcatcccctgaagacttagctcccacccaggagcagagattaaagtgagcattctggagccagactgctcaggtatatgtcaagcccatggcaagtgcctggcatacaaggtgctc

SEQ ID NO: 165282 - DNA, 311 bp, Homo sapiens
cacctctcaggaccagaggcctctgctaggacctcaaatgagcaggcagagggcatccaggaggaagtgcccatgggcagagggtcccatgaggggaggggctgacctggcagtgcccctggtgcctgccgcctgcctcctgcctccctcccctttcctccagctctgcccactgcttgagtggcatgaatccgtctgccttcatgggcctgtgagtgggtagggccttctccctgggtagcgctttcctcttcggtctgggcaaatttcccactagcccttggaagaaagctcagaagtccctgctacgt

SEQ ID NO: 165283 - DNA, 496 bp, Homo sapiens
gagtagctgggaccataagtgcgtgtcccaccacacctggctcattattaatttttctttgttgcccaggctggtcttgaactcctgggattacagacatgagccaccacacctggtccaaactttttgcttacaacttttaatagaaataggtaaaagaaataggaaggatctaattgagttataaaacaacctttaaagatacaaaagtgaaaaagattaagccattgctttttgtcaatagaattaaaagctgttggtaaaaatattaatgtatgaaaaacttattgaaatgaaaaaaatatatatatatatatatataaataaaatgtcgacatggctggatcttaaaaactgtcaaatgaaaaaaactaattgcaggaaagattttttttttttttttgagagggagtctcacgcagtcaacccaggttggagtgagccgagacggcgccactgcactgcagcctggctgacagagccagactctgtctcg

SEQ ID NO: 165284 - DNA, 309 bp, Homo sapiens
ccacctcctaggtagtagatgtaagcagcaaatataggcccacttgggccacataaattgaactagctgccacacccatcttgccccagccaggctccccatataagcaagcaggcaggttgcttaagccccaaacatagcagcagaggtgatggtggcacagggtggggcaggaggtagagagccagcctggcagacaggatgggcccacaggcacagtgatagcagcccagccactagggcctgtccacaggccagagctggccaggatcaagcgaggcactcagggtcctctcagctccttccttc

SEQ ID NO: 165285 - DNA, 489 bp, Homo sapiens
aggtgggctatcatcagacctctaaaatccttagtgcctcgttaacgacaatgggtagaatgttctatcttctaaagatcgtgaggaaaatgcattccctgtctcactgagcaaagcctgagaagaagcttgatcaggcctctgacttacttaaggaaacagggctgcagggcagcacagccacaggcagccagaaggaaagggcaaaggcacagggatggagcagccagaggcgcccatggtgtcacaggcttccctctcccctatcggtgcttgctttcaactcctaacctcaagtgcgagccaccgcttttgcatcgaatgctggatttcctgcccggatctgtgtggcactgttggcagtggagtcctagcaggagacctgagtgctggggaaatggggttcctgccctggctccacttcttctaggggcgcgacttccattgggttactgaacttaccgcaatttcagagcttcttcaacaaaa

SEQ ID NO: 165286 - DNA, 387 bp, Homo sapiens
ccccacaccccaaacacttctccttagaataagtatagcaagcctcagcatacacaaatctcagagtgaacggaaatgtctctgcaggcccaagggtggggtctgagtagcgggggcgctgaggaagacaggcagtgacagagccaggacagggtcaaccctgagcgtgagtgagcccaggaaacggaaagagagcaacacagccacccacacaactaaaatcgacccacccgggtctccatgctgcaggaagtcactgtctaggtctcccaagacacattttcaggggaaggttccaggcagcaagagcagccctaggaaactttaatatacaatggaatctgggttaagcactatcttctccaagagttgagctcacaggacatt

SEQ ID NO: 165287 - DNA, 153 bp, Homo sapiens
ggaaactgaggcttggaggggcaaagggccttccaaggctgcagctggcgaggcgggggccagagagcgatgccagcactgtgttcaggccactccgcggccccagccccactggctctctggggccagttcctccctcccccagtggtttcc

SEQ ID NO: 165288 - DNA, 543 bp, Homo sapiens
agagtcgccgctgcttttttgctcatcactgtgtgctacaacccagcagagtgcctagtacacagcaggggctcaataaacattagatgaatgaatgaatatggggaggggaggggaggggaggagagaagaaaggtgatgaggggagagagaaggggccactactttgtatataaagaaatcagggctttgctctacccaaacacgccttatgatccaccagcgatctgatgaattctgaaaggcaccacatgcaatgcacagctgtaagtatagcagctgtcacgcaaaggagctgaggtccagaactatgaagaattcagccctttgtttttctctctgtctcataacgaaaatgaagtcaagcccactgtcaatctacctgtcggctctatgtattcaacatgcggctttcagcaatactaagttaacactgcctctgaatgacatttatgttgattcactctctgacatcactgcctgaaaagatattatttaaatgtttgaggtcacacataagacctaaacagaactgagttaatt

SEQ ID NO: 165289 - DNA, 458 bp, Homo sapiens
tgaagaaaaagtcttattgatactcgaaatttaaggaggaaaatggacagaattattggccttcatttaactgacagcaatagaataggggaacacaggtttttaccaactaatggtaagaaaagcatgttgaaagctttaaaattaaattccaatgaagccagattgaagtttcctagattacttcagattatagaacggtatccagaggagactttgagcctcatgacaaaagagatctcttccgttccctgctggcagttcatcagctggatcagccacatggtggccttactggacaaagaccaagccgttgctgttcagcactctgtggaagaaatcactgataactacccgcaggctattgtttatcccttcatcataagcacgcgataagctattccttcaaggatacttctactggtcataagaataataacgctcttgtggcaaggaag

SEQ ID NO: 165290 - DNA, 246 bp, Homo sapiens
tgaagaaaaagtcttattgatactcgaaatttaaggaggaaaatggacagaattattggccttcatttaactgacagcaatagaataggggaacacaggtttttaccaactaatggtaagaaaagcatgttgaaagctttaaaattaaattccaatgaagccagattgacgtccagggagataccagtcacgaacggtgtcggaacgacggagaaggaccaagagcgaagcactgacaaggtgagt

SEQ ID NO: 165291 - DNA, 210 bp, Homo sapiens
aaggagagtgggggaggatgtccaaggtgaatggggcagggcactgaaaaaaaaagttgaaggagtcaggggaagcaggaaagagttacagaaggaaaggaggatctcagggaagtctaggaggaaaaatagaatttcgaagaatttcttttagaatgaatacccggggaggggccgtaaatctcgcgccgggccgtacccggggagggg

SEQ ID NO: 165292 - DNA, 357 bp, Homo sapiens
ctcccaaactaaccagtggcacactcagacccagctctgggcctgggccaggctcagcacagacctgctttctcacgggttgaggtggggaggaattaatgaggccccaggaagtgggacagagagaggcctccggaaggaggcaacgtgaggtgcatccccagcagcttcagggagggtctgagctgggggcagctgagccctgagggagccccaggaagggccccctgccctcccctagctcccaggctgccatgtcaactctctgtcaatgccctgagtctggggacaaaagtccaggaatcctgtgccctgttgggctgatctttttatcaacagtaaaatccactacgaata

SEQ ID NO: 165293 - DNA, 469 bp, Homo sapiens
actgcactccagcctgggtgacagagaaagaccctgtctcaaaaaaagaaaaagaaaaatgcagattctgattcagtaggtctggggttggtcctgaagcactgcatttctaacaggcccccaggtgatgctgctgctgctacactggaccaaactttgagtggagagcctgcaaagattgcttaatttcctccctttcacatttctccctattacctctccctccttccctgagggcttaatctcttaggccatccttatcatcatttaccacttttgccgtctgcttcctcccaaaaaataaataaataaataaataataaaataaaattttaatggcaaaaaaagaagttgtaaatctcaataaaattatgtgagaacaaaaaaaaaagcaaacatgctcaaactgctgcaccttgaaccaactatagacgtcagttcatccattcattcagcagttattgagctc

SEQ ID NO: 165294 - DNA, 197 bp, Homo sapiens
tcggtcttgaggtcccacacgtacgcttcggcaaacattaaaatgagttgttacagaacatttgtgtagattccaatcttcagtgtcaagagagcatcattctgctgtaatagtatcttttcatgaaagcacttcaaggcagtcataaataagagccagtgaaaggaatgacaacgtcaaaatggaaactgagtcag

SEQ ID NO: 165295 - DNA, 857 bp, Homo sapiens
tctctctcacgtcaccaatcaacacagaactgttaagatgaccttgttacagcccagtttcatagtcactttgggtttaactgaagagctcttgatctctgggaacttctaagaacatgaaactaatactccagaaactattactttcataattaaattctatactgggtagtgccaactaatctacggtgtcacatacaatagcttctctaaaaatactggtgcatactagtggtgtacataaagaattccagaggggatcagagaaagagaatgagtttatggaatgaggaaatctgaaaatgttctaacaagtgagtagagcttcaataagatatgaaaaaagggtgggaatttaaccccagggaagagtagggagagtggttgggactggaaggaatcaaaagtgactgactccagccaggtcaccgttattaccctcattatctcccagacattgctcagtcattcacatgccttggaattccttcccaacccaacagctagctcaaggcaaaagtcagatcccacctcctcaaatcctccatgatatttgccgttaatttcagtaagagttaactttctcccaatcttaatattctgaagtataagtaataaacatgcaacaatcttttgcaagattggagagtaactacttcctccagtgcgattgcgctaggaccaatgggtttatatgcccattgcgcagtaacagaccaattccactgagacagaagtggcagagaaagagaaatgattgcaggacaccaagtgaggagatgggagaagatcctcaaatttatctccccaaggagttctgggctgggttttttaggagatcatggagggtaaggggc

SEQ ID NO: 165296 - DNA, 94 bp, Homo sapiens
taaaaaaatgtccaggatgagtgttttggcttggtatgctcactgaatttaaaagaaaatagagccagtagagaatttcagattgtgctctcca

SEQ ID NO: 165297 - DNA, 594 bp, Homo sapiens
ctgaacctctaacaagctctgtaatcttaggcaagcaaattaacctctctaagccttaactgtaaaaattaggataatgatagttctgtactcagaaggaagttgtgagcattaaacaagatgattcctgtcaagttcttagcatagtgcctggcacagggatgcatcataaatataaaattctttagctgtcagcatcaatttcttctccatcattcctcacatatgttggagtgcacagtactatgtagacgctgctttcctgtctttaagacggatccgaatgcttgcctttcgcagatgaagatgtatgttgcagaggtggatgctgtaaaaatgggactagattagaagccctttctgtaaccttgactgaagaaaatacaaggtgacattgtttaaaggctctatcacttgcctttgtctagggctgctgttctcttctgcacatagtttgcggtcatgagtgtggcctttttactcctaaaatggcacaatgtgtcttcaaatctcaacagatgcattgtatttcaactctatcatgaaaggtagcttttgccattttttcctttttgtcaccaccatcatccattt

SEQ ID NO: 165298 - DNA, 457 bp, Homo sapiens
ctgaacctctaacaagctctgtaatcttaggcaagcaaattaacctctctaagccttaactgtaaaaattaggataatgatagttctgtactcagaaggaagttgtgagcattaaacaagatgattcctgtcaagttcttagcatagtgcctggcacagggatgcatcataaatataaaattctttagctgtcagcatcaatttcttctccatcattcctcacatatgttggagtgcacagtactatgtagacgctgctttcctgtctttaagacggatccgaatgcttgcctttcgcagatgaagatgtatgttgcagaggtggatgctgtaaaaatgggactagattagaagccctttctgtaaccttgactgaagaaaatacaaggtgacagaaagggcttctaatctagtcccatttatacagcatccacctctgcaacatacatcgtcgacc

SEQ ID NO: 165299 - DNA, 436 bp, Homo sapiens
aacctccacttctgaggctcaagcgattctcctgcctcagcctcccaagtagctgggattacaggcacgcgccaccatgcccagctaattttggtatttttggtagacacgaggttttgccatgttggccaggctggtctcaaactcctaacctcaggtgattcactcgcctcagccccccaaagtgctgggattgcaggtgtaagacactgctcctggcctgttcttgtttttctatgagaatctggaacgtctgcaagtttcattacgcttgctccctgtttccaagaggcttgtatgcaggcatctcctaaactctcccacccagcaaactggagaagctaagcacactcattcctccttccttttctttgggatctgcctgcctgcagggagcatgtgttcttggctgtatttttcttgtcgtaagcttaga

SEQ ID NO: 165300 - DNA, 472 bp, Homo sapiens
tgagttaaagaaaccacggctgcctagcttcaagggataagaacaacaaatacaataacattcaaatacaagacagcctttaaagagataagagattataaatttattttataactgcaaagggcagaagtagatctcatgtggtggaatgaaaatagttctgtataaaaaactattgaataatgagatatatctagcaaatggaaggggctaatcttgaaaataatgctagtgaagacaggaagcagagaacttgacattcatgtttgtaaaaaaaaatcatgggggagatagtgggtcaagttggagggggcctgagaaaaattcccgtggaatgtgatagtcctttatttatcttccaattcccatgcacccttgtatatatcacttcttcgtgtttttgactcctaactgctacagctgatagagaattccaatctcatgctcctattgtaacgcattccccgttctc

SEQ ID NO: 165301 - DNA, 129 bp, Homo sapiens
aaaactgaaactccttctattaagttccaattagaatttcatgaagcactaatgagagagaatgaaggaagggtattaaacaacataatacggtctttctaagcacagctgataccatgcccttaatat

SEQ ID NO: 165302 - DNA, 687 bp, Homo sapiens
accttgtgatctgcctgcctcagcctcccaaagtgctgggattacaggcgtgagccactgcacccagcccaactgtacactcttaagtggttaaaaatgagttcagaaaatccaatatctgattaatacaaattccttaaaagaaaatagaggagatgggggaggagggaattagcaaagaagttatataagaaaatttcccagaaatgaaagattgtatccttggattggaagggactggcacaataattttaaaaaggcctgtataaattacctccttgtgcagctgcagcacgttggtaatgcagaggacatcaacccctgtagcgggaaacctgggtcacaataaaaggatcaggaatcagagcagtagacgcctcagcggcagctccgatgtaaaaaaaaggtggggcgcggcatcccagatctgtagaggaactgattttgattgtctacttcaaatttttagttttatctttattcaagttacttatgcatacaatttgaatattcaaatgattctgtaagtcttttttttaatagcaaaccctatgaacccctctaattttcaaggcaaacattgttttagctgtttcatttggtatttatctgtgtgtctttaaattccgtggttttaggcattctctgctgattcttccctaagcctggtgggtgagtctgggccct

SEQ ID NO: 165303 - DNA, 420 bp, Homo sapiens
ctactgaaggagctgaaatttgcaggatgcctagaaaaaaggcagacataagcaaagtaaatttggaggctaataaagacttagataacaatatgaataatggaaatccttgggtttgaagaagatgccgtgattgagtttatattcaaccaggtggaagtggagacctgaaccaaaatggaagttattccttgcatctcaagtataacatcatcattgtattaggtctcagcaaaatgaacatcccaatgtcacactgcactcccttatgtgtttggaaaatccagactccaaaatgatacaaagcaatctgactgggtttttgaatgaaattactagagaattatgggagaactgtagtccctgctgttaaacgcacaagaagacatcactggaatctcttctgctttcctagaactg

SEQ ID NO: 165304 - DNA, 368 bp, Homo sapiens
gtatcatcactactatataaatgtattcctcaaatggcatttgacggttccctcaagtaaaaatgagtgttatctctttcttacaaacaggtatacagatatggggcaaaaaagcgagttgggtattcaaacactggggtactaagcctaacttggctttgatgttattggataatcttgagcaaatcataatgccaatcatattgatcacttaatatatgccacacaattttctaattcctttttgtatggaggtaggtccttttactgtccctattttaggggacaaagctgaggctcagaggaggtaagaaacttgtctaaacagagaagtggcagagccagatttagatccagggttgtctgac

SEQ ID NO: 165305 - DNA, 588 bp, Homo sapiens
caggatggtctcgatctcctgaggcctcccaaagtgctgggattacaggcatgagccaccgcgcccagccttaacacatcgtttttaaacaccactatgtgccacacaccctgctacagcatgtacctaagtaagatgttcaagataaatccctgtcctagggttgtttataatcttgtggggaaggcagctaaacaaatacttgcacaaataactacttagtcataattgaaagcgctaccaaggaaaaggtaaggaatcatctttgacgctttctcctcctgcattgaatcaccaggtgctgttaattctaactccgaagtctccagattgtcctcttctctccacttcactgctatcagtatctcaacttagactaccgaaataccttcctaactggctcccctgtgtctatccttgcccccacagtctatttaccatgctagatccatagtgatcttttaaaaatgcaattctgcgtgtcaccttcctgcttaaaacacttcattggttttctattgcccttgggataaagtctacacttcttaccatggcttgagaggccctctatgtcctggtccctccttg

SEQ ID NO: 165306 - DNA, 619 bp, Homo sapiens
attatgcttttggagtgtaactgaaacatttctgggattggagttaatatgctaaaaattaagaggcaagaaaataaagcagtagtttgtttagaataaaattcagcttaatctttggctgtcctgactacggcccatcatcagtgtttggaattttcccaccgtgttatgtagtgcagtgctgtggctttaaagaagcacttccccctgttgccctggagccccatgccctggttctgggaggtaatcacgattgtgtactgttactatattgtgtcagccctctctgcctgctgctttcatctttcttaagttatgcagcacaaatcttagaatgtttctctattttttctaattaaaatactttctatcctaaaacaattgaggaccattctcctagaaggttgctcacccagtctctggcgtgtcagcgcagctaatgacgcacctggcccacgaattcacttacagttggtttttgatgcatgaatggtagcaatactaggttacttttattttggcctttaaagtttgcagagatctttggtacacatgattccatttaatccttacaggattcctgtgacattagttattattcctattttaagatgagaaa

SEQ ID NO: 165307 - DNA, 343 bp, Homo sapiens
actccaaacccctcattcatcccattaataattcctttaaatagaatgattttttggctgggcacagtggctcacacctgtaatcccaacactttgggaggctgaaggggaaggatcgcttgagcccaggagtttgtgatcatcctgggcaatgtgagaccccatctctacaaaaaataaaataattagccaggcatggtggcatgcacctgtggtcccagctactcaggaggctgagttgagagaattgcatgagcccaggtgtttgaggcttgcagtgatccgccatgctgtgcccctgcactccagcctgggtgacagagtgagaccctgtctcaaaaaa

SEQ ID NO: 165308 - DNA, 172 bp, Homo sapiens
  misc_feature (23)..(23): n is a, c, g, or t
gtgactctagacgatcccctttntccacactggctaggcctggacacggttgcagaacgtgtctcctccccatgtcgctctgtgaccgaggggtgcgcatggcatgaccgctcactcactcctgcctggaagtgaagggctgctaggtggaggtcagcaaggatgttgagtg

SEQ ID NO: 165309 - DNA, 407 bp, Homo sapiens
ggacagaggggaagaagagttgaagaaaatgggacaaattagaagagcaactttcatctcacaggatagtgatctaaggagtcaggatttccttctttcctcttcaggaaagaggattcggctttaaaggatgagatccagggtggactgaaggaaagggatgaaacagtagaagaggtgaagggagttcaagatgaacaaagccagggggagccaggggaagtctggtggaagggaaaactcgctaaggcggtctttaacctcacttgcttccaggctgctgccctgccccatgtccccattcatcccataacatcaggatgtgttgtgggctctgcctggagtggttctgagagaacctcagaaacaaaggcctgaggagtttggggtggctcctgggaaggtat

SEQ ID NO: 165310 - DNA, 513 bp, Homo sapiens
aatatcagccaggcctgacctagatctgctgagtgtagcccaaactgccaaaccagagtcacagtctaaataagtgctcatagcagcattgtttacaatagcaaaatggtggcagcaacccaagcgtccatcaaaggatgaatggttaaacagtatgtggtatctacatacagtggaatattagccagccttaaaaaggagggaaatcctgatgcatgctaccatgtgggtgaaccttaaggacattatgctaggtgaaataaagccattcacaggacaaatattgcataattccacttataagagggtctaaaatagtcaaactcatagagacagaaagtagaatggtggttgccggggatgagtggaggggaggtggggagtggttgtttaatgggtgtggagtttccgtttgtgaagatgaaaaggattccagaggattgcccaacagtgtgaatatacttaacacaactgaactggacactttaaaatgggtacattttaccacaacta

SEQ ID NO: 165311 - DNA, 437 bp, Homo sapiens
tattttacccagtcccaaggatttcccctaacatttgcatacgagctagtgttcacaggattcactgtatgatgcattatggcagtaagaatacagtgtttgactgttatcaccagaagctaaaataaaccactctagagttggagggaaaaggtcttattttttgttttgttgcctttttaaccccattgcgtgatttctttgagaagaggtcattttaaagttctcctgcacagcctgatggacacgcgctaatgtgtgcagctggctttgtgatttgctattgttcttctaaccacatggtgtagctgtggatggctgggaagagccaagcaggctgtaatcatgtggaagggtgcatgtgtgcatggtgcatatgtgcatggtgcatgtgttcatggtgtgtgtgtatgtgtgtgtgtgtgtgtaagggtgga

SEQ ID NO: 165312 - DNA, 220 bp, Homo sapiens
actcatgaacatgtgcagatgggaccaggactgctctcagccaatgactagtctccatggcttggagagaggcctttgccatcgtacccaggggctgggttccaacactttcctgggcattcaccagggcccgtggataccatgtgtcaccacactgacccattttaccgatgaggaaacagaagctcaggaaaataatgttgcttgaggccatttaatt

SEQ ID NO: 165313 - DNA, 477 bp, Homo sapiens
aaggactctgtccattgggtatctgcagagcaggaatagaagggaagattccctgtcatggtgtcagacagagagaaggatttttagaaatagagcagcccatatgactgatgtcccaaactatagatcgctggctaatctcatcatttgttggtgtccctaagcagagttttaaaacttctataaatctagactataaaggtatctactggttgatgtgggaatgagaggtagaaagaggggaaatctaaaagtatcaacagataaagactaaaatgaatatgcaaaaaataaaatagttgttggagttttctattttccaaacttctataatcttacaacttttataatttaaaaataaagaattcagataaaaaattttaaaattagaaataagaaaaatgtgaacaaatgttaatgtaccttaatttaaatgtcaaaaatataacatattaaattagaagatacgtaatatac

SEQ ID NO: 165314 - DNA, 282 bp, Homo sapiens
aactccagatgtcattcaataaatatctattgagagcccaccatatttcagacactgcactagggatacagcagtaaaatacagtcttgtcctcatggatttacacaaactgaatgtcattggtatcaaccataaaaataaagacaacaaacaaaacaaaaacccttacttctcctgactttcccaatccaacaatccaatcagtagctaagtccttttattctcctctcaaacagctttcttattccttcctatccatcatacctgaggcttcaccaagaa

SEQ ID NO: 165315 - DNA, 551 bp, Homo sapiens
aagcttcttcaccctccctgggaagaggctgccctgagcttgctccaggcttcctggggtcctcgttaacaggcatgaaagtgctgctccccccccaccatgccctcatggctgagtgctgcatcagggcagagcttgtgtgaggctgaatgagaagtttggtgttagatttagggaatggggggccatggcaggatgccagggaagaacctgtgtatgtgtgcagctgtgtgagagctccagaatttctgcagggaacttggacagctaggggttacatctgcataggaagcaccctgtctttgcttagagtgtgtattccaaataacaaaaaatagcaagtttaataaagttgcttttgtgcacagtatgtataacatccagaaaaggtcaatggcctattactcaagagaaataattacacaaataagtcaaatgagaaggatgaaataaggccaggcgcagtggctcatgcctgtaatctcggcacttcgggaggccgaggcaggcagatcacctaaggttaggagtttgagacctggtgaaaccct

SEQ ID NO: 165316 - DNA, 622 bp, Homo sapiens
gaaaacaggcccagaatggaggggaatcaactaatgatggaacaaaaggtctatctagctattgtagtagcagtagagcatcactaagtatttcaatactttgtcaattataagagaatgtaagaatgaagaggatttcatctttatggctggaacagttgttagttgatctactatttgcatagttgaagagaaccaagcacataaaatcttgtgagtggtatagttgatcaaaagcagacctgctcccagaagttatgactccagaccattgatgctcacacccaggtagaaagggtagcatgtgaagaagacaggggccttataggtggagagaagcttgcaggtacatgatgtttgccacagttcacatttggctgagataatggggataaaagtatgatttttcaaagtgctctgtggccttttccatcattgcaaagtagtggaggcttagggttttgtccataagagcaatttaaaattacttcaaatttctgcaactctatagtattaacacatttaaagtagatacagaaataaaaatgtgcatgacccttcatcaaggattctttttattataatttataatttcatccagatggccaataatagaatatag

SEQ ID NO: 165317 - DNA, 517 bp, Homo sapiens
gagattaaaataataaataactatgcccccaaaagaatgtataaagatatgtaaacttgtatccagcttataaatactaaactaaacatcactgagcatttggaagagcagaattgatactgcagaacacaaagtcaggaattctaaactaatatagaaattccagttatataaataggtgtattataggtctagaatcacaagtctacaaaaagaaaaagagtatctaatttagaaataagaaggataagaaagaaaagataaaatgtcagaactgtacaaatcatgatcagaaaaaaaaaattttcaaagaaaacgatgccttcagcctggttaacaagagagggcatagagcatttctcagcaattatccttaaagaatgaccccagacatttatttgtcaagttttaaacttttaaagacaagatcttacattctgttaagaagaaaggtggtgtaatatatgaatgcccttgacctcatttctcagatctctaagaaaggagaagctaaaaa

SEQ ID NO: 165318 - DNA, 202 bp, Homo sapiens
ttggttctctggtgacacagaaccccctgtagtctctggaatgcatgagctatttcacctccaggtctttgcatatgctgtcccttctgaactttctccttgctatctccgtggccaaatcctatccagtcttcaaaacccagctcaacacccaggacctatacacccactggtctcgatctgtttttactggccattcatg

SEQ ID NO: 165319 - DNA, 215 bp, Homo sapiens
ggctactctgaggcttttctttagcatacttcctgattctttgctgttttagaaaaatgagattcgattttgatactgatttatggataggttatttggcaatgattattagtgtgtgatgcaaataatttcaaagatttgttcttaataacagctatgctcactgtagatgacgcaataaaaaccgtgattggtagatctggttgctgatactc

SEQ ID NO: 165320 - DNA, 329 bp, Homo sapiens
cagaataacactttttaaaagagatataaatctactcaagtaatctccctgcttaaatcttcccatgtaaagaccggaccccttaatatgactaaccaggcactgcatagtctgattcttgcttacttctgcaaagtagtcttacttcttgcttacttctttagtgttatcttatattttattgcctcttgttctctgttcactagctacactggtctgagagttcttctgaggtaccatcattggggctttttatcctgttccctgatatatcctgtataattcttattctttcaactcaaacatttcttcatggaagctgtcctttt

SEQ ID NO: 165321 - DNA, 403 bp, Homo sapiens
aatgtgtagtccattttcatgtttataaggcagggatttgaattatatcctataaggtttatcccagagagcaagaatcttcatttcaatgtagctttattctgatttaatgaactcagcgatgtgggtgttctctggaatctagtctgtcctttgcaaaatcagggtcctgccctcgtgcctttgagcccacatgtgtccagggatgatctaagtgacaaagtacttcgtccctaggctgtgcaagtaataatgtgattaaatagttgttggaggtcacttcttccaagttgagtatggactattggcagattttattttttgcttgtcacttaaaactggctaaggtagataagctttgcacgaatgtaattcaaaatacactgtatacatatgtgtgtat

SEQ ID NO: 165322 - DNA, 305 bp, Homo sapiens
tcctgagttcaagcgattctcctgccaaagcgtacaccaagtaccaatgtctaccaggctggtctcaaactcctgacctcaggtgatcctcccaccttggcctcccaaagtgttgagattacaggcatgagtgaccacgcccagccctgcacttaaagcttttacttctctccaggggcctgcacatgcaagtctattcacccctacctcctctcctcaacctatatcctcttccctcacttgcctggtttatgcctactctgtctttgggtactacgctttggcatcagttccagtaggaagtc

SEQ ID NO: 165323 - DNA, 203 bp, Homo sapiens
gaattgggaaagagaaaagaagcatctcaaattttgctgggagatataaatccaaagtttgtgtcagggcctataagggcttattagatttggtctcagcctgcctccacctccttgaaccttaaccttcttccagcttctgtaggtcctatgccctttgctggaaacatcactctccccattctgtacgtcactcactccaa

SEQ ID NO: 165324 - DNA, 247 bp, Homo sapiens
attctgcactgggtgctgaagaaggatggctcttatctgcaatggcgggcagaagctggcggatgggagagggtggggattttggccccgtggcttccccactccccaggtctgaccagcaacctccagcagagaaggcaccatgtccactcaggggccacacagtggtgcttcatacatgtgccactgacttagtcccaacccccctccaggacacctgaaggtgccaagtgtgacctgggctcct

SEQ ID NO: 165325 - DNA, 464 bp, Homo sapiens
ccaccgcacctggcctctaagagtgctttttcctagcatacttttcttctcctaaggtaaaaggctgtttgtcatggtacagctacggtgattttacttgagatatttgactttgagatggagatgaagataagtatataatgcagctgccacattcattctcatacaaggtaaagtcattcaaaagataaatcgaagaactatagatgtatttaagaagaaattcagcctatatgtaacaacaaaattttgaataatcaagttcagaaattggatttttaaaaacttattagctactttaacccttttgaaatattcccaaaaagtgttttctcttcctgagttaaatttattcgtttattgacctattaaagatttttttagtgcttcagagctattctgtatatctgttcattttcgttatttagtagtatatagaagtaatagattgggctgaatagatt

SEQ ID NO: 165326 - DNA, 284 bp, Homo sapiens
gaggtcgaatcttggtgatgggacttgggttccagagtggggtgaaagaaccaagacagtaggcacccacctgtcctgcacacatctgtggtttcatgttgactgcattttgggaggagctggcccccacctcgtcatgagttacaggcaagtggccctgttgagtccagagtggggagaggcaggcacagtggactctggctcgagacctaggatggcatcctactgtggctggcatgctgtgtgaccttgagcagacagatcttccccgtctctggggctga

SEQ ID NO: 165327 - DNA, 558 bp, Homo sapiens
gtaaggctgggaatttgaggctgcaattagctataattgtgccactgcaattcagtatgggcaacagagggagtttttttatatctaaaaataaataaatagacaaacaaataagtaaataaataaggcattccactgtcttctgacttccattgttaacattgagaaatctcctgtaatttctggctaatctttcttttcatgtgttttaaatattttcagtcttctcctttagttatgtaaccatgttaaataaacttgtgttgtatcctgcacttgtaattttagtgtcttcttttttctgaacatttcattactgcagttttttttctgttttgatataagagagagggagagagagagagaagaaagagagagagagagtgagcactaatgtttttggaacattatcttggagaatatactgaaattttcatatgaagtaaatttatccagaagggagtttcttttgactctgtctagtgtctaaggatatataccaacactttgaatcatattagttttccttaaagctagaaagttctatgagccacatat

SEQ ID NO: 165328 - DNA, 309 bp, Homo sapiens
  misc_feature (286)..(286): n is a, c, g, or t
tggcatgggtgctccaagaggatcaggaggcccaaagaaagctgactagctgaggccactgtttatgacatcagaaacagagctgcaggctcgacatccaccaatgaggaattgggtagacactcaagaacactcaagaacgctggagaggccaggcacagtttattaataatataagattaaagcaaaaacaaccttttatcaagtgaatactaagatggtcagtctcaagaccaggaagcattttggctgtaccagaccagggatgtatctttgttggtctgtngacttcccaagtgctcatccatc

SEQ ID NO: 165329 - DNA, 302 bp, Homo sapiens
tggcatgggtgctccaagaggatcaggaggcccaaagaaagctgactagctgaggccactgtttatgacatcagaaacagagctgcaggctcgacatccaccaatgaggaattgggtagacactcaagaacactcaagaacgctggagaggccaggcacagtggctcatgcctgtaatcctagcactttgggaggatgaggtgggaggatttcttgagcccagcagtttgagatcagcttgggcaacagagcaagactctgtctctacaaaaaattaaaaaattagcagcacgtggtggcac

SEQ ID NO: 165330 - DNA, 489 bp, Homo sapiens
gagctgtggcccaaaggagcaccacgagacagggacagggtgtctaccccgcctccaccatcactcccaaggacagcagagtggtctcaagagaaggcccagcttggggggagtgcgtgctgtaagggaagtgttcaaagaagaggccgaccacagtgcggtgcgggtaggtcaggggtggcgggggttgtgtttactgaagacagttccagaaggctagggggtcggcggggagagttgatcaacttactaaaagtcagctcctactccatatttcaatccagaatccagaaaacaggccagaattcatttttcaggactttctgatttatttgttgttgtttggtgagaaaatgagcatgggttagggacccactgggacctgttttctcacctgggttagaggggctatgagacggcctactgagccccaggctctcaggagcctctgaacaccaggacatgtggtccaagaaagatgaaggaaca

SEQ ID NO: 165331 - DNA, 526 bp, Homo sapiens
attccggaaggcaatacaaaccagtcagagtagataggactttattctggatatgattgaaagccagtgaagatatttgagaagggaagtcaaatatgattatataaaaatattaatatagtggacatgtataatgtggatacgatgggggaaatagtgccgtcacataggagtctgttgtagtaattccggagtgttgtgatgaaggcttggactgaagtggtgacgagaagagacagagatataggtgatgtgtcctaattgaggaaatgaatataatttggtgacttattgaatgtataggacaaccatcagaaagagaaaggaagattaaaaatgtccctaaggatttcttggatactataaaaattacacttgattaatatgaacaaagttgtgtaataaaatattttcaggaatatttatgcaaagacgattaggacatgcttaatttatcaggaagtgataaactatggctatctctgaataaatcatgcatagtctagattatccacactgttagacg

SEQ ID NO: 165332 - DNA, 155 bp, Homo sapiens
cattgttgctattatttgctgttgatgttattgtcttttgcttagtggcttttctgatttaattctataaagtctgtattcttttcatatgtggtcactgaagtctctgctcatttatcttagtggtcagttaacatttaaacagaggtttcgtt

SEQ ID NO: 165333 - DNA, 531 bp, Homo sapiens
actctgttgcccaggctgctcttaaactcctggtctcaagcaatctgcccacctgggcctcccaaagtgctgggattacaggtgtgagccaccacgcctggccctctgttaatgtattaattataactctttgttttgttatttgagggattactttagggttttacaactcgttaagtaaaaggggatcatcataaatgtattggaggaggaagggttggtcttgctgtgtcaggggtagcagaggtacatcttgacttaccacagtttctttctttcttttttattttattctttactcctggcaagctgtgacacagttattttcaagagatgtaatatactacttcatgcgtaagaactgtacaattatataccttttttgccagtcccaattttatgcagttgttttcatacattttatgttcatatatgtaataaaattaataatacgttgttatttttatttaaatgaccacttaggttttaatgtgtacttaataaacagtaagcagtctcttctgttgaccc

SEQ ID NO: 165334 - DNA, 280 bp, Homo sapiens
tgccccccggccaaatctactttcttgcagaataaatggattgtgctcctccttggctctcttctgccccactgaagacacacttttcttctgtgcagcataagaaccctatgctgatgtttggcggctatgatacacatgcacactctcacttccccataaacttttgttagatatccatgtttcacaatgggtacctgagattgtgaagctggtgttgaacccttgaccagcaaggacttatccaacagggttttctaacatcacttaactgaagcca

SEQ ID NO: 165335 - DNA, 228 bp, Homo sapiens
tctggaatgttatttacttggtacatttctgtggctttttgtagcattgcacatgccagagccatttacttgaaaatgccaggttgcacagtttgtcttctcaacggggtgactttctcagttaggggagtttagttcctgtgtctctcagtttcttccttccttccttgtttttttttttcccctgagttagtgctctgaacaatactgttggtgcctgttgcatcg

SEQ ID NO: 165336 - DNA, 506 bp, Homo sapiens
ggcaattttaataaggtagactaggaaggtctgggtgaagaggtaacatttcaggcaaatttacatgaaaaaaaaagtgcaaagcaaatgtaaaggctttgagattggagtatttttagtgtgtttgaggaaccaaaaaggttaatgtggatggagcagagtgaatgagaaagcaagtagtaggaaatgagattgaagaggaaggtaaagccagctcttgtgcacccttgcaggccccagtaagaagtttggattttatgccgagtggaatggaatgactttagtgggtttcccctaattttcacctctaatcaattaataatgactgcttagttcactgtgatgagaaagattctgaggctttacagttcaatggataaaagtccattgatggattaataatatacatcatgtctgtagcatgaggcagtggtaacactgatgattaatatttgacatctctgatcatgatggaagattaaattgtatttgtcaaagtactctga

SEQ ID NO: 165337 - DNA, 351 bp, Homo sapiens
tggtacgcaatagatacggattgctccacagttctggggtctggggagatcaaggccctggcagatgaggcatctggtgagggcccactttctggttcatagacagcaccttcttgctgtgtcttcacttggtggaagggtgaggggtctctctcaggcctcttttaaaagggcactaatcccactcacaggggtggggcccccaagacctaatcacctcccaaaggtaccttggtagttagttaggatttcaacagatgaatttggggaggacatgaagattcagaccacagcagatctctattttccctttatagagaaagtaattcaagacaaggagatgcttacaag

SEQ ID NO: 165338 - DNA, 209 bp, Homo sapiens
tggcctccagtctcccttgttaatcctccccaggccccagagctggccctgcactttccttcttcacagccctcctgtggctccccagccgccctgggagaaggtccaagcccctcagccaagcactcaaggctctgtgtgatctgagccccgggtcatggctacggcgttggagtccgcagagcactcagaacctccccaggcctcca

SEQ ID NO: 165339 - DNA, 406 bp, Homo sapiens
cagtgactgacgtggactctccccagtgactgacgtggactctccccagtgactgacgtggactctccccagtgactgacgtggactctccccagtgactgacgtggactctctccagtgactgacgtggactctccccagtgactgacgtggactctccccagtgactgacgtggactctccccagtgacggcatttacctagagaatctgctccgatataaggctggctaatttctggatggtgcactctgagcaggttgaatctgtaaacttcactcttgagccttggcctagtgaatctgggacttttgggtgttctctcctgtccagcacagcacagtgaggggagctgacttggttgtcacaggaccctacttgtcatcctgagcagccactatttgatt

SEQ ID NO: 165340 - DNA, 1007 bp, Homo sapiens
ctttcccatgttgtctgtctataagagaaaaattaccctctgtaatttaattttctcctggcatccccatggtataattcatcgaaattttgttgtggggtccagaagggctgtattggaatcttggttcttctacttgctagttttgtgactttgggacccctctgagccttggttcctcctttgtaacacactcatcttacatcatggtgagccaaatcccatagaatgacatctgtaccatgtagcccagtgtctcatacacatccaataagtgtgggctctctttcttccccatcacagaaactcactctgaacatgcttccaattgttaccattgatgatttatttatgtttgagtctgggaaggtgtttcttgaaatctgatagcaatgacaatgacaactgagttcatcatatggagtgattactgtggaccaggcactatcctaactgctttacttatatggttctttatgatagctccatggggaagcaatattgttatccagtattgtcagatgaagagactgaggcacagaaaggttataaatcctgcctaagtttatacagctgataagtggggagccagggactctggctccagagtcccacggtattaacagagcttgtctattgcccacacttcagccagatagaaggtcgggggaacagcagttaactagtagtgccatgccaagccactacaatttcaacctgaagcaaaagaaacttggtcttcaagatagtctgtggaggtcacattattgacaagtatatgatttcccataccttttggaatattgaaaatacctctaggtacccttctctcactgcctttactactttcccagacccttttgggtccacaggtctgaggttgaaaatcctaatgtaacctaaatttctcctgaaaaggaactcagagagatcaagtgagttttttgctcccttgccccatactgagattgtagtatatgaggaaaatggcagttataataaaaata

SEQ ID NO: 165341 - DNA, 465 bp, Homo sapiens
tcctgaggcagtgtgtgagctgtggttaaaagcttggactctgggccaggtgggtggctcacacctgcaatcccagcattttgggaggctaaggcgggtggatcacttgaggccaggagtttgaggccagcctggccaacatggtgaaaccctgtctctacaaaaaatacaaaaaaaaaaaaaaattagccaggcatggtggcttgcgcctgtagtcccagatactcaggacgctgaggcagagaatggctcgaacctgggaggcggaagttgcagtgagccaagatggtgcaactgcactccagcctgggcgacagagtgagactctgtgtccataaaacaaacaaacaaaaagcttggaattgagccagactgcctgaacttgaatcccaacttccacatttactagctgtgtgaccttgggtaagttactaatcctctcagtacctcaatttcctcacttgc

SEQ ID NO: 165342 - DNA, 153 bp, Homo sapiens
ttcttcatggggagggttaaagtgttgattatagactttggcttaattatacattttaaaatttgagataaacagtagaagaataaaagagatatttaatttttatatgagcagaagaagaaaatcagggtgaagtatttgattcaaaataag

SEQ ID NO: 165343 - DNA, 433 bp, Homo sapiens
aaagggaactcctttcctattctgctctttcttctttctttcttgagtctattaatagcactatgaaatcccatttccaaggacaagccttctggctacatgaaatgagaaagctgtcatcccatacacaccgtttaatccttgttacacaaatggtgcctgtccagatgcccggatatcatttattttttgctgatggactggtatcttgcatacatttgtttggtgatttctttttcttttctttttttttttttttgagatggagtctcgctgttgcccaggctggagtgcaatggcacaatctcggctcactgcaacctccgcctcctgggttcaagcgattctcctgtctccacctcccgagtagctgggactacaggcgtgagccaccatgcctggctaatttttgtattttttttttttttttttt

SEQ ID NO: 165344 - DNA, 214 bp, Homo sapiens
caagaaaacctgacgtaaacataatgtttttaacttttgttgtgctgacttctctcactcccctatggagtggaaatgcctgtgtgagatccataggtgcttttcctcctcaacagttccaccatgccatattcacattaggatatgattctcctgctaaatcatctgtacatcagatgtacacatcaattgtgggccctaggtgcttatctgc

SEQ ID NO: 165345 - DNA, 477 bp, Homo sapiens
acaacgtttctccattgtttcgtatgtcggctaggtctgagggacgggacggaagcccccggggctggggctcactcactctgttcttcatgtaacgcattcacaccatgtgtatgagcattcagcttggcgggtggagcagttcggcattacttgctggaaataattcagagcacttatgaccaggctttggaacccaagccaagtgttctcgagcacatccgtacggggaacaaaagttttgttttgtccccatcgttccctcacccgcttcggatggggaaatatttgaaaaacggaagtgcctataatattctgcttgtgctaccaaagttctaatggtgtttacctgaaatgtttctatcattcccaaactttcagggtttctgttggtgattggcgaggaacagattgcactttcctgaactgaaatctaatgaatgccacaaagtgaaaataaactggagacacttcaaa

SEQ ID NO: 165346 - DNA, 272 bp, Homo sapiens
tcaatcttcctacctcagcctcccaaagtgttgggcttacaggtgtgagccactgtgcctagcctcatacttttcttataattaccccatacagtataattacctcttataaaagttgttaattttgccatgagcttttcattaaaaatttatgatttgatcaacttcatttgatttcaaattatcactaaaatgtgtgctttttgcattaaataggcatgtaattcttccttttattcagttccaatccacgttgacctgtgattataaac

SEQ ID NO: 165347 - DNA, 216 bp, Homo sapiens
ccaactgctgaagggtgtaatatcacatggccacaggataagctggggagagaatgaggaaggggcaatttcccaacccaaattccccaaggtcctgaaaaattatactccccagaaagtgtttgctttacactttgctgaaatctgttacgtaacagtggagaaaatgtgtggggtgatcttttccctgcacttcagccggggaggggggtgaga

SEQ ID NO: 165348 - DNA, 515 bp, Homo sapiens
tcactaggccataggaatttctcagctccattaccttatgagactaccatcaaatatgtggtctgttgttgaccaaaacataattatgtggcacatgactgcacataccgagacatattgcattcctattatatttttcctttagtctaaaggtaataaatttctttttgtgtaagtggcagatgattaggatattactttttaattttatacacacacatgatctgttttatttccttgtaaggaaaagtcaagctctatggtctagagagaagagaacaggccttaagactaggatctcatccctgagcagctagcaactgaagatgagagagaaggatatttttaaagacacccctctagcatgtctaatggtcaaggattgcagtgtttctgacagaacacttctgttctgagaggctcagactccttagccctatggacagggtttaatacttcatcttgttaactttggtctgcagttctggtctggtagggttcctttgattcatgat

SEQ ID NO: 165349 - DNA, 450 bp, Homo sapiens
tgtcaagctgcttcacttgagtgtctaacaggcatattaaacttagtgtgttcaaaaccaaagtcttaattttctcccccaactcattccttacccagtactccctatatgagcaaatgcctatatgagcaaaagtccctttcttatagttgctcaagtcacaagcttggtataatccatgaattttgtttctttctcttccatctctcagccattactaaattctgttctacttgcaaaatatatctggaatctagatatcaatttctcatgcccccactccagtgatcccctcctcagcctgagtcatcatcactctcttctgagactattgcagtagctgtaagactcagctccctgctttcccctgtgcccccaacagtcttttctctgcacaacagccaccctaaccccctttcactcagaataaaacccaaagtccttgccatg

SEQ ID NO: 165350 - DNA, 357 bp, Homo sapiens
aattttacagaatatcaaattactcagggggggtttcagctattatgcttgagaattcaagtgatgaattcccttaaagttgaggtgtcatctagacagaagagacaaagtatatattcataattactggaggtcttatgttggcacagtgagctgctatgagttttatagtgcccaaataagtattgcaacaaaataaagctcatgctggcttctttccttgttttctatgactttcttcctatgctgctgaccactattagatcactttcattctcactgaatttcaatgcatatagccaccatttctcagggtttacaatgtataaggaatggggctaacagtgtacgtctagt

SEQ ID NO: 165351 - DNA, 420 bp, Homo sapiens
ttctgatccttttcagtcgtatgtggcagaagctctgttccaggcagtcatgtccaagaaaactgagactcccttaccccattcagtgcctgcttgtaggataaatgctttacttaaggcatggcaggctgagaatattgggctctgattatccccaacctggcttgctcacagggtggacattatatgtcagggagtgcaatctgaaaaaatcagagtttgatcccacacacccaacaccagcacctgctcttaaggcagggatataattttgggagaagttagctgctgtcctccctctatctcctgaacagtaacatagatgttctgtccagatggagagagaaggtgtgaggatgctgtgctcagcagttgtgcttgaagggaccaactttctttggaccagaccgtgctgtgcct

SEQ ID NO: 165352 - DNA, 285 bp, Homo sapiens
agttaaagaacaatggagttgaaaaaagatttagaaattatctcatgtaacgattcctgatctaggttcttcaggcactcaaaaataaatggataagcaagtactagtggttcatgaactattttcaatacttataaaattatcatagaaactgtaactaaagagaatgcacaggttaactgaattgtcaattttagcagcatttgattggaattatatcacctctgtggcaaagcttggcatttcttcttattggccaattaactttctatgtaataagatttg

SEQ ID NO: 165353 - DNA, 359 bp, Homo sapiens
ggttgctgtttcagttcaccgtgattggaaccagctgcattcctgcctgtagacttttgagaaaagttgaatggttagatcttagaagctcctccttcttccctgcatctcatgaaaaatattaaggcataggagcttgtcaaaagtcttcagattattttgtgtggttttattgttactctgcaataatgtaaccagagaacagctactccttgtggttaaaagtattctcattgtaatcccagtgctttggaaggccaaggtggaaggatcccttgtgcccaggagtttaaggctgcagtgagctaagattgcaccactgttctccagtctgggcaacagagggagaccctgtctca

SEQ ID NO: 165354 - DNA, 200 bp, Homo sapiens
gcagtttcagttggtctttatggaaggacacacagcatttcactgaagcttgagggatctgccaggttcaagtgtaaaggggcattagtttcaacttagagcagctcccccagctacaaatgctgataaaatagctcagaagtgcaagagcctggttactttcagtaattttaggatttagtatctggatctgaattttg

SEQ ID NO: 165355 - DNA, 99 bp, Homo sapiens
gcatgactctcaggctgcacaaacctttttgccaaacaccaatacgtgggactcaggtcagacagactatgaccactggcccattgcaaaatgaggaaa

SEQ ID NO: 165356 - DNA, 588 bp, Homo sapiens
tgtaaatgtcaggcaacttatgtccccacaaaggaaagagtcattttagcagtctatttgccaaacatttctgttggtgtgttaagctcagttcagctataagagggaactgtactaactggctgtcatcacttattccactgtaattttatagcttaactagacctctaactaacaacccaaaactctaaacacggaactgtttcctttcaataaacacacacggtcacacgcagacacacaccaaataatcctctagaagaaggaatatatactaaaaagtgagatgtctgtctgcctaaaatgcatgattttacttaaaatgttataagttaagttgcccgccaatcgattcgattggcgggcaacttatgatcatacaaggaaatgtacagaccagctactgctcttgggtcaaacagacagagctgtgcagttgctggtggcaacatagggccgagaacccgcattagtactgtgaatcactcaaatgcctctttcaatcattactgtcaacctcatcaggccctctactcagagcaccaataagttcccacaccaatcgaagggatcctcagatcactacag

SEQ ID NO: 165357 - DNA, 345 bp, Homo sapiens
aggtgatctagaggatcccgaacgcgtcaaatcgaagattactgagacttttaaaaatcgtgttaagtcttctgagtgacccttcagaggcattcttcatttctgttactgtgtttctaatgtctagcttttccttttgatcttttcttagctctttcatcgctccacttacatcacccctctgttcttgcatgttatctactttttctattagagcccttaacatatgaatcatagctaccgaaattccctgtgtgataattccaaaatctgcgtcacatcttcgattttgacgcttgctttgtatctacaggctgtttttccttgcctgttagcatgctttgt

SEQ ID NO: 165358 - DNA, 1378 bp, Homo sapiens
aaaaggctctggaacataagaatcgaatgtcacgaatgcttgaagacagagatttattcgtaatgcgatcagagctgacggagtctgtttatgaggaaaaacttaaacagttgaagagcgattagcagaagaaaggcataatcgattggaagaacggaaaaggcagcgtaaagaagaacgcaggataacatactatagagaaaaagaagaggaggagcagagaagggcagaagaacaaatgctaaaagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggactctcgttggggagatagagattcagaaggcacctggagaaaaggacctgaagcagattctgagtggagaagaggcccgccagagaaggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggcaaataacttcctgtggcccttcaaattgtcttctccacgaggtggaatgaagaaaaagaccacccattttgtagaaggtggagatgctggcaacagggaggaccagatcaacaggcttattagaagaatgaactaaggtgtctaccatgattatttttctaagctggttggttaataaacagtacctgctctcaaattg

SEQ ID NO: 165359 - DNA, 199 bp, Homo sapiens
actatggctttgtgataccccctggagaacgtaatgtgggaatcctgtaatctcacttgagaaatccaaatgtcaagaggctggctgccacagcctgtgatgcagagctgagggctacagtctggaaagtgacgttcttccagagtttgccagagcaaaggaataacaagactttcacatgaatctgatataagtcaag

SEQ ID NO: 165360 - DNA, 569 bp, Homo sapiens
agcctgttctgtggggcttatctcaggactgtgaggcaactgaagacagaagccatgagaggagaagtttggtaatctcatctgcaattgttgtttttgtacttatctaaggatgggggtggggatggaagggtgggaatgggtttgagttgcagccaaaggaatttagattagacacctgaaagaactttccaacatacaacgctgtaaggccaaaaggagatagtacagttgccttttatctggatccatagtataatacttaagtttaggtgttcaataagtactgaacacacaagactgggagtctggagagttgggccaaaagctcttatttgtccttcattcccactggggacatttctcctctttatttcactctctgagcctctgtgtccttgtcagccttgtagggctgcgatgagaattaaatgagacaatatgtgaatgtgaccagtccagtcaatgcctagcacatagtacatgcttaagaaatacctatgtcatctggattctggaaatcctgtacaccatggtagtccaataaaaatatacccaatgaatcatta

SEQ ID NO: 165361 - DNA, 455 bp, Homo sapiens
aatggtgggacttgcctcgtcacctggaatgacttccactgtacctgccctgccaatttcacggggcctacgtgtgcccagcagctgtggtgtcccggccagccctgtctcccacctgccacgtgtgaggaggtccctgatggctttgtgtgtgtggcggaggccacgttccgcgagggtccccccgccgcgttcagcgggcacaacgcgtcgtcagggcgcttgctcggcggcctgtcgctggcctttcgcacgcgcgactccgaggcctggctgctgcgtgccgcggcgggcgccctggaaggcgtgtggctggcggtgcgcaatggctcgctggcggggggcgtgcgcggaggccatggcctgcccggcgctgtgctgcccataccggggccgcgcgtggccgatggtgcctggcaccgcgtgcgtctggccatggagcgcccggcggccac

SEQ ID NO: 165362 - DNA, 376 bp, Homo sapiens
catgcatccttcatgtattcagcaaatatttcctgagaactttccttgggacacagcaatgaagaagacaggccatcccctgccctcatggcactcacagccaaaagtggacactaatttacgacaggtatggatgcgagacgatcatagaaacactcttctgtacttactacgtgcatggcaatgtgccatatattaattcgtttacttctcacaatactcatgaggaaaggaacattatcatccccatttcacagatgaggaaactgaggcatagagtgtttgcatgaggtgctcatggtcacacagctgggtgggggtagactcagatttggaacccaggcagtgcttccatcactatactatgctgcatctg

SEQ ID NO: 165363 - DNA, 335 bp, Homo sapiens
gtgggttgaccgtggcttgtgggttgaccgtggcttggcatgggctgttccagcagcttagacttccttccctccacttctgctgaaacacttcagcacatcctcaagactccttccctgaccatgcctcatggtcaaggtgacactcagtgatggcatagggttctggagtcaggacaccagggtgcctgtcctgattcttcaactaattggctgtgtgactttgggcaggtcatgctacctctctggacctcaggcttctcttggagaaaaagatgaaggtgttgggttagagtattcctagagtccctttcagtttgttgtgataccatggt

SEQ ID NO: 165364 - DNA, 371 bp, Homo sapiens
catttccactgtcccctttattatcagcgtgagatcatacagtccgcaggaagtattattgaagtgacttataaaaaaattaaattttctttaatcacactccattgcctgacaccccttatgtaagcagaagggagtctgaggcctcagcttctaaaatgggaaccatgctaaggataaaaaactgaagacatttagggacccttgtcctgtgaatacaagcaactacagaaaggcatgagaacagtttcttggcttgcttgacttccttctcaccttcccttggttgacccaaaaacaaatacaaagctcagtcatttaggtgggctgataattccatatcattcatattttcaatcaccaagagcaaa

SEQ ID NO: 165365 - DNA, 404 bp, Homo sapiens
aagaagagaccacacaacagacacagccagctctagcaggatgcaggcccttcccttgcctcctcaagcagctggggcagcctggtgttttcacacagacttggccaagcaggaaggggaaacagtgatggggcacggagcccaggagaaggtgcacagggcccaggttgctggaggagccattgtgcacgctgtgtacgctggggcactgctgcagcctcttttcagcctggacatcaggcctgcctttccatgcccacctttgaagtagcgacatccctgctctgatggctcccacagcccccactttggtctcatcattcccagctctgatcctgcctccgagtggtgggagccctagagattgtcagtcactgagctggtttccgggacacctgcccctg

SEQ ID NO: 165366 - DNA, 195 bp, Homo sapiens
ccaacatggtgaaatcccgtctctactaaaatacaaacattagccgggtatggtggcaggcgccctaggaaaacagtaccaataagcaacttgtcactatgggttgtttttttttcccccacctcttgatagcaagggtctatcggaagtataaagcgttgagcgggaagtaccttgcctttttgaagcgaatag

SEQ ID NO: 165367 - DNA, 665 bp, Homo sapiens
ctcaacgcctatacttctctatgcccactttacagaagagactgaggcaccaggcaataaagtgacttgcctgaggattctagactaacaagcagcactcaacgctttatacttcatgtttaaacatgaagtagaaatggggttgtgcgttctccccagatgtacatacttggaagagccatgcagcaagcagaggagaggaacagaggagctgtgtggcttgaccctcctcggaatctgcagtgtggctggctctgtgtgcttcctgtattgattccatgactcacggagcatgagctaagcagaaagcacacttaaactacagaggagacagctgtctgttacagaaggacatattttctgggtttaatggcgccacatttttcctaatagtttgtacactggggatgtacttactagtaatgtctgctaaagggtctttattgttttttcctttttgaataaaaaagacattctttaaaaaaatcacctaaatattattcttgacttttatttcacaacaggacttcccttctaggaaaacagtaccaataagcaacttgtcactatgggttgtttttttttcccccacctcttgatagcaagggtctatcggaagtataaagcgttgagcgggaagtaccttgcctttttgaagcgaatag

SEQ ID NO: 165368 - DNA, 842 bp, Homo sapiens
ttttattttcacggaattgcagatttgcagacagttgcagtatttttaattaagccgtaatacctgaatcgttttagtttagaatctttgggtagtggttaaagactgaaagtggataagggttaggagtcactaatacgttaacacatgcctttatgctgcacaaattgggtagggtatcttattactcaactcttgggagtatttgtagaaagttattttggagtcaacgactttatattttcatctcagcgtgttccacatattggttccctcaaaggctttatacttcatgtttaaacatgaagtagaaatggggttgtgcgttctccccagatgtacatacttggaagagccatgcagcaagcagaggagaggaacagaggagctgtgtggcttgaccctcctcggaatctgcagtgtggctggctctgtgtgcttcctgtattgattccatgactcacggagcatgagctaagcagaaagcacacttaaactacagaggagacagctgtctgttacagaaggacatattttctgggtttaatggcgccacatttttcctaatagtttgtacactggggatgtacttactagtaatgtctgctaaagggtctttattgttttttcctttttgaataaaaaagacattctttaaaaaaatcacctaaatattattcttgacttttatttcacaacaggacttcccttctaggaaaacagtaccaataagcaacttgtcactatgggttgtttttttttcccccacctcttgatagcaagggtctatcggaagtataaagcgttgagcgggaagtaccttgcctttttgaagcgaatag

SEQ ID NO: 165369 - DNA, 706 bp, Homo sapiens
ctcaacgctttatacttccgtgtggtccccacccctcaacaagggaaagaaatccacatgtatcgagcatatactacatgccagacatcatgccaggcacttatatgatctatttgtatcttcccaaaaaccccataactcaacgctttatacttagtgtttaaacatgaagtagaaatggggttgtgcgttctccccagatgtacatacttggaagagccatgcagcaagcagaggagaggaacagaggagctgtgtggcttgaccctcctcggaatctgcagtgtggctggctctgtgtgcttcctgtattgattccatgactcacggagcatgagctaagcagaaagcacacttaaactacagaggagacagctgtctgttacagaaggacatattttctgggtttaatggcgccacatttttcctaatagtttgtacactggggatgtacttactagtaatgtctgctaaagggtctttattgttttttcctttttgaataaaaaagacattctttaaaaaaatcacctaaatattattcttgacttttatttcacaacaggacttcccttctaggaaaacagtaccaataagcaacttgtcactatgggttgtttttttttcccccacctcttgatagcaagggtctatcggaagtataaagcgttgagcgggaagtaccttgcctttttgaagcgaatag

SEQ ID NO: 165370 - DNA, 631 bp, Homo sapiens
ctcaacgcctatacttctctatgcccactttacagaagagactgaggcaccaggcaataaagtgacttgcctgaggattctagactaacaagcagcactcaacgctttatacttcatgtttaaacatgaagtagaaatggggttgtgcgttctccccagatgtacatacttggaagagccatgcagcaagcagaggagaggaacagaggagctgtgtggcttgaccctcctcggaatctgcagtgtggctggctctgtgtgcttcctgtattgattccatgactcacggagcatgagctaagcagaaagcacacttaaactacagaggagacagctgtctgttacagaaggacatattttctgggtttaatggcgccacatttttcctaatagtttgtacaggtctttattgttttttcctttttgaataaaaaagacattctttaaaaaaatcacctaaatattattcttgacttttatttcacaacaggacttcccttctaggaaaacagtaccaataagcaacttgtcactatgggttgtttttttttcccccacctcttgatagcaagggtctatcggaagtataaagcgttgagcgggaagtaccttgcctttttgaagcgaatag

SEQ ID NO: 165371 - DNA, 503 bp, Homo sapiens
cacatttattgatattttcaagaagtataaagcgttgagaacagaggagctgtgtggcttgaccctcctcggaatctgcagtgtggctggctctgtgtgcttcctgtattgattccatgactcacggagcatgagctaagcagaaagcacacttaaactacagaggagacagctgtctgttacagaaggacatattttctgggtttaatggcgccacatttttcctaatagtttgtacactggggatgtacttactagtaatgtctgctaaagggtctttattgttttttcctttttgaataaaaaagacattctttaaaaaaatcacctaaatattattcttgacttttatttcacaacaggacttcccttctaggaaaacagtaccaataagcaacttgtcactatgggttgtttttttttcccccacctcttgatagcaagggtctatcggaagtataaagcgttgagcgggaagtaccttgcctttttgaagcgaatag

SEQ ID NO: 165372 - DNA, 272 bp, Homo sapiens
gagaattgcttgaacctgggaggcagaggttgcagtaagctgagatcaaccactgcactccagcctgggcaatagaatgagactctgtctcaaataattaaaataagataaaaaataaaaatagagattggtagctgtgtttctgctttgtagttttgagttcccctcccagtccccaactataacccccaaaatgctcttcaaaacctaagaagaagaagaatgtagggtgtgttttggcagaagaatttggctaggttacttcctctgtt

SEQ ID NO: 165373 - DNA, 257 bp, Homo sapiens
ggctttaacttggcctctggtaaggggttttgtcctgtgtcacaacacggcaaaaggtcaaagagtaggaaggcacatgcaaagaggcaaaatctgaggggctttataacaacccactcttgcaggaactaatccatttctgcaagaactaatccagttttgccagagtgagaactcactaccatgagaatggcatcaagccattcatgaggaatcttctctcatgacccaaacaactccaactaggcccacctccc

SEQ ID NO: 165374 - DNA, 448 bp, Homo sapiens
aagacttcgtgacacaagtttacctatttaacaaaccttcacatgtgcccctgaacttaaaaattaagaaaaagaaagaaaaagaaatagaatttataatcaaaaacattcctacaaagaaaactccaggccccaatggctttactgttgaattctaccaaatgtttaagcaagatgtaataccagtcttagagaaactcattcacaaaataaagaaggtattatagaaatacttaccaagtcagcttagaattgtgaccctcctgcctaaacttgacaaagacattgcaaaagaataaattacacatcagtgtcactcatgaacattgacataaaagtccctaacaaaaccttagcaattctaatatatcacaaccaggttggccttatttctagaatgtaaggtttgttcagtattcaaaaatgaattaattaaactcactacctg

SEQ ID NO: 165375 - DNA, 197 bp, Homo sapiens
tgctaggattacagatgtgagccaccatgcccagcccatatgttgaatttttaaacactgagtactgcagaacccaggaattatttggacatagggtctttacatgggagttaaaatgaggttgttgtgaagggaccctaatccaatttgactaatatccttgtaaaaagggaaatttggagacagacacacgtaga

SEQ ID NO: 165376 - DNA, 443 bp, Homo sapiens
agagcaaaactctgtctcaaaacaaaaaaagaaagagagagagagagaatggagagggtgccatcaaggcacaagaaacctacacccaccctcatcacatgaaaacacctcttcccaacccagcatctgtcctatctctaaaacacactcctctcatgggtaaagagccttaaaaagcaacttgcaaccatttttcttaaagacgtttccttaaagaagtttctttttggagatgtggtataaatcatggctcctaatccttcctttcactttctaaacaacactcactgtttttcctttcccacagaacctaacgtttaaatccatgaaccagtttttacccttgaaaatgcaaccaggaagtgaaacataaagcatgggattctgccaaaacttgccaagctgggaaaacctttcttaaccttcaatgagggggttcagaa

SEQ ID NO: 165377 - DNA, 501 bp, Homo sapiens
caaaaataaaaagtcttctcagtgtctgattttctaatagagtgccagattttctactttgcatgttatgaaagttgttttaggtgatcaaaggcttataaagaacaggatgagattattgatgataagacggtaggacccagagccataattatgcatctctcagaatagatacagtagacataatacccttgcctatataaaagccttgaaaaaggcttaactgaaattcaacagctcaactgcctggattttatttaataagcaggtggaaaaatgacacattctataaatgccggtctttcctctggcactctggccatttgctatatgggccttgtgtgctgagtacagacagagaagagtgctatacatagactcaacaatgtggctgctaatgagtgcctgagttgccaaaagcagaggctaaagctgaaccctgataatgcaccatgagtgtattaaccagccatctgggagcaggctgattgcactggtccc

SEQ ID NO: 165378 - DNA, 282 bp, Homo sapiens
tggtttgacctcctatagatatcctgtcagttaattcaacacatttctttttgcacttaacaggtgcttgaagtggcagggtccttcctctaaaacattttaaataacactagtagatgaattccagttaaggggaaaaggtatgtgctgaaagtaatcttcaaggccacagtatgttctctccaaacacatgttttcaccacgagggatgtagatctgtgtgcccttattggctttactttttcacttactggcatctcttctgaccaacatctttagtca

SEQ ID NO: 165379 - DNA, 399 bp, Homo sapiens
ctcagcaaactaacacaggacagaaaaccaaacactgcatgttctcacttataagtgggagctgaacattgagaacacagggaggggaacaacacacacactggggcctgttgggaggctgggaggagacagagcatcaggattaatagctaatgcatgccaggtttaataccaggtgatgggttgataggtgcagcaaaccactatggcacacttttacgtacgtaacaaatctgcacatcctgcacatgtatcctggagcttaaaataaaataaaataaaattttaaaaaatattaagtttgatggcaaataagaaaaactcaaactggcagtagcttccataaggtggggtttattactcttatgaagtctatgaagtggaggtagtcatcccagg

SEQ ID NO: 165380 - DNA, 462 bp, Homo sapiens
  misc_feature (18)..(18): n is a, c, g, or t
  misc_feature (23)..(24): n is a, c, g, or t
  misc_feature (26)..(26): n is a, c, g, or t
gcggctagaggatccccnacggnngntgtactcaggcttatcctaaaaaatcaaatctggtgtcccctgagtttctatcattcttgggtctgctgtgcagaagttgcccctttatagaaggcaggtattctccagttggctactgtgcccaccttagtacttcccttactcaggcaaccttccttggtccttgtaagtatctgagtttacaactcctatgttatagtatatttggataaaaatttcaaggtttttaagtcagcatgtattggtttataatatatagtctatagagtatataaatccctcagttatggagttgaattttagagtttagaattttttaactcttttctttatatataccacaaataattctctgcccataagaatgcctagaagcctttttaggttattcctggttatagttggataatttacgaatattgcagacagtacatc

SEQ ID NO: 165381 - DNA, 386 bp, Homo sapiens
tcctgaaaaaacaaacaaacaaaaaagccactgagggcccttggactaaatccaggcctgagttgctgggcagaggtcagtcttgtccagacatgggaaaaaaataactcgagtcagacaggtgggtcaccacagaactaatccagcctgcaaatggcctgtgcaatcttcagctctgtccagacctgcctccctctggggatgcctttaaaggtgatgaatgatctggatgaatgggcttagaagataagagggaaaaacaaatatcacaggtcaaatcgttatttgtcttcaagtttaacaccgtctactggactaaaagatgtccaaagaatagttgttcaactatgtaaattccttttttttttttttttgagacagagtct

SEQ ID NO: 165382 - DNA, 160 bp, Homo sapiens
cccagcatttaagaccctgtatagatgaatctacgtgacttttttctatccttatctttctgaaacccaaaggggtatatcttaaaagagtttacctcctcacttggacatacccaattttttcacaggtgtcctggacctcattctcctccacttttta

SEQ ID NO: 165383 - DNA, 442 bp, Homo sapiens
cacacacacacacacacatatacttacatatatattgctgaattttatttgctaatgttttgttaaggacttttgtttgtatgttcgtgagcaatattgctctgtagttttttttttgtgctgctttggtctggttttggtatcagggtagcgctagtttaaattaaatcaattggaaagtttcctgttttctgaaagagattgtgtagaattgtttttaattctttaaatgtttggcagaatttcatatgggccaagagatttcttttttgggagtttttagattatgcatttcatttcctgaatgtttatagggctattcaagtgatgtattttgtatgtgtaagttgtggtagtttgtgttttttgaagaagtggtccgtttcatctaacttgttgaattaatatgtgtagagtttacagtgtttccttattatccttt

SEQ ID NO: 165384 - DNA, 547 bp, Homo sapiens
cagtaatgagttgatttttggacatttgagtttgaaatgtgtttgggacaagacagctgggtgacaaccaggcatttggatataaattagtaggtatactagtcagaagtcccaagaagaggtcaaagctagtaatataggtttgttgtggggggagtcatatgaatatcttccaacttgattttcattgtgctaaagtatcatataaatgccatcttctaaaaattcacaacaaaaaatgtttttctttaccttaattttcttttaccttacttacttttatctttcttttactttaacaaaattttccctagaatgaaattctaaacaaaagatggaggattcttattgtatgacatgatgactacagttaataaaaatatgttgtatctttgaaaatagataagaatagattttaggtttcctcaacatatgaggtaatgcttatgttaattagctcaatttagccgttccataacatatacatatttcaaaatatcatgttttccatgataaataaataaatatattttttaaatacaaaaga

SEQ ID NO: 165385 - DNA, 181 bp, Homo sapiens
tgtgtcaggtggaatgcagagtccagtatgaaaaggagcctgtttcagaacggaaactgtcaggtggagtggactccctgcaatggagtgatggaaagatttggtacaaccattgatgacctgagaacagacactaggaaggtttgacaagatccttcctacccccactccactggtgatg

SEQ ID NO: 165386 - DNA, 121 bp, Homo sapiens
tgtttgattaacggcttgagctcctcaagggttcaggagcttagaatgctgacaaagcaactctgctttgcatccccctaccctccccacaacacactcgtgcaatcgccggctccctggg

SEQ ID NO: 165387 - DNA, 412 bp, Homo sapiens
tggcagtgtgcagcattgcagaccccacccagacctcttgaattttaacaagacctccgtgcagagtaaaagtttaagaagcactgctcctggggatgggctaagtatacagtttttcaaacccttaggctatatacacattggcaagggctgtgtttatattttgtggttaaacctattcctttgcctagcacagtgctcagcccatagcagtaactcaaagcatatttgccaaatgtgtatgaatgaatgggcctgatggtacccaggcaacaaacagaattaccacacccaccccttccccattgtgcttcacacatcgaacatgtgccttcccaagtggcaaggattacagggtctgatgagactgtcccaaaccagaaaggtgccctcactccctgacacggtcacc

SEQ ID NO: 165388 - DNA, 213 bp, Homo sapiens
tggcagagctccctggaggcaggaattgttgcctgcttcattcactgctgaacccccagtgcctgaacagtgctggttgtgtagtaggtgctcacttaacatttgttgagtgaatgatctacatatagtgcaccttaagaaacaaaccaaaggcacagcctataaacagctgtgtgtacacatactgaggtgtgtagtgtctagggcaacaaa

SEQ ID NO: 165389 - DNA, 125 bp, Homo sapiens
tcagcataaaggccatttcttctaagagcctgtccctgactctccaatcggggatgtgtctgttgtctcatagagtgcccaattcctgccaccacttgtcatttccattcgcaacatttctttca

SEQ ID NO: 165390 - DNA, 218 bp, Homo sapiens
ggaaaaaattaaaatccttaggaatatacctaatcaaggagatgaaagacctctacaaggaaaactacaaaatactgctgaaagaaataataaatgatacaaacaaatgggaacgcatcccatgctcatggatgggtagaattaatattgtgaaaatgatcattctgccaaaagcaatcaacaaacttattgcaattcccatcaaaataccaccatca

SEQ ID NO: 165391 - DNA, 724 bp, Homo sapiens
gacacaagtggaagaaaccccagatctcttttcttttctagggcacttcttgctattgtaatttgaaaatgtattatttgaataatgagggatgtctttctcctgcaggactggtagctccttggaggaagggcctactggtcttgcatctgtctccctaccccaaggccaggcacatatgggaactatttgttgggtgtgtgtagtttcaagttctgcctctacccctgcctagtggttgcccttctgcaagccacttaaccctctatgcgtgtttcctcatctgaagcacgcaagtcaaatgatctgtgtgtgcctccctctgcctctggacccaatctgttcatatggttgtattgaagctaatttcatccacatacaagaatgtctagagctagcatagtgtataacatagccatcatttccaggatgtagatactctatttccattaactgattattatttattatttcagactttaccctgctttctctatagggtttttgtaaagactaagtgaaatgatgtataggaaattacttcagaaattataaagtttgtataactgaacaatgattgttattgctggcccaaagataccctcctgagaagaaactcagacccaaaagacagcattgcagaccaagtattgtaaaacatatgtgtggctagccccatcaaagaatgtatttcccaagttagtttttcatttaaaaaaaaaaa

SEQ ID NO: 165392 - DNA, 622 bp, Homo sapiens
tctcagttcagattcgttcccaaatttataaaatctgtaaaatccacatctataagaagtttgggttggtaccttgaagtttcctttcatttctaaaactcttgattctaggaggttttgcagcagcgtgaaagtttgtttttagaagccagaattgaagctgacaactcccagtcaaaagcagtgtagcttccaccattgccaggggcagccctcaaaatgtgctcagaggtgcagagccaaggaggcaattaattacccttcagtttcaggctgtgccgtgacaggactggcatgagaactttctcagcccccgcagtccctctctttgttcctaggtccaactgaagctgcctgtggcaggcacagcgcagggaaaggacatctctgcctgtgaggggccaggagacgtagaggagccacatgacccggggacagttgtttttttagagtcctgccccttttcttggttctccaggtgctaatcttggtttgacagcttttgaaggtcagcagcctgggcaagcacagccctggggcagaataataccttacaccgtcagagctttcacactgcagttccctgatcctccccacagccttgtaagacatagagagcagg

SEQ ID NO: 165393 - DNA, 255 bp, Homo sapiens
ccaagtcctaccaattctgcaccctttctatcttcaccgccccatgctagctcagactgaattcctctcacagcagcctgctcattggtcttcttgtcaatgctttctctctctaaaccatttgagtcatccctgttggatcgaacttcctaaagtagatataacacaacttccccgtgccatccataccttcattggttcctacagcttactgaacatcttcgaaattctttatttgatgctgaagatcttcac

SEQ ID NO: 165394 - DNA, 600 bp, Homo sapiens
ggccccatgagcccgcggctccccgtcgcccgggccgtccgtagcccctgacctgacctgtcctcgccatggccgaggccgcctccggcgccgggggcacgtccctggagggcgagcgtggcaagaggcccccgccggagggcgagcctgcagccccggcgtccggagttctggataagcttttcggaaagcggctcctgcaggctggtcgctacctggtgtcccacaaggcgtggatgaagacggtgcctacagagaactgcgacgtgctgatgaccttcccagacacgaccgatgaccacacgctgctatggctgctgaaccacatccgcgtgggcattcccgagctcatcgtgcaagtccgccaccaccgccacacgcgtgcctacgccttctttgtcaccgccacgtatgagagcctactccgaggggccgacgagctgggtctgcgcaaagcagtgaaggccgagtttggcgggggcacccgcggcttctcctgcgaggaggactttatctatgagaatgtggagagcgagctacgcttcttcacctcccaggaacgccagagcatcatccgcttctggctgcagaatttgcgtg

SEQ ID NO: 165395 - DNA, 446 bp, Homo sapiens
ataaacatcatttttgctttaaaatgagaccggttaagatttacctgtacccagatgataaagttttggtagaaaatattaaatgggaaaatagaaaagtgtgtatctacatatattccttaaggtcttatgtgtatctaagtgggagggaagtctaatagttaaaaaatataactgtggccaagggcagtggctcacgcctgtaatcccagcactttgggaggccgaggtgagcagatcacgaggtcaggagattgagaccatcctgggtaacacggtgaaaccccgtctctactaaaaatacaaaaaattagctgggcgtggtggcgggcgcctatagtcccagctactggggaggctgaggcaggagaatggcgtgaacccgggaggcggtgcttgcagtgagccgagatggcgccgctgtactccagcctgggcaacagagc

SEQ ID NO: 165396 - DNA, 195 bp, Homo sapiens
cccttttcccatcacatgcctgggcccaggctggttgtttagtgttgcctctcctctccagctgcggagcttattgaaaagctcttgctccctgcctggctttggcacattttctgcaggtgcctcctactgtggccacaatgggctgctagggaggtttagacctgtcaacagctacaggggagggggtggcag

SEQ ID NO: 165397 - DNA, 211 bp, Homo sapiens
tagagagaggaattagagaaggaggagaagacgaaaatgagagaaaaacaggaggaaaatataaattcatctaaggcattaggacaagcttcaagaattgaaatcagtgtaagaacgactacagaacaagaatgctcatctttgcattaaaaaatgctgctgctatttacaatagcaaagacttggaaccaacccaaatgcccatcaatga

SEQ ID NO: 165398 - DNA, 179 bp, Homo sapiens
acagtactttctcctttggcttctctcttaaccactctcctggttttcatcctacctctccgggtcctcctctagaatcatgtataggtagccagtccggccgtgatcatcctcatttaaatgttgatgttctccaggattctctcctgagcactcttctctactcatagcatagtgtt

SEQ ID NO: 165399 - DNA, 323 bp, Homo sapiens
gtccagaaaatggacagtagtctggtacagagctcctcgtggcttgcagggaggtggcaacagactataggaaggtaaggggaagacatattctgggaacaaaagttgtcttatatgcagatgaagcctgtcagtaatagcactcagaatagatgaaaattctctctgggtgggtgtggtgatggccttcagattcttctttggtgattaattttccctggttgatgagatttctgacagggagctgaaggcaattttttttcttttgaaagaacttttctcagatgaggaaacttcagagagatcccctccatgggctaggt

SEQ ID NO: 165400 - DNA, 415 bp, Homo sapiens
ccagagccccagaatccattcgtgcctttctctaaagcaaaccgattatattttaacatttaattaacagcgctcaaaaaaaaaatcagtgttaagtattcctcaacaccataaaacctaccaatggtctcagcccatagaatctctatctccattatctcctgcggctcccaggggcccagaccagcatatccagatgcctcagttacctcaatgctgaacattcgttttcaaaaacctgatcaagtcatccctctgctaacaatgcgcttcatcagtttttatttcttcaggctaaggccaacatcctgcataaggccccaaatagatttttgagcttgttttcctattatctctcttttttaagaaaatcaacttctgccaggagcgctggctcacgcctggaatctcagca

SEQ ID NO: 165401 - DNA, 355 bp, Homo sapiens
agtggatggtggacaggtgggtgagtggatgggtaggtagatggggaggtggatgggtggttgctggacaggtgggtgagtggatagatgggcagatggatggtggacaagtgggtgagtggatgggtggatggatggtgggcagatggatggtggataggtagatgagtggatgaatgggtggatggatggtgggtaagtgggtgagtggatgggtggatggacaggtgggtgagtggatgggtgggtggatggatggtgggtaagtgggttagtggatgggtgggtggatggatgggtagaaatattttcgttttcctaagtgttgcgtccagctgctgtcggcccctccttg

SEQ ID NO: 165402 - DNA, 249 bp, Homo sapiens
ctcaggaggagtggaaatgcctggaccctgctcagagggctttgtacagggacgtgatgttggagaactacaggaacctggtctccctgggtgaggataatgcccctccagaagctgggatctgctctgctgtatctctgcatgttccctgtgtgcctcttgggagcccctgcattgctcaattaagactgaagctatgttaattctcagatgaaaagcttaatagtgcagcatctggacttaattatc

SEQ ID NO: 165403 - DNA, 249 bp, Homo sapiens
ggccgacgaagagcaatgagaagagagatcaatcaagactacaataggatttgcaaagaattttctaccattgtgattttttttcctcttaagaaagagaacaccggtcctggatcctcaggatgaaacccagagatgggtttttgaagattttctttactcaaaagagggttctcaaagcaggactagaacatggaccatgaagaaggttatattccaagggtctgccgaactgccatgaatacaaca

SEQ ID NO: 165404 - DNA, 741 bp, Homo sapiens
ctatcttttaattgccatttttagcccctttgtatttactgacatatttggacttctggctttcttctttctatttgtcctgaattcttgtctctacccttgactttgttttttcttttctcttattccccgtctgctggattgtaagttatattctgtctcttttcttttataggttaccttgaaatcttaccatatgcatacttaacacaaccccacctcctgagtaattcaaggcccttaatatatatttttttacttgtcacccactccttctcaaacttacaagctatattattttctctttttttttacagtacccacaaatgacatttttcttcttaatttctttattttatacatacagtacttatttagatttacccatatgttaatacacatttcttgtcatttttttcttgcatctcaaatcctccaaagcttattttctttctttctgaagtaaaaaacatctatactgttggaaaacgcttcaaagaggcaaataacttcctgtggcccttcaaattgtcttctccacgaggtggaattgaagaaaaagaccacccatttggtagaaggtggagatgctggcaaacagggaggaccagatcaacaggcttattagaagaatgaactaaggtgtctaccatgattatttcttctaagctggttgggttaatacaacagtacctgctctcaaaatcgaaccaaaacgaaagaaacaaaaaacaacaaatc

SEQ ID NO: 165405 - DNA, 600 bp, Homo sapiens
ttggaccgggaatccaaagccaattattctttgaaaatagaagccagggacaaggcagagagtggtcagcagctgttttcagttgtcactcttaaagtttttttagatgatgtcaatgactgctccccagctttcattcccagtagctatagtgtgaaggttcttgaagatctccctgttggcactgtcattgcttggcttgagacccatgatccagattgcgctattctttggtcaatgactataatgggagatttgaaatagataaagcaagtggtgccatccgcttgagcaaagagctttccctatgggtacaatttcactcttcaagcaaaagacaagggatctcctcaaaaatgttcagcattaaaggcagtttacattggcaaccccacaagagacactgtccccattagatttgaaaaagaagtgtacgatgtgagcataagtgaattttcccctcctggtgtcgtggttgctatagtaaaattaagtcctgaaccgatagatgtggaatacaaattatttcctggtgaggatgcagtgtagagtgctgtagctgtgtgttccaataaattattttgtagggaaaaaaaaaaa

SEQ ID NO: 165406 - DNA, 357 bp, Homo sapiens
catgtggctgccacctagcttttggaaggggccgtgagagccaggctcagggactgtgggaggtgtgcaagcggccgaggggcaggcaggggtggttatggcaggtcccacctgcatggtaggtggtgagcttccagggactcatggcatgagcaaaaataactagcacaccctttaacttttttgcatagttgggaattagctgtctccacacctgtgtggcctgccttccaaggaattcccagcccaggagttttaaattagtgctgcctgtggcattatgtttcaggtattggaattactctgtgtttgacaaggggaaggcaggtgttctgtgtctagaaaaggaaaaggtga

SEQ ID NO: 165407 - DNA, 227 bp, Homo sapiens
atttttatggctttggattaggcaatgttttcttaaagatgatgccaaaagcactagtaaccacagaaataatacataaattgtacttcaaaatttcaacattttgcttcaaaggacaccatcgagaaattgaatatgcaatgtacaatgtttgcaaatcttatgtctgataaaatatatatagtaggatataaaaagaactcttagaacttaataaaactttaccc

SEQ ID NO: 165408 - DNA, 411 bp, Homo sapiens
gtctgtattaatatcaagaatattttaaaaaattgtccaggataaagaaggtaattttataatgataaagggaataattagtcaaaaggacttaaaattataagtgtttatggctttgaaaatggagctttaaaaatatatgaactggggccaggggaggtggctcacacctgcaatcctagcatttgggaggccgaggtgggcagatcctgaggtcaggagtttgataccagcctggccaacacggtgaaatcccatctctactaaaaaatacaaaaattagccaggcatggtggtgtgcacctgtaatcccagctactcaggaggctgaggcaggagaatcacttgaacccaggagttcaagaccagcctgggagacatagtgagaacatgtctatacaaaaaaaaaaa

SEQ ID NO: 165409 - DNA, 899 bp, Homo sapiens
tgaacccaaagatgccttgagaccctgcgtgggagacagatggaaggagatgtctaagcctggtgtcaaggtgctctcaccttgcagaatcacagtgggctgtggtggaccaggagaagaccccttaacaaagtatgggagtgagtctgtctaagtcagctagcccttaatgaggtcctcctcgagtgaagctctgattctgacacccatgttaggttgtggtcatttctaggacccagggtccagccccagagattcctagatagttctaggaccatctggtggaatcaaactatggatagacccattaatatccaactgggtcctctttcgttgagtctcccgccctcttgagggagactgatctttagtaacttctttatgagactgggtcaggtgggcctcctgttgttgtctgtggtgctgcaggtcatgtgctttggtgggcaccagtaactgtcattggaattgccaaggtggtgggaataaagagagatgggcttctctgtgattgaattgaagtttggttgtgagtgtgggtcatgagccctgaccgggtaggagacagaagcctgtggttcttctcctggtttccttagggattttcagctggctcttgggcagctccttcaggtggtagctgttgtggcagaatagaagagtgctggactgaggagcagagacctgggtctcatgagatcatgagatcaaaccacttaaactctgtgtgcttaagtgacttcgttggcaatagagtaataccctccctgaagaataaatgaggcgatgttgagaaagcattttatgagcaagccattttcattaatgcaatgggggaaacatgctatgtctagcttagagggctgaaacggtcaaatgaaataatcaacgtaaatgct

SEQ ID NO: 165410 - DNA, 425 bp, Homo sapiens
tcagaatttctcacttaagaggtatagtaaatgaaaatcctttaccaaaacaagttcctgaagtgtgtcatccctctgctagacatctaagggatgacttttttcacaaatcatattaactcaccagtacaatagtagtaatactcattgtaagttgctgaattttgcaacttaacgaatgacaagaacatggcataggtcagtgatgcatgttatgcttaattttgagtgagtgacttgcatgttatatctctgcctgtctgaaaaaaagttggtgaaaatagaggcactaaacatcattagattccatgattatactacatttttgcataaaataaaactttcagatgttttataattactacagtgtattatcaaaattttattatgcaattaaaacattagctacaacaaatataaatatg

SEQ ID NO: 165411 - DNA, 516 bp, Homo sapiens
  misc_feature (58)..(58): n is a, c, g, or t
  misc_feature (66)..(66): n is a, c, g, or t
  misc_feature (69)..(69): n is a, c, g, or t
  misc_feature (104)..(104): n is a, c, g, or t
  misc_feature (113)..(114): n is a, c, g, or t
gactctagaggatacaccaagcccgaccatacactttggccctaggatcaggtgatcntcagcatnaangcctttccccaaataggtctcccctgctttacagngcacccagnngaggtatgagaccttgagatccaatgcaaagttgaagtgtgtgtcagtcacctgccttcacacatcttttgttccctggccccagggctcatgggtatctctgggtggcttaaccaccccacaagtgacccctccagccacttcccaactcagctcagagctccatgggcttctgccctccctggacttgatggcagcagggatgctccctccaggccttctcctggccgcagctgggtgaagacctctcaagtcccctgactttgtcccgactggtggctacagctcctgcctggactcaagctggctatgacatgcccttaagtctttggcatgacttggacaattccctctctgctaagggaaacccattccccccgccatagtttgtcatctgcaaaa

SEQ ID NO: 165412 - DNA, 366 bp, Homo sapiens
ttctggatgctgagggtccctgtgagggtctggcggcagaggcctgcgcttatgggtcagcagctaggactgatgggttgaataagaagggcccaagttaggccagttgttctcacagacccagaggtccctagagtttatgatgcccagagtctaggagagggaaatgcacacacatgccctcgaggacaccagcatcctgacatccaagttactgtactgccctggttagcaagaaagaacatctgttcccttctctatgcaattgttacagtaactgttgttacatttcttaagatacatagctatatatgtagtcactctgcaaacacacacactctgatagacacacgattgcactcatgg

SEQ ID NO: 165413 - DNA, 198 bp, Homo sapiens
atagaggaggtgtcagggagggctttcaggggaggtcttagatgagctcagtctttcagaatataaggaagagtgagccagcaaagggagtgaggaagagggaatagcaggagaaaaggttgaagaaaggcaggagccagccagtcctcatcaaggatctagaactttatcttgtagattaccaattgtcaaccctgg

SEQ ID NO: 165414 - DNA, 272 bp, Homo sapiens
ctcccaaagtgctggggtgactggcgtgagccactgcccggctgatcttcgtcatttcatttagcatacaatatgtgattttcctaattactttatgaagtcatcactgacagtctgactttagagacaggaaaacagagaaattaaagaacttctccagagccaatattggacttgagccgcatgtcagaaatatttcctgcttctgcatctcggagtcaggtgccattacttgtcttcagaaccttaaactttcgtagcttagctctgcc

SEQ ID NO: 165415 - DNA, 394 bp, Homo sapiens
ccgcgcccagcccctagatttgtttttatccagtctctgcttggcactcattgcgagctttcagaattgagattcaagtcttcaattatggcacatttttagcgttagttctagtattgcctccccaccactccttctagctttatttctggaaatcctactagatgtgtttcttttcactctacctgttatgttacttcacttctcatagagagaagtgttttatctctattctatacacagagtgaatttaatttactaattctctcgtttactgtgcttggtgttgtttctccccatctactgaccatatatttcattttcaggattttgaataggtttttgttttcataactactgcctgattttgtttctaaaaatttttttttttctg

SEQ ID NO: 165416 - DNA, 682 bp, Homo sapiens
agcgagggagggaggggacgggcgcagaccgaaagtggggaaagaagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaagcaggtgtcttctgcggaggtgcgcatcgggcccatgagactgacgcaggaccctattcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtgtaagtgcacctcccatt

SEQ ID NO: 165417 - DNA, 713 bp, Homo sapiens
gcggccgcgggcgcgggcgggcgcgcgggggagcccggccgagggatgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaagcaggtgtcttctgcggaggtgcgcatcgggcccatgagactgacgcaggaccctattcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtgtaagtgcacctcccatt

SEQ ID NO: 165418 - DNA, 339 bp, Homo sapiens
gggtcagttcttcaagaggacaaaacagttctaaacatttataaactaaatgacagtgtttcaaagtatatgaagcaaacactgataactgcaaggagaaatagatatatccataatgatagtgattccattattcttctcttagtaattgatagaataaggagactgaaaatcattaaggatgcgggagacttgaacaaccccttcagcctgctggatctgactgacagtcatagcacaccatccagagagagcagaatgtagttcttttttagtataaacacaaagatagatcatattcttgtgagccataaaataagccccaaattgataattatg

SEQ ID NO: 165419 - DNA, 502 bp, Homo sapiens
aataataaaacctcattgagctatgtggctttatgtttactagcaaagctagtatttactgtaaaatcttaaaactggtctaaaacttaagctacccaagaacagaggccatgtattattttgtattcctcatgatgccacatgctgttaggcacatggttgctcaatgaatgatcatatagtatgaagaccaccagaagtaggagttaaaaagtggatgatggtccttgcttaacattctctacttgtatggggcaaactacctaatttacaaagatgttattttcctctctctaatgtgaagattgaacaacatggtaatataagttcctttattctggagtaggattgccagaattggggaaaaggcccttcaattacaaaattacagaatttaagattttacttttgggtcctgttcccttgtctggtttcttcctagattctgccctattgagtgattgttctgcaaagcagtataaacaccttggagaggtatgcg

SEQ ID NO: 165420 - DNA, 662 bp, Homo sapiens
aacttttttaaaagtgaaaaaggaagcaaataatactgtatatttcatacactatatcttaatttgagatatatatgtatgtatatttaaatttagaaccatatattaaaatttttgcagtggttatttctgaaaggtggtttatggatggattaaatttctttctttgtacttttctgtatttttcaaattttctacaaacgaccatagtagaaaataatagagaagctgcaaaaaagggagaaaatttttataatagagaaaaagttgcaaaaaaggggagacacccaagtttatagtactatattttaggcaaattgccatgaaaaattgttaaacttaaaaaaaaaacttaaagaggtaaggtttggtgttattgagcacttcaaatgtggctagctcaaactgagatagctgtaagtataaattaccaaatggatttcaaagtcttagtgcaaaaagagaatatgaaatatctcatgtatttttaaacattggttacatgataaaaaaaattttgttagattaaataaactatattattttcttagtccattttgtgctgctataacagaatgtctgacactggttagtttacaattctggaggctggagtccaaggtcaaggggtggcatctggtgatggccttcttgcttcatca

SEQ ID NO: 165421 - DNA, 809 bp, Homo sapiens
tggaatttctccagagggcactaccaggatgagtagcaccaggtggctggaactcttgtgtgagcagggaaatagcaagtatttagccagttttggagatgagaaggttaacgttatcaagagactcaatgctataacccttacccccacaaaaacctggtgcttaggggtggatcctggggtggctcttcagtctgccagttaagcagggttgggcaaggaaaagttacagattacatggaaagtcaacaaaccacggtgcagagaagctgttgaagtcagcgtgccctgccctggctctgtgtctctgaccagggcagggtcagagtgcccaagtgcatgtgggtaaggcacatgtggatgaatgtgtgtctggacacgtgattgtttgtgtacacttgcagttcttgagcctgagcctgtctgtgtgagtaggcaaatacggatttaccctgtgtccccatgagactaaggagggagctactctccctatctggtgggtgctactccgtgtagacatgaactggggataagtaggatggctagtggggaacctaacaagggagaagccaggcagtttgctggcttagcttttcgtaggtaaccctctgatgtgacatggggccataccaacccaagagcataagccatgcctctggactcaccctgtgccccatgcagccctaggcttcagtgagcatacctaatcctccttaatggtaaacatcccaaatatccattaataatcctctgagggttggttatttgtgaactttgactcgtaaaagctcgtcatcggggggtcctct

SEQ ID NO: 165422 - DNA, 331 bp, Homo sapiens
agccttttgatttggaggctaaagagctctagactgggtattaacaaccctgtctttgaggatttgctctgtttctgacagttgtggggacttggccaactttcactcactgtctctagtttccaaatctagcaacttgacttttagttttcttacttttcctttatgtagcaaatgaattaatgtaggagaaaatattttaaaattttaattaatatgtgaatgtaatattaatgtttcttttaattataaatatatgtatcagtataaaagtaagacaagtgtaatataattgataatataattatcaaataaatgaaaaagaagaaga

SEQ ID NO: 165423 - DNA, 285 bp, Homo sapiens
tactgcaaaagtattttttaaattacttcaattttcaaggaagaatgatatcagctctcaaaattcagttttgtaaaatattgatgcttgtaaataaaaacaaatcaatgacttgcagctgtagttacacaggctatcttgcagtaattataatttttaaaaagagtacagattatgttgctctatttattaaagtaaaaggataaagaaagatttatcagacaaattctaaccaaaagaatactagttattaatattgaacaaaactggaagaaaaataccaaa

SEQ ID NO: 165424 - DNA, 425 bp, Homo sapiens
gaagtttaagttatttaataatatgacattatcaagtaaagctgaatatatgtatagccaagtatttatactatagaaatgcacgcttatgtgcatcagaagacaagtttacaaatagctgcatcattcaaaatagaaaaaaaatgtgaaacaacccaattatccatcaatagcagaatggataaactgtgttggatgcattcagtggaatcaggtcaatttttaaaacaaaatagcattgcacaaaagaacccagactcgaagaaaatatactgtatgatccatttgattcaaaatatgcaaaactaaattatattgcttggggaagaataagtaggtggcaaaattataaagaaaaccagaagagactattataaaaatttacgggtaacactgaggggtggggtggaaagttttgatcataa

SEQ ID NO: 165425 - DNA, 225 bp, Homo sapiens
ggagagagttgggaggggatcgtgagggaggagctgcggacagcccgtgtagtcaactctttggcaaaatttgatgatgaaaggcgaggagcagagaaacggagtgggagctggaaggatgtgcacaagggaaagaggttttttggaagtgttggtaatttgtgtgctgatgggaaagatcagtggagagggagtgactgatcaagagaaacgagttgggtcagt

SEQ ID NO: 165426 - DNA, 111 bp, Homo sapiens
tcagcggaaataaaaacctggaatcctactggattttgaaacttcccagtcccttgcttcagctaacataaaaagttctacattaagaatataaggaaatgcacagaaact

SEQ ID NO: 165427 - DNA, 512 bp, Homo sapiens
tgagggaagcaggagactgagggcagacaaaaagccacccttcggaaaagcaagcgagagctttctaggcattaatcgccgcacccccacgccgccaccagaacaaacgtgggatgcggtggtcttcgccaaaagggaagggaatcttagccgcgcctcagggcccggaatgcccctccagcttcacttccagaagggcagagctttccggaatggcggggggcaccaaaccatcgtgtttgggggagtttccactgggcaaccggtcacagtttcgcgaggaacgagtaacaagcggagcgagctcccagatgggaacgctgcgcggtcgccaagagctgctcctccccggcttggagtcccccagaggagttccatccggagcaggacaccggaaagtggggctgctagccggactgcggcagcgcatcacccctagagttggttttctcccgacaactccaactccgctctcccgcggagctgtgttcccaggaggctgccgcggccgc

SEQ ID NO: 165428 - DNA, 405 bp, Homo sapiens
ggccagatcgtggaggagtcggggtccaagggactgggacagaggtcatcctcgaagagatggggagggtgaggccaggtgtgggcaggagggggtggaccgggagcttctgcagcgccagccctccgcggggacgtgtgttacactgcctgacatgggcaggaccctggagctgcatttgtaagataaataatgggtgtcccgagcgcctcattaagacatctttgctgagatggaaatcgctgaggcattaattaatagaattaatgccttttctagttgcctttaagactaagtcacctttagtccaattcccagagtgaggaagccttaacattgctcctcctggtttaaaattccatcagcatttttgttgcaagcattaaaaaatatttttgttttatt

SEQ ID NO: 165429 - DNA, 692 bp, Homo sapiens
agtgttttctttccattagtgcacaaataaaattagaaatgactaatggaagattgctttgctttaccagatgaatcttgggtttgtctgtaaatctgtgactttaatgttacttagtatcatctccgtatctgaaggcttattccatagcaagtatatgctgcattgagattatattctaattgaactttattccctgttctggattagagcaatcaagaagtgtttctatatggaactttgttcattgtaaaggcattctgaaattatcttaaattgtggaactttattgcttttctgtgtgttaaggaggcagaattgttagagaaggggattctgattatttaacaacagagaaaggcttctgggttatctattagagatgaaaggattaaagagaaactatagatcagctagtccttatggagagaggaatataaaggaaagagaaaaaataggactgtggcttagtttgggctctgttgactgactataaaagtgagccaatcacatagtaattttctgacaaaatagagtttaggttaaggcttaggtcaaggctgtactttgtgttaatagtattataatgagcaaattaatagaaacaagaaaacacaagttagaggtgagagggccagctgtgtctggttaagtgcatttgtttctggtcctcaactagataactatagtaa

SEQ ID NO: 165430 - DNA, 436 bp, Homo sapiens
aatgactgacacatgtggccaacctctactacaggtcctatctatccaaggaatagtaccatcaattatcttttgtttgtcagacataattatttcatctccttccaaaagcacatcacattatctgttgattttagctccttgatatttgcctacagataagaaccatcagtgagtatttctaaaaccttgacaatttttttctcattagttttattttttttaaggcagtgaaaaacctgaaaatagctagaatcacaaagagaactgctgggctaggaccatgcctgggacaagagcagagaaaattagggtccattgtcagcacatgtgtagagtaagtaagtctgctacccagcctcacagtcattcctctcttatctgcctaatgcctctgatgctcattaacataaagaaaacaaatttcatttggtaa

SEQ ID NO: 165431 - DNA, 475 bp, Homo sapiens
tgagggggccagtttacacagctaactcaagcctaaccccttatgaaaggtggatttcctgtacaactgttctgacaagcggaggattaggcacttcatacattctgcttgggtaagagactcacgacagaagtgaatcaccacagaggagcatactgcttttctgaacgtctctgagattgttgtatgctggaagacaaggacacttcggttgcgaaccaaactcaactagagtcacctcccatcacaacaatggcatgaaacatcccacacctacaagttaaagctatcagtcctatacagacagctgtagctagctagctagctctctctccctctggagacccacatgtgacactccctctaccttctgtaattcaggattactaacaccattcaaagcaagcataaggctgggtgcagtggctcatgcctgtaatcccagtaatttgggaggccgaggcggacggatcac

SEQ ID NO: 165432 - DNA, 299 bp, Homo sapiens
aaacggtaattgttgagcccatccacacaactgggtacttttttaaaggattttccaagtaagaagactgttcttctcccactatctgactcgccagttacacaaagatgcctttaattatgtttcatttaagactaaagaaagcatttggaggccaggggcagtggctcacacctgtaatcccagcactttgggaggccgaggtgggcggatcacgaggtcaggagatcgagaccatggtgaaaccctgtctactaaaaaaaaattagctgggcacaattatggaggggtaccgagct

SEQ ID NO: 165433 - DNA, 318 bp, Homo sapiens
aaacggtaattgttgagcccatccacacaactgggtacttttttaaaggattttccaagtaagaagactgttcttctcccactatctgactcgccagttacacaaagatgcctttaattatgtttcatttaagactaaagaaagcatttggaggccaggggcagtggctcacacctgtaatcccagcactttgggaggccgaggtgggcggatcacgaggtcaggagatcgagaccatcctggttaacacagtgaaaccccgtctctactaaaaatacaaaaaattagccgggtgtggtggcgggcgcctgtagtcct

SEQ ID NO: 165434 - DNA, 1084 bp, Homo sapiens
gagacgtcatcacgcagggccgagtcggcgcggccacatcctttaaatatggtctttcttgggcgcgcgcgacaatgtgaggagtggggtggagcgtgtgtggtgtgtggctgcggcctgggcaagagccgccgcggaccatgagctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagagagagcagaggagttatgtggacttgttggttaaatacgcaaagattcctgcaaattccaaagctgttggaataaataaaaatgactacttgcagtacttggatatgaaaaaacatgtgaacgaagaagttactgagttcctaaagtttttgcagaattctgcaaagaaatgtgcgcaggattataatatgctttctgatgatgcccgtctcttcacagagaaaattttaagagcttgcattgaacaagtgaaaaagtattcagaattctatactctccacgaggtcaccagcttaatgggattcttcccattcagagtagagatgggattaaagttagaaaaaactcttctcgcattgggcagtgtaaaatatgtgaaaacagtatttccctcaatgcctataaagttgcagctgtcaaaggacgatatagctaccattgaaacgtcagaacaaaacagctgaagctatgcattatgatattagtaaagatccaaatgcagagaagcttgtttccagatatcaccctcagatagctctaactagtcagtcattatttaccttattaaataatcatggaccaacgtacaaggaacagtgggaaattccagtgtgtattcaagtaatacctgttgcaggttcaaaacagttaaagtaatatatattaattcaccacttccccaaaagaaaatgactatgag

SEQ ID NO: 165435 - DNA, 414 bp, Homo sapiens
actgaggacaacccgtgtgcgaagaactacgtgttttatccatcagacgtataggagaaaatttgaatgcctcagcaagttctgtagaaaatgagccggcagttagttcagcaactcaagcaaaggaaaaagttaaaaccacaattggaatggttcttcttccaaaaccaagagttccttatcctcgtttctctcgtttctcacagagagagcagaggagttatgtggacttgttggttaaatacgcaaagattcctgcaaattccaaagctgttggaataaataaaaatgactacttgcagtacttgcaattgaaagaaacgcgtttcttttcaattccaagcgttctggtaattcccattcttttcatttccaaggtttcttgtaccctgtggacaccctgcaatgaaaaga

SEQ ID NO: 165436 - DNA, 1541 bp, Homo sapiens
gcaggggcgggaggagggaacatggcggccgggccaggaccctttgctcctggctctgcgcggctcctacccctgctttgcttgcccttttacctgcttttctggaaccttgtttcccctctctttgcgtcccctttccctcagccgtttcttttgccttcctcgactattcccccccagctccacactgggtcgaagtgtgagaggtagattaagtgggagccggtcgggcccgttcggtgtcgagagaccgactcctaaatttgattaggttctcgcaggtcactttatcagtctgcctggggtcacaggagaagtactgaacatgagagatcaagcctgatttgtagtcctgatgatgtctctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagacgtataggagaaaatttgaatgcctcagcaagttctgtagaaaatgagccggcagttagttcagcaactcaagcaaaggaaaaagttaaaaccacaattggaatggttcttcttccaaaaccaagagttccttatcctcgtttctctcgtttctcacagagagagcagaggagttatgtggacttgttggttaaatacgcaaagattcctgcaaattccaaagctgttggaataaataaaaatgactacttgcagtacttggatatgaaaaaacatgtgaacgaagaagttactgagttcctaaagtttttgcagaattctgcaaagaaatgtgcgcaggattataatatgctttctgatgatgcccgtctcttcacagagaaaattttaagagcttgcattgaacaagtgaaaaagtattcagaattctatactctccacgaggtcaccagcttaatgggattcttcccattcagagtagagatgggattaaagttagaaaaaactcttctcgcattgggcagtgtaaaatatgtgaaaacagtatttccctcaatgcctataaagttgcagctgtcaaaggacgatatagctaccattgaaacgtcagaacaaaacagctgaagctatgcattatgatattagtaagatccaatgcgagaagctggttccagatatttacctcagatagtctaactaggtcggcataattaccttattatatctggggcacgtaagaccggggaatccggggtcagacacccgtgcggtcaaccgtagattttttatacactccggaatgattagaagaacacttttagaccaatagcgacgacatgtcgctgctagaacacaatatatacatcgtgggcacgcaagagaacattcagggttcgacgccctcgtttctttcccttctttttttgtcaatattttga

SEQ ID NO: 165437 - DNA, 1322 bp, Homo sapiens
gagacgtcatcacgcagggccgagtcggcgcggccacatcctttaaatatggtctttcttgggcgcgcgcgacaatgtgaggagtggggtggagcgtgtgtggtgtgtggctgcggcctgggcaagagccgccgcggaccatgagctgagtaagttctggagggatcctgcctcttggagccttcgcagccaggcagctgtgaactgtgagctagagtgaagcagaaatctaggaagatgagctccaagatggtcataagtgaaccaggactgaattgggatatttcccccaaaaatggccttaagacatttttctctcgagaaaattataaagatcattccatggctccaagtttaaaagaactacgtgttttatccaacagacgtataggagaaaatttgaatgcctcagcaagttctgtagaaaatgagccggcagttagttcagcaactcaagcaaaggaaaaagttaaaaccacaattggaatggttcttcttccaaaaccaagagttccttatcctcgtttctctcgtttctcacagagagagcagaggagttatgtggacttgttggttaaatacgcaaagattcctgcaaattccaaagctgttggaataaataaaaatgactacttgcagtacttggatatgaaaaaacatgtgaacgaagaagttactgagttcctaaagtttttgcagaattctgcaaagaaatgtgcgcaggattataatatgctttctgatgatgcccgtctcttcacagagaaaattttaagagcttgcattgaacaagtgaaaaagtattcagaattctatactctccacgaggtcaccagcttaatgggattcttcccattcagagtagagatgggattaaagttagaaaaaactcttctcgcattgggcagtgtaaaatatgtgaaaacagtatttccctcaatgcctataaagttgcagctgtcaaaggacgatatagctaccattgaaacgtcagaacaaaacagctgaagctatgcattatgatattagtaagatccaatgcgagaagctggttccagatatttacctcagatagtctaactaggtcggcataattaccttattatatctggggcacgtaagaccggggaatccggggtcagacacccgtgcggtcaaccgtagattttttatacactccggaatgattagaagaacacttttagaccaatagcgacgacatgtcgctgctagaacacaatatatacatcgtgggcacgcaagagaacattcagggttcgacgccctcgtttctttcccttctttttttgtcaatattttga

SEQ ID NO: 165438 - DNA, 719 bp, Homo sapiens
  misc_feature (55)..(55): n is a, c, g, or t
ctctcgagtatccacgcgtgttcgtcagatggtcgtctgtgcgggaggactgaantgggatatttcccccaaaaatggccttaagacatttttctctcgagaaaattataaagatcattccatggctccaagtttaaaagaactacgtgttttatccaacagaaaattttaagagcttgcattgaacaagtgaaaaagtattcagaattctatactctccacgaggtcaccagcttaatgggattcttcccattcagagtagagatgggattaaagttagaaaaaactcttctcgcattgggcagtgtaaaatatgtgaaaacagtatttccctcaatgcctataaagttgcagctgtcaaaggacgatatagctaccattgaaacgtcagaacaaaacagctgaagctatgcattatgatattagtaagatccaatgcgagaagctggttccagatatttacctcagatagtctaactaggtcggcataattaccttattatatctggggcacgtaagaccggggaatccggggtcagacacccgtgcggtcaaccgtagattttttatacactccggaatgattagaagaacacttttagaccaatagcgacgacatgtcgctgctagaacacaatatatacatcgtgggcacgcaagagaacattcagggttcgacgccctcgtttctttcccttctttttttgtcaatattttga

SEQ ID NO: 165439 - DNA, 321 bp, Homo sapiens
ctcggctcactacaacctccacctcccgggttcaagcaattcttgtgcctcagcctcccaagtagctgggattacaagcgcacaccacgcctggctaatttttgtatttttagtaaagacagggttttaccatgttgcccaggctggtctcaaactcctgacttcaggtgatctgcctgccctcggcctcccaaagtgctgcgattacaggcatgaaacaccgcgcctggcccctattctgatttttatgtcttatttcgtcagtattaattcctagtatctttgaaattatttatgcattgagactttcatataacaaca

SEQ ID NO: 165440 - DNA, 487 bp, Homo sapiens
tgggtgcgtggtccctgccatttctctgtctgcggagcagcctttgttactgtctgctgggcttgcccatgtgtgactatattcaccacaaccaatgggaaataagtaagaccatatttcagcatatttaagatgctattgattgtaagacacatggtattttataagttgctaagacaaatctaataagatgctgatgaaattatgacatgccatcaattgtaaaatggatctccatttctgatgttaaaatatgaaaaatgtgtgtcttagaattgatgcagtggccgggcgtagtgggtcacgcctgtaatcccagcactttgggaggccgaggcgggtgaatcacgaggtcaggagattgagaccatcctggctaacatggtgaaacccccgaatctactaaaaaatacaaaaaattagccgggtgtggtggcacgtgcctgtagtcccagctatttgggagtctgaggcaggagaatggcgt

SEQ ID NO: 165441 - DNA, 893 bp, Homo sapiens
aaaaaatacagctaagtagagctcgagttgaatcagaacgagggagtccggagcctgaggagtctccgggacaggaaccctcagtgctgcgtctagattctgcaggggaggtttgctgggaccttggctccacccagccagcgaaatggcagccacactcgatttgaaatcaaaggaggagaaggatgctgagttggacaagaggatcgaggctcttcggcggaagaatgaggccctcatccggcgctaccaggagattgaggaagaccgtaagaaagctgaacttgagggagtcgcagtcacagctccccgaaagggccgctcagtggagaaggagaacgtggcagtggagtcggagaagaacctgggtccttcccggaggtctcctgggacccctcggcccccaggggccagcaaggggggccggactcctccacagcagggaggccgggccggcatgggccgagcatcgcgcagctgggagggcagccccggggagcagcctcgaggaggaggagctgggggccgtggccggaggggccggggccgaggttcacctcacctctctggagctggagacacctcaatctctgaccgtaaatccaaggtaggagctaggcagcgcctggagccctggctgaggttctctgttgtctgtttctgttttttcctcctctcagatgcacatttgtcctgtgtgtccatctttcagtatctctctctgagcctttgcatctggctctgtttctctcttcctccacctccttctcctcctcctgctccccctcttctagttccccctgttccttccctctcacgcctagagctcgtgtgtttttccttgtctctttctctcctactcctgctccccgtcttcttgttcctcctcgcct

SEQ ID NO: 165442 - DNA, 2408 bp, Homo sapiens
gcctcccgagttgctgggattacaggcgcgcgccaccacaaccggctaattttttttgtagagacgggatttcacaatgttggccagactgatctcgaacttctgacctcaggtgatccgcccgcctcggcctcccaaggtgctgggattacaagtgtgagccaccgcccacggccggtagaacatctgaagcttctaaagcgaactctaaggtttcattggcacgagggggctcgaaccacgccaggcttccaggcgtcagtgcccagtgcttggcatctactgatagaaaccaggaatgaggggctggaggcggaaacagcttgaagaaagaggtagaggccagggagtgaggacggtgtctccttttcctggaagttggcaggaagtgacgcgcctggcccgggagctgcggtcgcagaggccgacggagccggagtcgcggacgccgcggggtctccgggacaggaaccctcagtgctgcgtctagattctgcaggggaggtttgctgggaccttggctccacccagccagcgaaatggcagccacactcgatttgaaatcaaaggaggagaaggatgctgagttggacaagaggatcgaggctcttcggcggaagaatgaggccctcatccggcgctaccaggagattgaggaagaccgtaagaaagctgaacttgagggagtcgcagtcacagctccccgaaagggccgctcagtggagaaggagaacgtggcagtggagtcggagaagaacctgggtccttcccggaggtctcctgggacccctcggcccccaggggccagcaaggggggccggactcctccacagcagggaggccgggccggcatgggccgagcatcgcgcagctgggagggcagccccggggagcagcctcgaggaggaggagctgggggccgtggccggaggggccggggccgaggttcacctcacctctctggagctggagacacctcaatctctgaccgtaaatccaaggagtgggaggagcggcgcaggcagaacattgagaagatgaatgaggagatggagaagatcgccgagtatgagcgcaaccagcgggaaggggttcttgaacccaacccagtgcggaacttcctggacgacccccggcgacgcagcgggcccctggaggagtctgagcgggaccgccgggaggagagccgccggcacggccgcaactgggggggccccgacttcgagcgggtgcgctgtggccttgagcacgagcggcagggccgccgagctggcctgggcagtgctggagacatgacgttgtccatgacgggccgggagcggtcggagtacctgcgctggaagcaggagagggagaagatcgaccaggagcggctgcagaggcaccgcaagcccactggccagtggaggcgcgagtgggatgccgagaagaccgatgggatgttcaaggatggcccagtccctgcccatgaaccatcccaccgctatgatgaccaggcctgggcccggcccccgaagccccctacttttggggagttcctgtcccagcacaaagctgaggccagcagccgcagaaggagaaagagcagtcggccccaggccaaggcagcgcccagggcctacagtgaccatgatgaccgctgggagacaaaagaaggggcagcatccccagcccctgagactccacagcctacttcccccgagacttcccccaaggagacacccatgcagccacccgagatcccagctcctgcccaccggcctcctgaagacgagggggaagagaatgagggggaagaggatgaagaatgggaggacataagtgaggatgaggaagaggaggagatcgaggtggaagaaggtgatgaggaggaaccagcccaagaccaccaagccccagaggctgcccccaccgggatcccctgcagtgagcaggcccacggagtccccttcagtccggaggagcccctgctggagccccaggcccctggcacgccttccagccctttctcaccacccagcggccaccagcctgtgtccgattggggtgaagaggtggagctgaattctccccggaccactcacctggctggcgccctctccccgggtgaggcctggccttttgagagtgtatgaagctggctgcctgtgtgtgtgtgtgtgtgtgtgtgtgtgtgtgtgtgtgtgtgcgcgcgcgcgcgcgcgcgcgcgcgctagaggggtgtggctggtgggggacccttggggctgggccctgggacccagtgtgccccacagccctgtcagctgagggggtagcgcagcccatgctcttctgtactgtcatgcccgtctctggaatgtccactcccagagcctgccccagcccttcgagccccctccccaataaagaattcacatcctccaatg

SEQ ID NO: 165443 - DNA, 2181 bp, Homo sapiens
gtgggtttgactagatcgtttacatgggaactgggtgagtccacaaagatcatgaaagggctgagtctgaatttctatggagaagatggaggtggcagttgaaaggagggagagtgagggctacaattctcttggggtacagggttttttgtgtatggctgtgaggatcccgcagtatgttagagggtgaagtaggttggggggccattggcctttgtcctttttttccctctgtccccaggaaccctcagtgctgcgtctagattctgcaggggaggtttgctgggaccttggctccacccagccagcgaaatggcagccacactcgatttgaaatcaaaggaggagaaggatgctgagttggacaagaggatcgaggctcttcggcggaagaatgaggccctcatccggcgctaccaggagattgaggaagaccgtaagaaagctgaacttgagggagtcgcagtcacagctccccgaaagggccgctcagtggagaaggagaacgtggcagtggagtcggagaagaacctgggtccttcccggaggtctcctgggacccctcggcccccaggggccagcaaggggggccggactcctccacagcagggaggccgggccggcatgggccgagcatcgcgcagctgggagggcagccccggggagcagcctcgaggaggaggagctgggggccgtggccggaggggccggggccgaggttcacctcacctctctggagctggagacacctcaatctctgaccgtaaatccaaggagtgggaggagcggcgcaggcagaacattgagaagatgaatgaggagatggagaagatcgccgagtatgagcgcaaccagcgggaaggggttcttgaacccaacccagtgcggaacttcctggacgacccccggcgacgcagcgggcccctggaggagtctgagcgggaccgccgggaggagagccgccggcacggccgcaactgggggggccccgacttcgagcgggtgcgctgtggccttgagcacgagcggcagggccgccgagctggcctgggcagtgctggagacatgacgttgtccatgacgggccgggagcggtcggagtacctgcgctggaagcaggagagggagaagatcgaccaggagcggctgcagaggcaccgcaagcccactggccagtggaggcgcgagtgggatgccgagaagaccgatgggatgttcaaggatggcccagtccctgcccatgaaccatcccaccgctatgatgaccaggcctgggcccggcccccgaagccccctacttttggggagttcctgtcccagcacaaagctgaggccagcagccgcagaaggagaaagagcagtcggccccaggccaaggcagcgcccagggcctacagtgaccatgatgaccgctgggagacaaaagaaggggcagcatccccagcccctgagactccacagcctacttcccccgagacttcccccaaggagacacccatgcagccacccgagatcccagctcctgcccaccggcctcctgaagacgagggggaagagaatgagggggaagaggatgaagaatgggaggacataagtgaggatgaggaagaggaggagatcgaggtggaagaaggtgatgaggaggaaccagcccaagaccaccaagccccagaggctgcccccaccgggatcccctgcagtgagcaggcccacggagtccccttcagtccggaggagcccctgctggagccccaggcccctggcacgccttccagccctttctcaccacccagcggccaccagcctgtgtccgattggggtgaagaggtggagctgaattctccccggaccactcacctggctggcgccctctccccgggtgaggcctggccttttgagagtgtatgaagctggctgcctgtgtgtgtgtgtgtgtgtgtgtgtgtgtgtgtgtgtgtgtgcgcgcgcgcgcgcgcgcgcgcgcgctagaggggtgtggctggtgggggacccttggggctgggccctgggacccagtgtgccccacagccctgtcagctgagggggtagcgcagcccatgctcttctgtactgtcatgcccgtctctggaatgtccactcccagagcctgccccagcccttcgagccccctccccaataaagaattcacatcctccaatg

SEQ ID NO: 165444 - DNA, 1180 bp, Homo sapiens
tgggctcaagcgattctgtctgcctcgggcctcccagagtgcggggattacaggcttgagccaccatgcccggccctgtcctacttctagtgtcccctgtctggttgaccgtctgtctctgatccgattcctgaccctgacctctcccatcttcttgatcctcttgttaccctgttcccccagctgcccgctcacccgttatctttcccccaggttcaaggatggcccagtccctgcccatgaaccatcccaccgctatgatgaccaggcctgggcccggcccccgaagccccctacttttggggagttcctgtcccagcacaaagctgaggccagcagccgcagaaggagaaagagcagtcggccccaggccaaggcagcgcccagggcctacagtgaccatgatgaccgctgggagacaaaagaaggggcagcatccccagcccctgagactccacagcctacttcccccgagacttcccccaaggagacacccatgcagccacccgagatcccagctcctgcccaccggcctcctgaagacgagggggaagagaatgagggggaagaggatgaagaatgggaggacataagtgaggatgaggaagaggaggagatcgaggtggaagaaggtgatgaggaggaaccagcccaagaccaccaagccccagaggctgcccccaccgggatcccctgcagtgagcaggcccacggagtccccttcagtccggaggagcccctgctggagccccaggcccctggcacgccttccagccctttctcaccacccagcggccaccagcctgtgtccgattggggtgaagaggtggagctgaattctccccggaccactcacctggctggcgccctctccccgggtgaggcctggccttttgagagtgtatgaagctggctgcctgtgtgtgtgtgtgtgtgtgtgtgtgtgtgtgtgtgtgtgtgcgcgcgcgcgcgcgcgcgcgcgcgctagaggggtgtggctggtgggggacccttggggctgggccctgggacccagtgtgccccacagccctgtcagctgagggggtagcgcagcccatgctcttctgtactgtcatgcccgtctctggaatgtccactcccagagcctgccccagcccttcgagccccctccccaataaagaattcacatcctccaatg

SEQ ID NO: 165445 - DNA, 1540 bp, Homo sapiens
gcctcccgagttgctgggattacaggcgcgcgccaccacaaccggctaattttttttgtagagacgggatttcacaatgttggccagactgatctcgaacttctgacctcaggtgatccgcccgcctcggcctcccaaggtgctgggattacaagtgtgagccaccgcccacggccggtagaacatctgaagcttctaaagcgaactctaaggtttcattggcacgagggggctcgaaccacgccaggcttccaggcgtcagtgcccagtgcttggcatctactgatagaaaccaggaatgaggggctggaggcggaaacagcttgaagaaagaggtagaggccagggagtgaggacggtgtctccttttcctggaagttggcaggaagtgacgcgcctggcccgggagctgcggtcgcagaggccgacggagccggagtcgcggacgccgcggggtctccgggacaggaaccctcagtgctgcgtctagattctgcaggggaggtttgctgggaccttggctccacccagccagcgaaatggcagccacactcgatttgaaatcaaaggaggagaaggatgctgagttggacaagaggatcgaggctcttcggcggaagaatgaggccctcatccggcgctaccaggagattgaggaagaccgtaagaaagctgaacttgagggagtcgcagtcacagctccccgaaagggccgctcagtggagaaggagaacgtggcagtggagtcggagaagaacctgggtccttcccggaggtctcctgggacccctcggcccccaggggccagcaaggggggccggactcctccacagcagggaggccgggccggcatgggccgagcatcgcgcagctgggagggcagccccggggagcagcctcgaggaggaggagctgggggccgtggccggaggggccggggccgaggttcacctcacctctctggagctggagacacctcaatctctgaccgtaaatccaaggagtgggaggagcggcgcaggcagaacattgagaagatgaatgaggagatggagaagatcgccgagtatgagcgcaaccagcgggaaggggttcttgaacccaacccagtgcggaacttcctggacgacccccggcgacgcagcgggcccctggaggagtctgagcgggaccgccgggaggagagccgccggcacggccgcaactgggggggccccgacttcgagcgggtgcgctgtggccttgagcacgagcggcagggccgccgagctggcctgggcagtgctggagacatgacgttgtccatgacgggccgggagcggtcggagtacctgcgctggaagcaggagagggagaagatcgaccaggagcggctgcagaggcaccgcaagcccactggccagtggaggcgcgagtgggatgccgagaagaccgatgggatgtgagtctcctccccgctcctctccccatgtggcacgttgaccttggccctgacttctaagtcctatgcctctctctggtttttcctgctgtgtatgag

SEQ ID NO: 165446 - DNA, 612 bp, Homo sapiens
cattttattttattttcgagaaggggtctgctctgtcgtctaggctgcagtgcggtggcatgatctcggctcactgcaacctctgcctccccggttcaagcgattctcctgcttcagcctcccgagttgctgggattacaggcgcgcgccaccacaaccggctaattttttttgtagagacgggatttcacaatgttggccagactgatctcgaacttctgacctcaggtgatccgcccgcctcggcctcccaaggtgctgggattacaagtgtgagccaccgcccacggccggtagaacatctgaagcttctaaagcgaactctaaggtttcattggcacgagggggctcgaaccacgccaggcttccaggcgtcagtgcccagtgcttggcatctactgatagaaaccaggaatgaggggctggaggcggaaacagcttgaagaaagaggtagaggccagggagtgaggacggtgtctccttttcctggaagttggtaattcaggcagaaggaagttggatgagcttgcggaacacccggggggccagtcggccccgctcccgcatccatcgcggaggcgcggcccctttaaggctcccggaaacggtcc

SEQ ID NO: 165447 - DNA, 2573 bp, Homo sapiens
gcctcccgagttgctgggattacaggcgcgcgccaccacaaccggctaattttttttgtagagacgggatttcacaatgttggccagactgatctcgaacttctgacctcaggtgatccgcccgcctcggcctcccaaggtgctgggattacaagtgtgagccaccgcccacggccggtagaacatctgaagcttctaaagcgaactctaaggtttcattggcacgagggggctcgaaccacgccaggcttccaggcgtcagtgcccagtgcttggcatctactgatagaaaccaggaatgaggggctggaggcggaaacagcttgaagaaagaggtagaggccagggagtgaggacggtgtctccttttcctggaagttggcaggaagtgacgcgcctggcccgggagctgcggtcgcagaggccgacggagccggagtcgcggacgccgcggggtctccgggacaggaaccctcagtgctgcgtctagattctgcaggggaggtttgctgggaccttggctccacccagccagcgaaatggcagccacactcgatttgaaatcaaaggaggagaaggatgctgagttggacaagaggatcgaggctcttcggcggaagaatgaggccctcatccggcgctaccaggagattgaggaagaccgtaagaaagctgaacttgagggagtcgcagtcacagctccccgaaagggccgctcagtggagaaggagaacgtggcagtggagtcggtgagctcgtcactggggtgtgggaccctgaggatggggaggggcagagggttgaggcctgggacccaggagcccccagctgtcctgcaccagtgggtggcctccatcctggccgcatgcctccctgccccagtgactgtattttccccatctcccctcttccaggagaagaacctgggtccttcccggaggtctcctgggacccctcggcccccaggggccagcaaggggggccggactcctccacagcagggaggccgggccggcatgggccgagcatcgcgcagctgggagggcagccccggggagcagcctcgaggaggaggagctgggggccgtggccggaggggccggggccgaggttcacctcacctctctggagctggagacacctcaatctctgaccgtaaatccaaggagtgggaggagcggcgcaggcagaacattgagaagatgaatgaggagatggagaagatcgccgagtatgagcgcaaccagcgggaaggggttcttgaacccaacccagtgcggaacttcctggacgacccccggcgacgcagcgggcccctggaggagtctgagcgggaccgccgggaggagagccgccggcacggccgcaactgggggggccccgacttcgagcgggtgcgctgtggccttgagcacgagcggcagggccgccgagctggcctgggcagtgctggagacatgacgttgtccatgacgggccgggagcggtcggagtacctgcgctggaagcaggagagggagaagatcgaccaggagcggctgcagaggcaccgcaagcccactggccagtggaggcgcgagtgggatgccgagaagaccgatgggatgttcaaggatggcccagtccctgcccatgaaccatcccaccgctatgatgaccaggcctgggcccggcccccgaagccccctacttttggggagttcctgtcccagcacaaagctgaggccagcagccgcagaaggagaaagagcagtcggccccaggccaaggcagcgcccagggcctacagtgaccatgatgaccgctgggagacaaaagaaggggcagcatccccagcccctgagactccacagcctacttcccccgagacttcccccaaggagacacccatgcagccacccgagatcccagctcctgcccaccggcctcctgaagacgagggggaagagaatgagggggaagaggatgaagaatgggaggacataagtgaggatgaggaagaggaggagatcgaggtggaagaaggtgatgaggaggaaccagcccaagaccaccaagccccagaggctgcccccaccgggatcccctgcagtgagcaggcccacggagtccccttcagtccggaggagcccctgctggagccccaggcccctggcacgccttccagccctttctcaccacccagcggccaccagcctgtgtccgattggggtgaagaggtggagctgaattctccccggaccactcacctggctggcgccctctccccgggtgaggcctggccttttgagagtgtatgaagctggctgcctgtgtgtgtgtgtgtgtgtgtgtgtgtgtgtgtgtgtgtgtgcgcgcgcgcgcgcgcgcgcgcgcgctagaggggtgtggctggtgggggacccttggggctgggccctgggacccagtgtgccccacagccctgtcagctgagggggtagcgcagcccatgctcttctgtactgtcatgcccgtctctggaatgtccactcccagagcctgccccagcccttcgagccccctccccaataaagaattcacatcctccaatg

SEQ ID NO: 165448 - DNA, 1452 bp, Homo sapiens
gcctcccgagttgctgggattacaggcgcgcgccaccacaaccggctaattttttttgtagagacgggatttcacaatgttggccagactgatctcgaacttctgacctcaggtgatccgcccgcctcggcctcccaaggtgctgggattacaagtgtgagccaccgcccacggccggtagaacatctgaagcttctaaagcgaactctaaggtttcattggcacgagggggctcgaaccacgccaggcttccaggcgtcagtgcccagtgcttggcatctactgatagaaaccaggaatgaggggctggaggcggaaacagcttgaagaaagaggtagaggccagggagtgaggacggtgtctccttttcctggaagttggcaggaagtgacgcgcctggcccgggagctgcggtcgcagaggccgacggagccggagtcgcggacgccgcggggtctccgggacaggaaccctcagtgctgcgtctagattctgcaggggaggtttgctgggaccttggctccacccagccagcgaaatggcagccacactcgatttgaaatcaaaggaggagaaggatgctgagttggacaagaggatcgaggctcttcggcggaagaatgaggccctcatccggcgctaccaggagattgaggaagaccgtaagaaagctgaacttgagggagtcgcagtcacagctccccgaaagggccgctcagtggagaaggagaacgtggcagtggagtcggtgagctcgtcactggggtgtgggaccctgaggatggggaggggcagagggttgaggcctgggacccaggagcccccagctgtcctgcaccagtgggtggcctccatcctggccgcatgcctccctgccccagtgactgtattttccccatctcccctcttccaggagaagaacctgggtccttcccggaggtctcctgggacccctcggcccccaggggccagcaaggggggccggactcctccacagcagggaggccgggccggcatgggccgagcatcgcgcagctgggagggcagccccggggagcagcctcgaggaggaggagctgggggccgtggccggaggggccggggccgaggttcacctcacctctctggagctggagacacctcaatctctgaccgtaaatccaaggtaggagctaggcagcgcctggagccctggctgaggttctctgttgtctgtttctgttttttcctcctctcagatgcacatttgtcctgtgtgtccatctttcagtatctctctctgagcctttgcatctggctctgtttctctcttcctccacctccttctcctcctcctgctccccctcttctagttccccctgttccttccctctcacgcctagagctcgtgtgtttttccttgtctctttctctcctactcctgctccccgtcttcttgttcctcctcgcct

SEQ ID NO: 165449 - DNA, 529 bp, Homo sapiens
taatataacaaaaattaaaataaaggttacttacacttctaaaataaatacttgagaaattattaatgtgtagttatattctgtccctatatgctgacacacagaactatctagtctctttaaaggacagtctatgtataaaacatgtggcttaaatatgtaatcattcatactagaaaaggcgcacaaccaaaacagtatgcaaaaagtttcagtaatgagtacatctcttttcatgtctgtgtcacgtagacacaaaatcctaaaaccaaaataatttgctaaaatataaaattattatttgaggactgacatcagcgagatggtggaatagaagacctccagcatcaatcgcttttaaaagtacaactagcaactattcgaatataaaaataccactctgaaagcaccagagctcagaagaaaagtgaaaaatcttatgggttcatggaaattaaaaaatccatgaccagaaagaagaaagatcattgtgccacatcaccccattctccaaaccaaaatagcatca

SEQ ID NO: 165450 - DNA, 334 bp, Homo sapiens
tttgttctacactgctctgttctaaatgtttgttcccccaatattcatatgttgaaattctaacccccaaggagatagtattaggaggtggggccttcgggacatgataaggtcatgaggatgaagccctcaagaataagattcattgccttataaagaaaaaccagaaagatccctcatttcttcaatcataagaagacacatgagcaagaagacggccagctatgaagcaggtcgtgggccctcgccagacactgaatctgccaacactttgatcttggatttcctagcctgcagaactgtgagaaataaatttcttttctttataatccac

SEQ ID NO: 165451 - DNA, 374 bp, Homo sapiens
tcatcgagcccggcccatctattcgctgactggtcactgtgtaccccagagccttcacagcctgcagcaaataaacctgttgaacttagcatttaacccaacttggcctcaacttctttaaccaataattcctctcccacccccaggggaattgatgtttgcattcaggaagcactggtcagatccagggtcctgcctaatgtagaatccccctggagccctctctctgttggtcttttggccttgctgggacccaaacttctgggtgctcctagctagcaggtctgcaaaagaatgtggaacaaacatgtattagtcacctgctatgtaccacacactcccacctttgtgatgctactgatcagcgacttgat

SEQ ID NO: 165452 - DNA, 195 bp, Homo sapiens
tttcatgagtgaaaaatcacaggactcagttgcttaaccctaacaaaaacctttttgaaataaattttatagactggtgattagcaagtccaacaagcatacccctatctatatctttttaaaattcaagttcaaatgaatctgtcagtattttaatttctgctgcttgaattaggtttacccaaaatgcctaag

SEQ ID NO: 165453 - DNA, 278 bp, Homo sapiens
ttctagatatttaaaaattactttgctcttttagacaactatgtattcgtaaatttaatgatccaaacataaatgtttcccttcattatatcaatgtaaatatagcaaaatcccaaaacctctggagctctagttttaacaaaaattgatgtaatatcatggtcttatagtaaaatatttcttcccatttctttccatagagtcctacaacattgccttggaatttgttcttagaatacttcactgtttgaagttcattagaaaagatgccatcacaa

SEQ ID NO: 165454 - DNA, 409 bp, Homo sapiens
ccctgtctaacccgcagcactcattgcaaaagctatctcctctgatatctacagacacccagcacctcctctggcctgtccattctcttcccagacctcctgggatgctaatcaagggctgggggtagaggacagctggcctgggcagggggccagggctatctctgggaaggcatcctcacacccagacaggatgagcctggttcccaggaaatgcaacagctctgcaccttcctctcttccccagaaagtctacccgtggctgacccaggcaccctccttcaaggccctatgtccagctggaaggccacaggtcaacatcaggagatgcctggggttcctccccaaggccaccgtccacatctgctctgaggatattctccatctcccctcccatggccctgtttgt

SEQ ID NO: 165455 - DNA, 146 bp, Homo sapiens
tttaggagagaagatatttaaacatgtttttactggctaagtagaagtcagtgctcagtaaggtggaagaaattacagatacaagaaggaaaatggctatgactgagaaagattcctgtttaagacaatattaagaacatacatag

SEQ ID NO: 165456 - DNA, 118 bp, Homo sapiens
ctggataattattgtgaggaattagttattactgtaagtgggtatgtataagccatcttcttggtgagtagaattgtaaactgagcctttagttatatgggatcagataatcacattt

SEQ ID NO: 165457 - DNA, 171 bp, Homo sapiens
ctggtccgggtgggagtacggaatggtggacactgagcttcttgggctcactgccctgaccgccaggtgtccctgggagctcatcaggcccgggggcctaggtagtcatcacctgggactcacaggacttcggcatttgccctgtggacaatctaggtgtgcagaaatggg

SEQ ID NO: 165458 - DNA, 344 bp, Homo sapiens
gaaagtcctgcatagctacctggtggaatctcctctggcaacagataaaatacagctaatccccctgggcctgaccccatctcacggccaggggggcccagatgtctttcccggctcagctatctgagtctagggacacggctgactgtgctcaggtcatcaggagatagataggacattcccacctagaaaagtggctgggctacagggaagcctccagagaaccaaactgtgaaaccctctgcagaaacaccaagcctttccttcctgccactcaggctggctcagagaggaggaagaggccacagaaggagcccgagtgtaaaatggaaacccatagccgc

SEQ ID NO: 165459 - DNA, 272 bp, Homo sapiens
ggatagtgagttttatgtacagacagtagttggtattggcatgctgatcaaagacagcattattattctatagtctgtttctaatcataatgttggtattaattgcttatctctgctgcccataaataggaatatatgcttaggttaattcagttttgcttgtgagaacgtgcctaaaattcaaacttaaatttaatttttgtggatatatagtgaagcttttttttaagtctcttctaaagggagaaattgaagtattttgctaatgactt

SEQ ID NO: 165460 - DNA, 121 bp, Homo sapiens
tggatgagatgactggcccaaagagaggaaggaatataatgtcctagactccaggtctcatgacgtcaaggttgtttccactgcaccagggtctgcaaactggccagagggattggtcctc

SEQ ID NO: 165461 - DNA, 155 bp, Homo sapiens
tctcttgaatatgcaatttcaatatgatgaggtaaggtgtgtgggagcaaaacactatggaaacacagagggaaggtacctgctttatgcaagcctacataagaagaatttcaaaaggtagagatatttataacatacctaaaggataaatttgg

SEQ ID NO: 165462 - DNA, 99 bp, Homo sapiens
ggctggtccgatggtagtgggttatcagaacttattaacattagtgtcactaaagttggtatacaaccccccactgctaaatttgactggctttttacc

SEQ ID NO: 165463 - DNA, 801 bp, Homo sapiens
  misc_feature (770)..(770): n is a, c, g, or t
tccaaacccaatcaactattttagttatgtctttgtgtttggagttgaaatagcaaacagaggaaatgtgttacaaattcatttaaattacatttcctggtcactaatctgtacagcagatacacagaaatatgcttcctatgctctgtaactaactgtttctttggttgtcttgactttaaaacttgtttgttatttagtattcttttagaggaataattttactaattaagtttattattttattaacttttaagttcaatattgtttataagagcatcataaaattttaattctgttacatataagctattctggcttggacacattttttaaccttttaacctttaagcttcagtttctgtgcctactaatgtaggtatgacaatagtattaacttatatgctgtgaggaataaaatgttaaatgcatgtatagtgctttgcacaatacatggtgcaaagtaatcaagaaaggtccctgttaataatatatgctgtattaacctgtataatgtagttaaagtttttggtaggtaggctgtaaagaataagacataatttgtggtcatgctgaatgctaggtattatttacagtctatgaatatggactttttttttaatacggtatttaaaatagtagtactaagaaagtggtgaacagtgatttagaaataataaacttgtaatccaaatagcctttagaaaagttactgctaacctctgagttactaaattcacagtcctcaataaggttgattggtgacgtcnaggggtatactctaggaacagctatgacgat

SEQ ID NO: 165464 - DNA, 773 bp, Homo sapiens
tccaaacccaatcaactattttagttatgtctttgtgtttggagttgaaatagcaaacagaggaaatgtgttacaaattcatttaaattacatttcctggtcactaatctgtacagcagatacacagaaatatgcttcctatgctctgtaactaactgtttctttggttgtcttgactttaaaacttgtttgttatttagtattcttttagaggaataattttactaattaagtttattattttattaacttttaagttcaatattgtttataagagcatcataaaattttaattctgttacatataagctattctggcttggacacattttttaaccttttaacctttaagcttcagtttctgtgcctactaatgtaggtatgacaatagtattaacttatatgctgtgaggaataaaatgttaaatgcatgtatagtgctttgcacaatacatggtgcaaagtaatcaagaaaggtccctgttaataatatatgctgtattaacctgtataatgtagttaaagtttttggtaggtaggctgtaaagaataagacataatttgtggtcatgctgaatgctaggtattatttacagtctatgaatatggactttttttttaatacggtatttaaaatagtagtactaagaaagtggtgaacagtgatttagaaataataaacttgtaatccaaatagcctttagaaaagttactgctaacctctgagtacgcgcaaggttttcccaatgtaaggacgtccaggtctgccgggc

SEQ ID NO: 165465 - DNA, 505 bp, Homo sapiens
tcgaaagatagaacttggccccaaaatcatgcaatcattttaaacaatttctttcatggtaccagagacaccacaccatatgaaagttgctttgggacctgttcaagttgaattgtgctctccaataattcacatcttgaaatcttaacctccagtagctcagaatgtgactgcatttggagacagagaaataaggaaaaaatgtagatgcaggcggatacagagcaagggtgatgtaaacacacagggagaagacagacaccagtgagctgaggagagaggcctgaaacaggtcttttctttacagcacttggaaggcaccaaccctgtcgacacctcgattttggacttctggcctcagacctgtgagacagtatattcgtgttgtgtaagctgcccagttgtagtacttttccacagtagccccagcaaatcaatacagggcctacaggcatggatttctgttccagttactttgctttgcaataaatgtccctaaaacttc

SEQ ID NO: 165466 - DNA, 179 bp, Homo sapiens
agtagaaatgaccagatgtagtcagtatctatggatcttttctctagggtagtcagatcttactcacctaaacctggctgccagtgctctggggctggggttgcactgattgtgcagactttcatttaagatatcttcctattttcagtttcgtgcctcattcctttcgttctctgggt

SEQ ID NO: 165467 - DNA, 592 bp, Homo sapiens
gtctactatcctaccatcatatgtgaaatagaggtcattaaactttcatcttcaggtcaaataaaaacacaaagagaatgactccctcttccagagggtcaatccaacagactgaaattatagaagcagaagaaaaacagaacaacatggagctcctctgtaataaatctaccttgactattttggctgtgaaaagttattactgtttgtggaggataggatttgtagctgttatccccaagacattatacaaacgaaaggcacatcccttttggggcctgcaatggaaatgaagtagaaaaaaaaatgctttcgctttctggctgcctagctaaattgcaaaataaaaactggaatattaactccttatgtgcaattcacaaatagtgggcataatgatatgaattttcacatttagtacaattatactaaaaagggaataatagctattaaagtgtataatgctatgttttcgcaaaacataattttccaccagaaaactaaaaacctaaataattttttgggcaaggggctagaaagagcatagaaagtgtcagtatagctctgtttcccaatctcttccaaattattc

SEQ ID NO: 165468 - DNA, 410 bp, Homo sapiens
aacctattaggaaattctggcacatttataattccataagatgaggaaaactatttgtagggtcatggagagaagtgacttaccagctgcaccaatagtgccttgaagatgccgtggcctgactacgtaatgactgtcttagtcatgacaccgataagcttcaaatctacaccattacagtttgtacaacaggttggcttaatgaggttgatgcagatgctcaagagcagttattaaatcctcacaatgagactttagcaaatgagggcttcaacaagttgttgccagtaagtgataacagtggaagccactcagttgcatcagacacatgtgtaaggtgctctgagtgctagacgctggtacagaactccaaaagaaaatcaggcctcattgccaaagctcagggataa

SEQ ID NO: 165469 - DNA, 209 bp, Homo sapiens
tgtctgtttctatatattcaaatttctcatagtttttggtcacattttacttctcatgtctaggtcttttattattggaggttgaagtgaatattacgatattgagggtctagatttttttgttttccttgtagatagctgaatttgttttggtaggtacttgatttaatttacttgcagcttactaagactttcacactcttgcatta

SEQ ID NO: 165470 - DNA, 216 bp, Homo sapiens
tgaggcagaggctgcagtgactccagattatgccactgtactccagcctgggcaacagaccaagactctgtctcaaaaaaaattaattttaaaaaagcaaaacaaattcagaagttaattggatgattagattaacatgagatgcacagtgtggccctgttttcatgtgtttctgttcatcagagcagcccctttattcagtgattggctttataa

SEQ ID NO: 165471 - DNA, 331 bp, Homo sapiens
gaggaaaaaacaaatgtaagttggtcactaagctgtccacagctgcacgagcaaacacagactgttgcttagtcatgtgaagcatctacagacaggctgtacaggacaagtcagttagattgaggaagaaaaataatttatctgccaacatcttcctatctctcatttcacattggtcaaagctcaccttatggtatgttactgtccctatactttcagattatatcccctgaccccagtaggcaattgttggggaagttagatcctacaccgtatgctttgtggcttcactggaatctggaggtggcaggaggaactgagcttccatgtg

SEQ ID NO: 165472 - DNA, 298 bp, Homo sapiens
accacctaaaccgaaaccagctaaacctaaaccagccaaacacaaaccagataaacctaaaccagctaaacctaaaccagctaaacacaaaccagataaacttaaaccagataaacctaaaccagctaaacctaaaccagctaaacacaaaccagataaacttaaaccagataaacctaaaccagctaaacacaaaccagataaacttaaaccagataaacctaaaccagctaaacttaaaccagctaaacctaaactgtcactctcccctactctggtcggtctttctttttcctac

SEQ ID NO: 165473 - DNA, 578 bp, Homo sapiens
ttcttatcacctttactattaccatgctggttcagctgacagtaatctcttaactggtcatctgttccaagtaccctcattcccatccctgtttatggcatctattgaccacttaatagctgaagtaatcttttttttttttttttttttggagaaagattctcattccgtcacccaggttggagtacagtgacacgatcttgtctcactgcagcctccgcctcccaggttcaagcaattctcatgcctcagcctcctgagtagctgggattacaggcgtgtaccaccacacccggctaatgtttgtatttttaatagagacagggtttcaccatgttcgccaggctggtgaagtaatatttttaaagcctaaatcagacctgcgcaaaatcctccaaagaagtgctgatttcaggtctggggcaggaaatgtacaagatgaatctcagaggataggatagtaacagagttccagaaatgatgaggagagaataaagctataatcataaaattggaaatgttgcctatgacagaaacaatagaggccttttatgagacccttcttaagatcacatcaa

SEQ ID NO: 165474 - DNA, 198 bp, Homo sapiens
actgcaaagtgggaactgatttgtaaaggagcaaaaagggaaatgggggaccaacaggaagctactacagtggttaggtgagagatgataatgtggcttagaagatagcagtggagggggaaagaaaatagatatggggtatgtaaaaggaaaagaacaaatagaatcatcaagataagaaacactcaaaaggccaag

SEQ ID NO: 165475 - DNA, 451 bp, Homo sapiens
tattttattttattttatctatttatttgtagagacagggtcccactgtgttggaaaaggcaacctttaaaactcttagaagaagacacaatagaatatcttactggcttcagaaaatagatttttttagaaaaagaaaacacaaaacactagtcataaaagaaacaatagataaatttaaacatattaattaatattaagagtttctaatcatcaaaagacactctaagaaaaggaaaaagaaacagcatacattgagagaagatagatagcagcagccatataactgcagtctccagggaagttcccatgatatgcttatcaggacacaaatgcaagaatgtctatagcagcattacatatagaaaaaaaagaattcaaatatccatggatggtagaacagaaaaatggtgctatattgacagaatttggaatattatacaatgataaa

SEQ ID NO: 165476 - DNA, 271 bp, Homo sapiens
aattacgttgtttaagccacacagtctatgttattttgtcatggcaacctgagcagaccatatgcactaccttgcatgtagcattcaagatggcaaccagaatttggctagtattttccaaaatcagccctggagaaactatagaaagaatgagataacagtatcaacaacaggaaagaagcaaaaatgagaaattcctgagggacaagaagtctgggttgaaccattacttatgtgtgggaaacaggtgggggcataccctcaagtggaa

SEQ ID NO: 165477 - DNA, 542 bp, Homo sapiens
cacaaaccttagttcataaacctctttcaaaagcccgaagaaaaccgtttctgtgctctgactgtagaatagaaaacacaacggtcacagaaagtaattgaaggcaaagcccaacaggctgcagcctgaacttgtttgagccgtaagcccgagcctagcgtcgcacgctgggcgactcccctcaggctctcaggccggcgccttcgggggaccacgtagcgccccagcggtggcggctgcgcccggctcagggcggtgccgcggccactggctcctcctcggggtggggcgggccgcgccgggcgagggcgggaggaggagcagccgcagcggcgtgaggagctgccgcgcgaggagcgcgtcgcgtccgcacttctcctgcccgagagagactgagccgcgctggcagctcgcgtcgagtcggtctgccctagccgcatcccgcggcgcccggtcgggctccgggcaccaggcaacacctaggccgttccctttagacagccccgggccagcggccccctcgggaaatgtccagcggccgc

SEQ ID NO: 165478 - DNA, 273 bp, Homo sapiens
tgaggggttgtgcatcatctggggccatccaggttggaaggcacaagcttattttccagggggaaaaatggagttttaaaatccattctaaaaatgactcaagggctgtaggatggtgcgccctctgtccgtgtggctctccggctcggtgggatcaatacctagtgctgggggacttcacacatcactttcccagccgtggctgaaatatgtggcttaggagagcatctcttccctggagaaggcttggtttctagaatcacagagcaatac

SEQ ID NO: 165479 - DNA, 287 bp, Homo sapiens
ggagaggtgatgaaggaaacagggaggagggagaggtgatgaaggaaatggaggagggagaggtgatgaaggaaacagggaggagggagaggtgatgaaggaaatggaggagggagaggtgatgatggaaacagggaggagggagaggtgatgatggaaacagggaggagggagaggtgatgaaggaaatggaggagggagaggtgataatggaaacagggaggagggagaggtgatgaaggaaacagggaggagggagaggtgatgatggaaacagggaggaggga

SEQ ID NO: 165480 - DNA, 169 bp, Homo sapiens
cccttctctgttcttctccagaagaagctggtgaaaggcagaggcaacacctgcttcctgcagtaacctcagagccttaccagccagctctgcttcctgcctgcttttggtacgtgctttgctttcttgccactccacagcttgctgtacatggaaggtatctgtccct

SEQ ID NO: 165481 - DNA, 452 bp, Homo sapiens
gcaatgggatatgcctggaactgggggctggcttctgataaatggtcagtttaagcctttacaccacaatatatgtacacatacaatatgagtcacccagggcccctaaacatttgacatgttctcactatcactaaaaatatctaaatcccatgaaggagtggggagaggacgaacacttggaaaaagtaatgagatcaagtgtaaggaaggacagagatgctgggaatggacccggtcccacggaaggttctagctcaagtccttggtccacacgggagcccctgggttgccaggaaatgggcaatctcaaccccagtgcctgtggggctgtgagggtcccttgggccccagaacctgaggaggaccctggagaggcgggaaggcatcttctgtgggcttctagaagtctcgtcacagatgctacctcttttctgaaattttacaactca

SEQ ID NO: 165482 - DNA, 257 bp, Homo sapiens
gtaagtttaaacaacaacaacaacaaaataaacaaactaattgctgatagataatggcagtcactgttatttattgaattttgaatccacgttttctgcatattttatgtctgatgttctggtagatgctgttagagttactttaagtaataaaaatagtttgctggtaatgtctattctcatttcaggtagaaacaataccctttctaccacttattttattcaattataaagtctccactttaatatataatatg

SEQ ID NO: 165483 - DNA, 569 bp, Homo sapiens
ggaagacccagaatgaagtgggcgaaagggataagggtaggtgaaggaggagtggcaaaaggtccagagagaggccctaacaggcctatagggaactggagcctgggaagctctggactggcttaggattctaagctcttctctgcagaaaacatctatccagctgcctgctgggtacatccaggtggattctgacaggcaccttaaacttaaggtggccaagctgagcctgtcatagtccccccagatctactcctcccaaagcaccccccaaactcgttggtacatatcaactcacttcttcccattactcaggccaaacctcaggactgtccttgactcctctctcccaagccatcagcaaatcctgttgactccaccttcagtagttccccagaacctgaccatgcctcgccacctccactgccagcccctctggtcccagccaccagcatctagcccggatgattccaccactggtgctcggcagtctctcagcccagcagccagacggggcctgttaaccctgggagaggcggcgtcatgttaagttctacttcatacccctc

SEQ ID NO: 165484 - DNA, 889 bp, Homo sapiens
tgggaatctagacacagcaacagtaacaacaacaacaataacaatgaaggctcactgtgaaaacatcaattcattaggaaagttacatcccctccgccactgtttcagatgctgtttctcattctccatgggagcagccagcatcgtgtttaggatggggatacaatagcctgagctcctgattgagtcagaccctggactttcccttttgtatctgtcattttcctctggatcctcacacctttgtgtttaatttttttaaatttcatttgttgacttcctatgtggggtaaaatgacttcctttgattaatgtactttctgtatcctagagtttccctttccctttgtgatttagtccaacgtgtcctactacagcctcaaaaattgtcattggaatcaaaagctttccaaggtgcatcaggttaatgatttggatgcatcctgaggttgtctcctgtagcatggaggcattataataggagtctcagaagttacaccatttttctacagcacatcacaggcccagaggcttgaatctaagagaatccactctatgtctgtcagcctgaatccttccttcttgctgcacaacaaagcaactgaacgtattttgagtttaggtgaaaactatcactcattcatcaaagttctatctgggtgatatatgctatcgaaacagatgtggacactgggctgacagatgttgagaacggacctgttgctgaagctcatgttatcacacatgctgtgggaagagaggtcattggcattcaagatgcaacacctacaatatggtgaattaaagatgccatttgcatggatcttggattagtgcttgtaatttgatttgcgtatttacattgctttggacatatagttgtcatcct

SEQ ID NO: 165485 - DNA, 609 bp, Homo sapiens
ctctctctctctctctctctctctctccctctctctctcattccctcacactcaattagccctccatatccatggcttccacctctgtggattcaaccgactgtggattgaaaatatttttggggaaaaataagcataattgtatctgtactaacataatgttgagcacattacaatacattacatcagggtacattacaataccctaaacaataaagtataacaactctttacataacgtacattatattagatagaagtaatatagggaatcctctgaaggttatatgcaaatataccattttatatcagggacttgaacatccctagattttggtatctgcatgggatcctgtaatcaatccctcaccgataaaagggacaacagagtgtgtgtgtgtgtgtgcgcgcgcgcgcgcatgtgtgtgtacacagtcatccctcagtatatgtggggaattggttctaggactccctgcagatacccaaatccacacacgcttaagtgccacatcagccctgcaaaacttgcataggccctgtggaacccatatatacgaaaagccagccctgagtacgcaagggtttcacatcccacaaatactgtat

SEQ ID NO: 165486 - DNA, 255 bp, Homo sapiens
cgagatcatgccattgcactccagcctgagtgacagagtgagactccaacttaaaaaaaaataaaattattattatttctagattttaacaattggaattatcagttatatttgtgcttgcaaatttgtgggatctctttttccccttctcttccttattgaactttagcatgctagactgtcttcattattcatgtatggagaagaagattctcattttgtggttttggttgttcttaataccttcataataat

SEQ ID NO: 165487 - DNA, 244 bp, Homo sapiens
aaattgtgaggctgtactttctcattacttatgtatatttcacccagcagtgaaaatgtctcttcaggtaaaccaaggagatacatcaatatcttaattttagttccaagtgtatacacgattcgtctaaagtagaagagtgtcacttgtatgctattatggttttggggttgtcttttattttttatttatttatttatttttgagacaggacattgctgtcacccaggctggagtgcagtgg

SEQ ID NO: 165488 - DNA, 703 bp, Homo sapiens
gcacaggaagtcactgagacagtggaaatgtgtgaaaatcccttaggggatcacaaaattgctagcaaaggtagctaagagtagagtaccaacatcaagagacagatggcagaggaaaagccagaaaaagatgaagatagtgaaaatacacatgccatgggtgaagttacggggacagaagagttagaaggagcccttgccacaaagagatcaagtaggaaggagatcaagataaagcccctacattagaagggtccagtgacctctataaaaataaaaatgatttctgaaaagggatgaggataaaagccaaattcaagttatttaattagtgaatgggagtttgtaagtatagatccctgtttaagttttgcgccaaatggaatgatgaatggagtgattcttcttgatcagacagaacggtcaagagatgtgtgtgtgtgggtgtgtacatgcatgtgtgtgtgtattgtttagaatgaaacacttagatgaatgaaaggaaatagtggagagacacattttaaaaaggagagaaacagaaaacatggctatatggttccaagtaccatgtaccgtagatggtctccaaatcatatttatgagcaaatactttttctcctttcctggacgtaaagatatactgccaccaatttacaaggcttataaagcagacagccatgtctattttagaatagctata

SEQ ID NO: 165489 - DNA, 256 bp, Homo sapiens
aatgtttttctaagcttctagaccttcataagccataagtattaagcaaaagattagagagatacagcagtggtatggtataagtgtcataaacaatggcttaactactgggcaaaattaaactaatgtttactgagaatcagtttggtgctagtcaattattatcactcagtcttcacaaatatcaaatgagtcaagcatcattttgcttattttatacataggctatctatgtaactgatctatgtaactaagg

SEQ ID NO: 165490 - DNA, 531 bp, Homo sapiens
gtaaccacaagtgaagagaatatatttaaataaatcaaatattatgaaccaaactgccctaagaatttaggttggttgtttcacatttgaatcacttgatcagtttaagtatcttttgggtggaaacatagcctttgcatttagccattaaaataaaattgattaccatggtcataaagcttacaaagcaatgagatactttatggttttcagatttctttacataatcattttcctcagtcttctttctctatccttttcttttcaagaacaaaaacaactggtgatattcctaggacaagtcctatatatttgtctgtctgtctgtctgtctgcctatctatctatctatctatctatctatctatctatctatctatctatctatctatcaggtcttgctttgttgcccaggctggagaactatgccctggttattctaatcccaattacatgtacttagcaaagtgttatactgatcttgaggaaaaccagaatgctttgaagttctgtaattttggcattattgct

SEQ ID NO: 165491 - DNA, 320 bp, Homo sapiens
caaagtgctgggattacaggtgtgaaccgcagtgcccggcctcttgatgcatttcaaggcagattgtggacatcattgcacttcatcccaagacatttcagcatgtatattaagtagagttcaatattttaatgcttttttttcttttgagttcaaatttacatacaatgaaatgaattacttttaagtgtgcacaaactagttttgaaaacttaagtagaggccaggacggtggctcactcctgtaatcctagctctttgggaggttgaggccgggggatcacccgaggtcaggagtttgagaccagcctgaccaacat

SEQ ID NO: 165492 - DNA, 522 bp, Homo sapiens
gaaatggttagaatttaatagcctattcctactcttatgaactccttcctcagagaggtaggaagaatggcaagacttaaacagacgaaagaagggaaagtgctgtctagattatgaaaaatgccaaaggattgtaaattaatgatgtaatttagatggggacatgagacggaccagaagtgagcaatttatttggctccgatttggtcattgcaacttggtggttggctgcagcacccaaaataattcaattacctttactgagcctgtttttttcttgttttaataatctgtagcgtaacaatttctactttatagagttcccgagaggacaagatagtgtatatactggactccccgtgagcagaagtaattttcacgctctggctctcacacctgagcacacatagcaaacgtgaatgcatatgctggttgccatacttgaaacttcatagcattcttcataacccctgcaccagccttctgcactacctaccaataaatgcatgcgtatttcagttt

SEQ ID NO: 165493 - DNA, 315 bp, Homo sapiens
ccccgggcccagttttccccactcagggccgtagcagagcggggcaaagccagccggaccctgagtctgtgctggggtgaccgcgtccgtcaagtccgcctccccagtagagtctgtgaggggaccttcctggaaagtagggtctttttggatgtcattgggtagggatcaagatgagatgaggtagctctgaaatccagcacaagggtcctcagaagagacaggagaatcacttgaactcgggaagcagaggttgcagggagccgagattgcgccactgcattcgagcctgggtgacagagcaagactctgtct

SEQ ID NO: 165494 - DNA, 143 bp, Homo sapiens
ctgaagagaaaccggagaattttgttgttgttttaggttttacgttagtttgtttgagttgggagctgatctgaaggttcgaattgcaaacagcaagagtgcacttgggaggaggggtcactgctgctggaagtgagctttag

SEQ ID NO: 165495 - DNA, 102 bp, Homo sapiens
actcttctcccatattacaaacattaataacagcatatcgctcacctatccctaatctcatatggtacatttttccaactcttgacatgacctataaagaaa

SEQ ID NO: 165496 - DNA, 496 bp, Homo sapiens
cttagacgtatcttaatctataagaaagagacaatgcagccgggcgtggtggctcatgcctgtaatcccagcactttgggaggcggaggtgggtggctcacctgaggtcgggagtttgagaccagcctgaccaacatggagaaaccctgtctctactaaaaatacaaaattagctgggcgtggtggtgcaagtctgtaatcccagctactcaggaggctgaggcaggagaatcgcttaaacccaggaggtggaggttgcgacgagccgaggttgcaccattgcactccaggttggacaaaaagagcgaaactctgtctcaaaagaaaaaaagaagtaggggtgtgggtatagacagggttatttttttgttttttgtttttttaaatacccttccgtcatcttctcttcttttgtcatttacatctacatctttaaaaattggagataggaaatattctgattgagtaaacttatttaggttctggtaaagttttg

SEQ ID NO: 165497 - DNA, 689 bp, Homo sapiens
tctagaccttctaactcttcctggttcccaattcctttattctgccctctaggagggtcggatctcttctaacccgaatagccttcatttattaattctgctaagtactaagctataacctcatttccttcacttccaagcaattgaaacacatgtgttgtctttgcctttcctcatcacctaatttttcctggccctctgcagtgcctccctacccaagatcgctgggaacagcacaaaatcagtatccatgtcttggccaaatccaaaggcatttttagggacctcacactttttccttttacaatatctaagatgacagacaacttttcccttctggaaagctctcctccctccatttcccacttacgactgctcccccacaccagatttagtactcagacccttcttgtctccctccatctaccctctttcatcagcttagtgacctctctggagatggctcttaatttatatctctagccccaactacttccagaactcatgacacccacatccaaatactgtctgaagttacccatttaaacaagctctcccacacagctcactcatttctcccagtgacaccccctaagtttccacagcccctgctcatttgtttccagattcaatacattgtgaaagcctcttgatccttttttaacaactgtcagttatgctgttctcac

SEQ ID NO: 165498 - DNA, 494 bp, Homo sapiens
aataagatgcagcgaagtccagaatctgtgaaatcattttggcccaaatgagtcttttgtgtcctttgttcatggagattgggtgaagcaaggtgcacctgtttcaatagtaaagcagccccactgaggaaaggactttttgagttgtgtcattagaagtcatcattgcatatgtgagagaagagaggaaggaaagggcaggatgcagtcacataacaggatcatggaattctaaaattggaagaaatatgtttctagtcatctagtatagcttccaatccataggatgaatcctcatggctaatgaaagcctggaagaacattagaaccaccatgaggaggctgctgggatgcaatggtgtggcgtgatctcggctcactgcaactaatttggagcatctttctaagactttgcatgtaaatgtgactggatggccatctgtcaggaaaagactagaagaattgaattggaaaagcgaaaaaaataaaagtgg

SEQ ID NO: 165499 - DNA, 232 bp, Homo sapiens
agagactgttgtggcggttgcagtgtctagagggttgcgatggaagctcttgtgctgtcaacttaatgcctgttggggcatccctaactggggtcacctcacacttgtctaaccccagaagaacaatggagtcgagtgtgtggccaccttgtttgaaagtgtaaaggaaaatttaaattgatgggaccacaatcataaaaaaaaaataaagttaatgattttagaatcatga

SEQ ID NO: 165500 - DNA, 498 bp, Homo sapiens
aggaggaatcatgtatctcatagtcataatgacgaaagtaaaatattttaaattctaatgttaaataccttaaaacaaatatgatttaatagcttgggatatagcacttatactttgttggtattacttttagtaaataggctacctggtcaggctccctggtctgtgccaggtaggatgggctccccagcccctcctcactagtttcagcctaagatcatatgaccaaggaacttaccaaagataaggtagaaatgtggctattctctgatttcctttaccttcctcccttaagaatcagatcaagtttatcctgccctctgtgtggtctgtatttatggggatagcaagaaagtcctattgtcttagagtgcgtgttacatagaaagagttcacaaattgtgaaatattaggtagggagtatattgatggataccttgaatgttctgtgagtgtccatgagaaaactgtatcccagtctctcatggacaaatagaa

SEQ ID NO: 165501 - DNA, 286 bp, Homo sapiens
cacacatgcactctcacacacatccactcacacacacatccactcacacacatccacacacacacaatgtttggctaactcaagacttggtgtttatgttaatgattttagcccatccatgtagaggattatagatgttgccggccctttcttctctgtagcattgatcccggcttggtgcttggtcttcaaattgtttacagtgttgtcactcaggaatgcccagcgtgaggagaaagaatcccctcttacattcatgctcacacacacatccaccctcacactc

SEQ ID NO: 165502 - DNA, 424 bp, Homo sapiens
tatcttttttttatcctacaaaattgaaataactactggatgggcctattgtgagaattaaataagcatacatatataagattctgaaatataatagatgcccagaaaatgttatttactattttattcctcatttccttttcttttcttttcttagtcaataagaagtatcaaaaaaaggtaacatatcttaagcatgaggtctgtcctttttttaaaatattttttagtttggaatagttttatatttacaaaataattgcaaaaatagtacagagaatttccatataactcatacccaatttcctctatcattaatatcttacatttgtatgatgcatttgttacattaatgaaccaaacgttgttattgactaaagttcatagtttattcagattttctcatttttcttcaatatccttt

SEQ ID NO: 165503 - DNA, 578 bp, Homo sapiens
aatattatttcaaaatattatttcaaaacattatattgagtataatattccaaaatattatactcaaaatcagatcaactcaccagcatctaccttcactaatcaaaaccaaacaaacacaaatcagatcaacttaccctaccagcatctaccgtcactaaccaaaaccaaaaatcacctctctaccctagctggtgtcccctagggtaaatccaaacaccattgccactgaagacactcaatggtttggaatcagtttgcccttccagcataattcccttccaacttgcctttgcaacttccatctcaccattgcaacctacactctcatcaaatcagaactcctgaagtttcctaaacacattatgatggctctgtccagtagaacttcggataacacgttcgcgagctcgcgaacgtgttatcctcaccctcttggcctgcactggaatgaccaggactctggggctcctgggagtctgtagtaggtggtcctgagatgctccagtccgtcactcgcttcctaggagggcacagagtgtcctaaaggggactggcctccaatgggcctgggaaag

SEQ ID NO: 165504 - DNA, 334 bp, Homo sapiens
taccttggtttctttacttataaaatgggaatgacagtacctagatcatggggttgatgtgagcatgatgcatgtgtttaaacatgacataagcaaagaggatgcagagcttagtattagttctagttgccttcatgccttacagacaaggatcctgtctgtgtgtggaatttatagaggaatgcagttaaggctcaaagggacccattccttcccccattaccagcttacctgcttgcttcttccagtgctcatccctgcctcctccctggctccatgcctgcctttctgctgaggactcgagcatggtgctgaagctcacttgcttggaatt

SEQ ID NO: 165505 - DNA, 312 bp, Homo sapiens
cgcataactatacagtactataactttactatgataacttcactgagcaacggtacaaatcgacaaatggacaacagtttctatcattgattaatcaaataatcagaagtcaataatctgctaagaatattctgacctctactggcccttggcaatagatggagacagaacaatgccgcaaacgtgaagacagcctcccactctctcctctcccacttctcctacaggctttgaggatcaccacgtttcgctccttcattcacatgtctctgacattttagagtccagaacatcacaagatacccataattt

SEQ ID NO: 165506 - DNA, 322 bp, Homo sapiens
ccccgcttctcctccttgtcagtccacaggtatgagggcagcagcgccaggagtggggtgctgagggcaggcagaggatgcttcagaaacacctgtgtagtaagaggggagggtaatactcatgctcccaggacggctgaggattcaatgaggctgaagcaattctgttgagatgagctgtcttgtagacaattgagggtttattctgagagagcaggtggtgaaggagctctgggtctgagttctcgtcctggctgtgtggccctgtacacgccacctctcccagcgtcagcctcctcacttgtaatatgaaggtagccat

SEQ ID NO: 165507 - DNA, 502 bp, Homo sapiens
  misc_feature (96)..(96): n is a, c, g, or t
cccggccccggccccggccctgcggctctcaccctggcccggcgcggcccgggcgcgcggcggtcgctgtggctgaggcagggcagccagaggcangcgcggttccggggcgctgcagtccacgccgacggcgcgctcccagcgccagcccccggcccccgcgcgctccacgcgccacacggcgctgcccaccagctccgcggccggcgggggctcccgggcccggccactgccccggccccagtacgccccaggccgggcttccggagacgcgcgcgccgcgcgggggcccggggccgctgctaggcgcccggcagacggcgtcctcgaccccccgggcggccggcgggccccgggggtccccgcccgccccccggagccgcgggcccggggcccgggggccccgaagggacggacggcccgcgcggacggcggcaggacggctggattggctccgcgcctcctgcgcctcccggctgaaggcgcccgagccccgacacgc

SEQ ID NO: 165508 - DNA, 423 bp, Homo sapiens
aaaatgaggctggctatatgagaagaaaatagcatgtaaggggtgacacgttctgaaaactaagagtagacagctttggaaatgtcacgcccacatgatgttttgtggtgatgtttattatttcaggggaaccggctgtccttcaattaaatgcagctgagggaggaaggccagcaggagaggaggggcatatgaggggcttccctgtgagcccgcggccctaagtcagtgtagggcagctgagacaagaaccaaagtgtggacaatgtccttttgtacctgcttggagaagagagaagtaatgatggtagattttagtacattatattacaaaagattacgtgaaaaatggtgctccctcttatcccagggacagagcaagaggagtttaggtgagctttcaggaagaattcattgacagaa

SEQ ID NO: 165509 - DNA, 205 bp, Homo sapiens
aaagactcagaattaaagggttggaatctactcctagtggaagatctaccagagtgtagaaaaagtctttttgatcctctaaaggaaagtctttttcaggcctcctaggagggagatgcccacatggagggtgagctggaggggaagaagtgagtgactgtgggctatggaaatcctgggtcatagggagctacgtggaggggtc

SEQ ID NO: 165510 - DNA, 590 bp, Homo sapiens
agaatgccccgatgagtgccactggctgagcagacatgtcacatggactgcccagccaggaagggaggcctatcataattttgtcccccacttgtgttatctcatagactacagacttaaatttatttcttaatatgcatactatttaaagaaggaagttataaacatttgggcattatcttagagaaagcagaactttctaaagagagtgtctagaggctggaccacagactaacatccctgttggttgaaaaattgcaggctgtcttgtcctgttggaaagcattattttaacagattgcttaatgcttttccttcctgtagcatgggcttgggggagtggtactcaaagcagacttataaattggattgtatagtgaatgaactttgcttaatggctttgctgggtttatttaagacattgaactgtttgcccttgtctccagtggttcaatgaccactcatcattacattagtgggagaactatcatactgtgttagagatacggagagcttgtgactgggtgaagagtcagtgttttgactttttatgccaagatttactcatcggggatcctctataatcgcgg

SEQ ID NO: 165511 - DNA, 406 bp, Homo sapiens
aggtcaaggctgcagtgagctacgattgcaccacagcccttcaggggaaaaaaagaaatctgcagtggttcctcactcacaggataacaacttaaacctggcatccaagttggactatcatatggtcccaactacctttgcagctttggaattaaggcatcaggtctaggcacatgaatttcctggttgcacttgttttgtgtggggtggcaggaagaaactcaggccatcggctactctaggcactgccagagtcacttattctttccagaacttggcttcctcatctaaggtgacagacaattgaaccaactcgttttaaagttctcttccagttctgccctgtgtagtatgaagactgtcctcttctacttttgtacttcctacctcttctagaaccccagcc

SEQ ID NO: 165512 - DNA, 236 bp, Homo sapiens
gctgggattagaggtgtgagccaccatggctggccacatacttttattataaaactcattttcctcatcaaacagtggtaatacacttttgcaaatgttaatgtgcatttctcttttgccattctctgtacttcaccatctgctttgtcagcagagctgtttgccctgcggatttgacagcagtggtatggcaggtgagtgattagcaggagtgcaagagaaagcattcatgctca

SEQ ID NO: 165513 - DNA, 222 bp, Homo sapiens
atgctactaagtaaaagctgacaatcgcattttcctcaccatcttcagaacctggtgtatgatttttactgtgttttctttgtatgaaaaaagctttttaaaaatcacggtattgggcatttgaattgcttttattgaaaagagtagagtaatacattggaacggcctttgaagactgggttcgttgtcaccttgcctgtcctggtgggtatgtggcctgat

SEQ ID NO: 165514 - DNA, 167 bp, Homo sapiens
ggcacagtgctggatgagggtcatgtagacacggttgacagaaaatgtagggggcacacctgaagtaggtggaagcaccagccattgctcaatgtaccatgatctaaagaatgttgctgatggagccagttattcttcatttgtttcccacccccgaatccatacta

SEQ ID NO: 165515 - DNA, 284 bp, Homo sapiens
tgctgcatcttatggcagttgacatcaaggccttactttgtatatgtaatatgagagctacttattatttaagggtatctgaccatcttgaaattcctgatgttactttctgaaggtccctgaactctcacaattggcctctttgcaactagattcaaagtcgttcacttagccatgtacacaactgccaaaatgactctgtgaattccatgctcaaagattttcgatggttccccactgcctagtcaatgatgtaggaattccctagtcaagcattcaagtcc

SEQ ID NO: 165516 - DNA, 347 bp, Homo sapiens
ccttttactgtagagtacatggaaataacacaaatctaaatgtaattcttagttgtactattcataaatatttgttttgctttttttgtcttcatatttgtgctaaattacattagaagtctttgttggacttcaaaatatattgtttgtgttttgcactgggctctttgcagtgttcttattgtaaatgttagcccttaatgacacttgctcagaataatgaaaacagatggtatttgtttttgtttttgtattttagtagataaagctaaagtcattcagatttcctttctataattaaaccaaaatttgtagaatattcagtatccaagtaggataaaatcata

SEQ ID NO: 165517 - DNA, 459 bp, Homo sapiens
gactgcacagggctgcagacatagatttgtattcccaggtttaaccacctctctaactttatggaggagaatctctgattgtgaagcgttatgacttaccaaactacccactggatgtcttcctgtaatgttgagaagcatccatagtttcctatttctttgtaaataccaaacctagaaaactacacatgacagtcaagggcactattctaaatattctaaatgctcagagtatgtgagagaaatttggaaagaatcctctggctcagagtcaacagatgagagaaggaaagctactgccttaggtgtttgggggcagaaattttccattactgagaagcaaactgaggtaaggatagtcaacattcatgggcagtcccagtttttgttgtacctttaaaaaaaccaaagcctaaaatgagtttctgagaaaagaaatctatccatatatcaatggaa

SEQ ID NO: 165518 - DNA, 370 bp, Homo sapiens
gattatgatggatggggggcgggggtccctcaactcagcctacttggaggggaggctcgaaacggccgcagtggctcggaagccgcggctcggggcccctggctcacgcccccttctctggctctcggatcggcccggcgccggccccccggaggaggaaggggcgcgcgggggcgctcaggcggcggccggcaggcgcgcccgtgccccgggcatcgctcagcccgtgcgccgggccgccgctgcctgccctcgggctgcggtgctcagcgcgaggcgcgcagccgatccccaggccggtgccaagtcgccggccccgctagctgcctccatgggccaggggctcggagaggggggaggcggcggccgc

SEQ ID NO: 165519 - DNA, 333 bp, Homo sapiens
cgccaagaagtgttgagtgcgggggaaagtgcccagcggtgttgagtgcaagggaaagcgcccagcagcattgagcacggcagatttcttctctgccctcttcagtccatctccttggagttctgcaaaacagaatttaatttctgttgttctgtcctgaccaaaaccaggctccagcttggaggctgacctcctcgtacacaaagaagtgtgtactgttgctcacgggggacacactgaggtcaagacgggtggacaagcccaaaaggcaggttcatctgaccgcagctctgtgggtaaacgcctgtgcccactgtcgctgtgcagtacgat

SEQ ID NO: 165520 - DNA, 324 bp, Homo sapiens
ccctgaacattttgtttctaggattatgcttgtgttcatcagtcggttttcctctggtgtgattttgctgtagtagattgggggtggaggaggtggcaaggagggagggggtggtcaccacttgttggatcttaggataaagttggttgtgtccagaggtgactgatacaccttataatttcagactgttccatgtcatgtgatcactttaaactaggcttaatccaaacctctctctaaagataattcacaatagaggacagagtggtcacatagtgtttcttacagtgacatgtgcattagaatgatttgtagaccaaattt

SEQ ID NO: 165521 - DNA, 231 bp, Homo sapiens
gaggcaggagaatctcttgaacccaggaggcggaggttgtagtgagctgatatggcctcactgcattccagcctgggtgacagagtgagaccctgtctcaaaacaaacaaacaaacaaacaaatgaaaattattactagtgtataataatttcattttcattttaaattcttcaattggcttataacaaaacttcccaagaaaagctcctacaaataacttctcaaatgaa

SEQ ID NO: 165522 - DNA, 232 bp, Homo sapiens
tttcctctttggtctcatgaacctactgagagacaagatggtaagtaccccatactgacctctccactgggggaaggagctgtgcatgactaactcatgagctcagcgtggtgaggaggtactccaccccacagtacttgtgagaactgtgtaggtgccatcaattacaagaaatagtacaaaagcagccgggtgcagtggctcaggcctgtaatcccagcactttgggagg

SEQ ID NO: 165523 - DNA, 145 bp, Homo sapiens
ctccatctaagtctcaaagttttattcacattttagtatttttattttgacctctccacctcactcaaaagatcagtacatgctcccaaatctatcttataaaagaaggaattctgttattttgttatttttcctgcagttaaaa

SEQ ID NO: 165524 - DNA, 519 bp, Homo sapiens
tgtgtattttaccctctcactcccagcacacacacacagaagtgcactgtaatggaacatggagtgtgctgctatgtgtattttaccctctcactcccagcacacacacacagaagtgcactgtaatggaacatggagtgtgctgctatgtgtattttaccctctcactcccagcacacacacacagaagtgcactgtaatggaacatggagtgtgctgctatgtgtattttaccctctcactcccagcacacacacacagaagagcactgtaatggagcatggagggtgctgctatgtgtgttttaccctctcactcccagcacacacacacagaagagcactgtaatggagcatggagggtgctgctatgtgtgtttaccctctcactcccagcacacacacacagaagtgcactgtaatggaacatggagtgtgctgctatgtgtattttaccctctcactcccagcacacacacacagaagagcactgtaatggaacatgtagtgtactgctatg

SEQ ID NO: 165525 - DNA, 472 bp, Homo sapiens
agaatctgtattttcttcctcttttcctactatttttaagccagggaatttgtacagtttaattaaaagatactggagggaagaaaagagtccatgcatcagtagcttaggatccttagcactgaataatccaaccctccaaataactcttacaaatgaatcctacagtatttctcattcagcaatatcctgttactggggcaacctgtgccattaggtctcagtaagcagcacagtctcattgccagatgtagctcagacagcagcaactcaagccctgcactacagaggcatctcctcttccagccatcacctgcttggaaacaaaaacagaccccactggtttggccacacatctgtaatctgcttaaggctataaaagtgttttgcttttctttttgacatacatgtagtccaagtttattcaatacaggaatcgagcatttctaaataaggacctcaaaactggcag

SEQ ID NO: 165526 - DNA, 191 bp, Homo sapiens
tggaaggaaatgaaacagactaaaatcagagtaacgcttaaaaccatgaagattccagcccacagattctatctgccacatgcagacacgatttatacccctagagggaaactgaagaaacaaggtggtggtcatacaataatagactcaaaacccaaccacacttttgaagtgaatagtggctcatgatg

SEQ ID NO: 165527 - DNA, 215 bp, Homo sapiens
ggtgaattaaattttaaatgtaaaagtgaaaacaaagtaaagtatttttttctgtcaagtaaacattcttcttttgagtacaacttcatttcacattaactatcacactgaataaggttattattgttgtagtacacatgtactttttacatttttaatacatgactgtgagaaaattttaaattttgactcatgtttaattcacttctattggg

SEQ ID NO: 165528 - DNA, 178 bp, Homo sapiens
ccatcccaagtccagtgtgcttcctgcctcagcacaccacctggaaagcaaactgccctgccctgcctgagtccactgtgagattcctcccctctggctctcacaagtttctcatgatgttgatgtttgaacctttaaggaatagactgagggaagggggcagtcaccagactggaaa

SEQ ID NO: 165529 - DNA, 224 bp, Homo sapiens
aatacattgcaattattttctgtctgactaatttcagacttcatttaaaattggaacagtctctgagctttggttgcctagggatacagcataaaaaataaaaaatttggaacataaagtaaactatattgatatatttttataaaacatttgagggcagaagaagatagtgacacacgtgtaatacatcttagtctcagtcacagtaagaaatgtttcatttc

SEQ ID NO: 165530 - DNA, 393 bp, Homo sapiens
ttgagttccagtggtagtcatgcttaaaactgcttgacataatgggctttcttctattggaatattttgtattagtttaaccttgctttgtgggatttacagtttattgaataagaacagaatatgattatttctttttaataaaatatgaaaaataaacatgggaatacattgcttttaagaagtaaatgtaaaatcaaatgactttaaacctagtacagttctctagtgacatttgtaataacttgcctaaggcattaattctaatcactttgtcattatttgcagttttattttaagcaagttttatattaattccccttactgttttagttttaaaagtaatatatgattctcttttaaattatttttatgctgcgacttcaatcttcc

SEQ ID NO: 165531 - DNA, 323 bp, Homo sapiens
ctttgacctcctggactcaaagcagtcctccgtgcctcagcctcctgagtagctgggactgcaggtgcccgccacaatgccctgttaatttttgtattttttgtagaaacagagttttgtcatgttgcccaggctggtctcaaactcctgagctcaagtgatctgcatgctttggcctcccaaagtgctggcattacagatgtgagccaccactcccagctgaggtgtacctgttttgatacatctaattacaatgaaaaatgctagtttcttaccagcattgctcagtcagtcatagaaccttgaacttaaaataatgattt

SEQ ID NO: 165532 - DNA, 128 bp, Homo sapiens
tgaatccatccagatgggcagctccccctctcttcactcctcagttctctggcttagaccttggtctgcttttatccagatcttcagtagggtttcacccgtgtcaacttagttgtctgcttgaaccg

SEQ ID NO: 165533 - DNA, 411 bp, Homo sapiens
tggagggaacaataccactcacataggcaagaattaatcaggagaggtctggataaatacacttgtttccttgagcacctctccacccacatttatactgtgcacagtactttgcaacagtagcagaaatgcagcagtagcactaccttgcagaaatgcaacagtagctgaaatgaaaatcatctctcttccaccgtttcttcagcaaaccaagtatttctattggttttcttccaattctagtgcatgcccatcaaaatgtttatgcttgcaacctgcgtagtttttggtttactgatttttttatcattttatcacaacacctttccattattaatgtgtagttgtaattgtaatggctgtatgccagttcagaacatgtgcctgaattgatgtgcaatcatttgctta

SEQ ID NO: 165534 - DNA, 277 bp, Homo sapiens
ttcagatgaaatgctgaatgatctctatagatatacagatacagacatagacaaagttagtctgggggagaaatacaaccaagttccaacactgagtgtctctatagagatacagatacagacatagacaaagttagtctgggggagaaatacaaccgagttccaacactgagtgtctctatagagatacagatacagacatagacaaagttagtctgggggagaaatacaaccgagttccaacactgagtgtctctggtgggggggttatgggatt

SEQ ID NO: 165535 - DNA, 320 bp, Homo sapiens
atctcatcttgaattgtaataatccccacatgtcaagggtggggccagatggagataatttcatcacgagggcggttccccccatactattctcatgatagtgagtgagttctcatgagatctcatgattttataatggctttcccccgttttgctctgcacttctctttgctgctgccatgtaaagaaggacgtgtttgcttccccttctgccatgattgtaagtttctgaggccttcccagccctgcagaattgtgagtcaattaaaactctttcctttataagttacccagtctcagacatttcttcatagcagcac

SEQ ID NO: 165536 - DNA, 414 bp, Homo sapiens
aaggtaaaaggcaaaatgataaaatttctagaacagtacattgaggggtatctttatgatggtgtggagaaggtaaacatttcttaagaggacacaaaaagcactaacataaaaaaaaaattgataaattctacattaaaatgaagaacgtctgttcttcaaaaggcaccatgaagagaaaaggtaggttacagaatggaagaagatatttaaattaccatgacctgccaaggagctgtagccagaatacgtaaataactcctataaattgggggtaagggcgggttgtaaatccaactggtaaaccaacaggtagatgggcaaaagatttgaacaggtaattcatgaagaaagacacccaaatagctaataaacatataaaagacactcaaaatggttaattaacaggaaaat

SEQ ID NO: 165537 - DNA, 401 bp, Homo sapiens
ctgtgtgttgcattctttcccctggataggggacaggactcctctgtaatgagggttttctaccttcaggggagtggcgtctctaggtttttatgacttgctttgcgggagatactggacataggaagaggggttctgaagctgctgaaatggcccaggtgagagttatggagtctgatttacagaggacatgaagatgaatgggctcatgctctgacaaaagggacttcccaggatgactggcttagtgagtatttcaccagggggagtgagggaacgtgaggaggcagacttcagcaagaaggatggcgggccctttaatagagaaataggagctggttttgggtggaagactctgaacttagttgtggagtgctgggaagagagccaggtgaagtccc

SEQ ID NO: 165538 - DNA, 320 bp, Homo sapiens
ttgagcttgcccagtggaatgtagcgggagatactggacataggaagaggggttctgaagctgctgaaatggcccaggtgagagttatggagtctgatttacagaggacatgaagatgaatgggctcatgctctgacaaaagggacttcccaggatgactggcttagtgagtatttcaccagggggagtgagggaacgtgaggaggcagacttcagcaagaaggatggcgggccctttaatagagaaataggagctggttttgggtggaagactctgaacttagttgtggagtgctgggaagagagccaggtgaagtccc

SEQ ID NO: 165539 - DNA, 206 bp, Homo sapiens
gaagtatactaagcaaaacttgtataagccaaccaagacccagcttggcaactgggatcaactttgcccaaagtacaaggaatctggggaacaagcagatatccagacgaaaatcggtatacatatgagaaagggaaaagggaagcaaacactagatgaacaatgtccatgatgtgctctttaaaaaaatatgatctattctagaa

SEQ ID NO: 165540 - DNA, 543 bp, Homo sapiens
ccctatgaaactggtcagagggaaataatttatacatactaatgaaaatcaaactcctcatactaatgtaaatcaaactatacagacacaataggaaatatagaaatgtaagtttaaacaaatatttatctattgactcatagtccatcaacatagtcttttgtttcaggcatgattggtagaggcatagctgtctgccacaatgtcagcatcatcagtttaggaagctatcaccctcccccaacatcctatttttctcttataatttcttatgattccttcatccacccattcctaaaccaatcatcaactcccagttatcactgtgtatggagtagtacttctttttaacctcctacccaatatgtaaaaagtaatatttcattttacttatctaaatttacctgacatccaaggtagaaaggacaagtaatttcattattttggaatttgaaaccaactctccatgtttatcttctttgtgtctttcacaattttataactttatagcttttttccctttaactttttttatctttcccg

SEQ ID NO: 165541 - DNA, 462 bp, Homo sapiens
ctggccaaagaatgcaatttttaagtctgcagttaaaactgcttaatttctgcagagaacggagtaggcagagggctcaggtgtgacatgctgggcttgaatcctcaaagcaagaacaagttcactggaggcccagaggcaggcctgctagggatacgctccctccgacctcaggcaggtcactggcagaagtgggcttggtggcttccctggattcccctgtggccaggtgaaagctggcaagggggtttgaagagaatatagagaaagcagcccaggactcagaaatccaggtcctgcccctggctctgccaccactagcctgtcacctgcagaccggcccgttcctgaatagacacaggaattccaacatcccagatccagcacctggcgcatttaggaccaagccccttaacaactcaggtattatttggccagcatgttgcctagacttgccaggac

SEQ ID NO: 165542 - DNA, 551 bp, Homo sapiens
tctaagagttatcagttataaactgttgttagttggaggaggtaggctaggtggcccatcctgtaaaataaaagtttcagctagtgaggtagggccagtagggcaatcctgctagctgaataatctcattgagattattcagctaggaggagctgaatcaccagaggacatgtaccaatgtacctttatcttctggtgcaatcacttctaaggggagaaaactatgaagaaataagaactccagaagacaatcagatggaaagttcttcttcctgtggaaagatcgtgtcttctccttctttgctgtttctacaacattgtaagacctggtatgtactcaagagaactgaaataaaaacaattacaagaaatttaagtcaccacgggaaaaaaaagagtactctggtttttgtttggttaaaaaccaaagaatccatacctaaggcagaagggaaaaccacaaacacctggaggtgcctgtgtatgctgagcctggagacagaggctccaggtctgaatcctggctttggccatttactagcagaatgaca

SEQ ID NO: 165543 - DNA, 350 bp, Homo sapiens
taatgagaaatttttgcttctcatgtgagctgaaattttaaaaattcccaatgatatggctgccttgatatcgctggggggagtataaatccatgtaatttttttgtaaagcattctggcagtatatcaagagcctaaatatgttcatgtcctttgacccaaactcgctcaagaatatggtgaagattcagcctcatttctgcgcggatcacagcctgaagtagattttgtctgtgtggatccttcaaatcattggcaaattaaggagctagagcaaggaagtgtcacgatggcgtgatgggcaagaatgggaacctaaggaagttgatgcaagaacgtgatcctattcc

SEQ ID NO: 165544 - DNA, 337 bp, Homo sapiens
cccaatttacagaaattcccagccttattcaatacccagtgttctctaactgggcaaacatgctcctttgtttcagttactccaagatttacctcccttctgtaggaaactgaagttctgcagaatggacaaagatgatttcctattaaaaaaaaaaaaaaaagcagatgtggttttctctccctatggatgacaatctagttttatcttttacttcaattctaggaaaattcattcccatcatgaaaaatatgtcagaagaaaagcagaccactctgttgtatttgggtcacataccaattttctaagctagctaatgaaaagggactatattaac

SEQ ID NO: 165545 - DNA, 433 bp, Homo sapiens
gaacagggatatagaaaaaacgattttatatcaagactgtggagtcagacagactgagtttgtatcctgaatatgtgatattagcaatttgttcaacccttatgtgcctcagttttctcatctgtaaaatggagataatgattataacattttccacatgggtttcctgtaagaaataaattagctactatatgtaaaataggaagagtgtctagcatacagtgttagatggtttgattattttagcccagataggactagaatgattatataattatactcatcaatatactaatatgttgaaaaatttgagaatttagctatgagatacaaatacatttttgtaaattctttgacattattactatatgaacatgatgaaattttactttaaaaagttgaacttgacaatttaatgacactttgtcctggt

SEQ ID NO: 165546 - DNA, 350 bp, Homo sapiens
ttaggagcatatacttttgctgaacatgttgctaaataaaataggatattgattatatagtaagttgtgtacttgagcagaaatgtcagaacttaaagataaatgaaaccagcatatcggtattttaaaccaatatggtttcaaaatggtttaatatctttgcttcatttttaatgtctaaaaggtggttgtttgaagactgtacagagttgaaataaaaagccgttaattcagacataaaataaaggggacataatttataggataggtgtatattgatttatgaggatcttttaggcctttgagaatggtagaatggtggggtttttattttttttatttatttttgg

SEQ ID NO: 165547 - DNA, 318 bp, Homo sapiens
tcttcattgtgttctttttttctggcaaatttctctcctcatggtggtgtgctcttccatctacaccctggaatcatcatgttgattacgtgagaaaccctgttgaactggggttggtactgcatcgcgttcatggattaatctgtggcactggagatatagcagcgggcatgaccgctcagccactgcccgcccaccttcaaggagcttttattctagtggtggcaacagtctagtgagaatcggagtgctagtggctggtgggggtggtgttatttttaggtgaagcaatcagggagagcttcattgatagggtaa

SEQ ID NO: 165548 - DNA, 547 bp, Homo sapiens
atacatgggaacggagctggaactgtcttatggcccaccaatgtgcaacctgggcatgtgaaggcactaatgacatacgtggcaacccttgccaatggggtcaggagccagtgtattaatgatccccatctgaggtgcattacgtacagcttcttagatcttggcagttttcagcccaattgtccatagtggtgaccaactcaacatatactcatagaagctttctctcctttcctgtttcattttccctagccccccactactggttcctgagaatcccaggctctgctttctaggggtatcccaggctaaaacaacagaggtggttacaaagctgagagaagaagcctttctcaacaggtagagtctgccccttatcccagtatagaaatctaatacttcaaggatcagcatgtagttctagtatcatctcccacatgcatgggcgataaaagaggagggagtctatatggctggggatccgttacatttcttgaagagcacctttaaaagttgggatcggccaggcatggtagcatgtgcctgt

SEQ ID NO: 165549 - DNA, 366 bp, Homo sapiens
cggcctttactgtaaatgcagataatattttatgctgccttccctgccttgcagggctgcttaatgcagcatgtattccttaaatacacataatgatgagacaggacacctaccatagtggaacattcatgcagagaggaagaaccacgtcaacaaccggctccaccactgactcagcgaagaagagaagaggaacatgcaacttgccgtgggaacaaagagaaagggacacttccttggacactcaagcgaagagtgtcatggaggatatgacatttaaactgggtcctggaagatgggtagaatattggcagggaagggaagagatggtggaaaggtatcccgggccgagggagaaaagcaaga

SEQ ID NO: 165550 - DNA, 387 bp, Homo sapiens
tgggcggcctccccggggacaggtcccgggcccagccccacaggagctcccgaggccccgcggacggtcgcgacagccccaacttcccggaaagaagaccaagatgtaagcacacctgagcagatccttttccaagtatcctgatgtctccaagggctgttcagattccaaagagaactatctacaagttaatctctgttactggagtcattcattctccgtagtaatctgctccacagaattcctcttctcttccctcccataacctgttttaccaggatccaagcctccattctttctgtaacctcattgggaagttggttcttcatttggaaggctcccatgtgtacatgttaaataaatatctatgccttttcttctgttaaa

SEQ ID NO: 165551 - DNA, 343 bp, Homo sapiens
ctatgaatgactggaccctgtattgtctaattatccttaataccaaagacaggcatctgtgagaatctgagaggtactaagaaaggctctgtgctctaaaaccatttcctccactggctttatcagagagaaaccccacatttcacatcattgttaaagagcctctacagaaattcagttaccagctgagaaaaataatgaagcctccccaacaggcctctgggaccccttgagttgccaccaggaactggggtacaacagaagaggaggttactttctcaaatgcaagagcttggcaggcctaatcggttgtagatttaagaaccaaatggccaacccaatc

SEQ ID NO: 165552 - DNA, 121 bp, Homo sapiens
agtagaatactagagaggggaggactgatcggcatgtgcaggtgtggaaaccccctaaggtaaggtacagaacacctgaaaggttgggcccgcgcggtgcctcacgcctgtaatgccagca

SEQ ID NO: 165553 - DNA, 106 bp, Homo sapiens
gggccagagagagaaaaaatgagcctatttgccctcccaccataggggacaaggatggaggcagcagtcacagtggttgctaacatctttgtgacctacctggaaa

SEQ ID NO: 165554 - DNA, 343 bp, Homo sapiens
aaattggctgatgttttttcttacagttttgttttataaattttttaacttaaaatattaatgtaatgaaagaaatcactttggaggaaatttaaaactaaaatgaattcatactgaattatgttttaagacttgtggtattccctgtaatgcataaaaagcaatgtgaggaatcactgctcaaattgataatgtttaaaatggagaataagagcatagaaaaaaaaatacgggactaattgtacaatattttaacatttttaggttttacatattgagttaacctgatcacctacttgaagcagtctagcattaactgttaaatgtttaatgaagtagttct

SEQ ID NO: 165555 - DNA, 713 bp, Homo sapiens
gaattccacaggggagattagcagtagatcacactcattctgctccaagttgactgatggagaaaatctagctaagagagcaaggcttacagctgtcactgacaagccttctgcttcctttcattgcccagcctctaattcctgagatctgtgaaacttttgctgcatagatgctatgcaaagatggaaaatttaaatttttagtgttcaggtatagtcattttctgctctgtggaaagtcatacaggagaactgatttgtgaagagaagaaaatcaggattaaacatgtgtaggctgttgtaaattgtaataatgaaactgcaacatattgtcaccttctctcctctccccttctcctttgcactcttaaggggtcccactctcagatacacagcctgtttctcctgttgcctgcctcccactggcggatgattaataactcacaaagacattgtaaatgaatttagtttactacacataaaataacttttcctgtagataagtagttgaaaacttttgatcaggaattttcttattttgatagctttaattccatttctccgtatctttgcaactctcactgaatggtgatcagtgagattggtctagtgaaccagatatatagaggatcccatgtatctgcccagaaagtagggttctgatcttctgggtgaggcaattccaagtggtctttggaggcctgtggtaagta

SEQ ID NO: 165556 - DNA, 550 bp, Homo sapiens
gcattttcaattcccttcaagaactttccagttgcattcacaatttggctgtttggcataagaggcttagctttcagtctgtctcagctttcgacctgctttcctcaccaagcttcatcatttctagcttttaattgaaagacagaggtatgaatcttccttccacttgataacatagggaccactgtagggttattaattgacctaattccaatattgttgtgtctcagggcatagggaggtccaaagagagggacagagatgagggaatgcctggtcagtgtagcagtaagaaaatatataacatttttcaatcaagttcactgtctaaacaatcacaatagtaacatcaaagatcaccataacagatataataatagtaaaaataatttgaaatatcgggaaaattaccaaaatgtgacacagagatactaagtgaacacacgctgttggaaaaatgtcaccaatagacttgctcaatgtagggttgccacaaaatttcaatttgtaaaaaaaaaaaaaaaaaaaaaaaaaaacactatctgtaaag

SEQ ID NO: 165557 - DNA, 249 bp, Homo sapiens
gggtagagtgctcagggaagagaggagagcagcggagcccaccctgctgatgggccaggtcaggtgggagacgggacaaagggacagctggtggccttagtaacggggagcacgttggaactgccatagaatagtcccgctggcagggaagtaagcgctgaaagctggcctgcagcaaggtctagagaagtggggagaggaagacagaatggaggtggctcaccaggatcttttactctggttgggagc

SEQ ID NO: 165558 - DNA, 444 bp, Homo sapiens
gttgtgaactgtagcaagtggagacgtcaacagaccgtagcctacacttgtgccagtcaccgagttttggccaatccaacgtagccaactgttcaaaccatgttcaaatgaggctgacgccgagctgtagccaatccggctggttctgtgcctcacttctgttttctgtccatcactttccttttttctgtccgtaaatcttcttctaccctgtggctgtgctggagtctctgagcccactccggcttgggcggttgccttattcaggaatcgttcactgctcaattaaactctttcaaatttaattcagctgaagtttttcttttatccaatgaaatttgctcatgacaattcatactttaaaaaagacactaaagaaaaagcataaaacttcacaatcttcagctgaaaagaaaattactacttttgtgcattaactctact

SEQ ID NO: 165559 - DNA, 165 bp, Homo sapiens
tgggatttgaaggtctgccatagagtccgaagagagggggaaaacacacgcaaaccacccaatcacagggacccctgtggctcctcacccaccctccaccctccaccttccacttattccactcctctcgattgtcaattaaaataaacagccttgtattccacg

SEQ ID NO: 165560 - DNA, 200 bp, Homo sapiens
  misc_feature (182)..(182): n is a, c, g, or t
cgacatagggagaccacgtctctattaaaaagaaattttctttttgaatagtattacagattcacagaaagttttattttcaaggaattgcagatttgcagacagttgcagtatttttaattaagccgtaatacctgaatcgttttacaagaaaatcaaaattgctttacatgcaatagctnattatggtctaccacaga

SEQ ID NO: 165561 - DNA, 245 bp, Homo sapiens
ctccgtgctcaagcaaagggactggccaaatcggtttcctgagtctctgtcttgattcccctagcctgctcaaatcacaagagaatcttttagaaaccagtgggaataatcttcccatgacaccattatcatctcagtaagaaaatcatagatcatcttcaagtaatgtgtttgcatggcattacagataatgtttcataaggacaatgccatctcaacagcatgccgaccttaaaaaggaagat

SEQ ID NO: 165562 - DNA, 187 bp, Homo sapiens
cagtaatgctcacttccctcaactcatctcctgctgtgcagcctggttcctaacaggccagggactggtacagtctgtggtctggggcttggggacccctgctttataagatacatgatttgtaaaaattttctcccattatgtggattttcctttcactttcttgatggcattctttgaaacacat

SEQ ID NO: 165563 - DNA, 922 bp, Homo sapiens
atatttttaccataaatagataaatacataaataaagttttgaatttattggtgcttagggtaggaggaagcttattccctaccccactaccccctttgggggccacgcaagaatccctatctcctgaggccctttcccaactcacctcctgacatcatggtgggcatctccttgatctggcctcctgcttcagtttgtttacctctcatttagagatcctgaacctccagcactttgggaggtgaaggcgggtggatcacttgaggtcaggagttcgagaccagcctgaccaacatggcaaaccctgtctctactaaaaatacaaaattagcggggagtggtggctggcgcctgtgaccctagctacttgggaggctgaggcaggagaatcgcttgaacccgggaggcagaggttgcagtgagccgagaccgtgccattgcacttcagcctgggcaacaagagcaaaactccatctctaaataaacaaataaaataaaaatagataccttgaacctgtctctcatattcactgctcctctggcccttgcctctccctttcttccttgctcacaattctacaggatttggtctggttctaactgctccaaggaaccctctggaacctggatatgaatggccagtaattaatttatgaaatcagaccctcagctacattctatactcaagatactaaagccaagcttaaagacattgataaaacacttaatgcaagaattattttatgaaaacactttaaaaattatttcaaacatcaaaatggtacttaaatcccattacattaacaatctcataacactatctcatgccattgaatatgtgataaaaccttcatacaatatctggtgggaatgtaagttggcacaaacatttagaaaagcaatttggcggccgggcgcagt

SEQ ID NO: 165564 - DNA, 331 bp, Homo sapiens
tccttaaactgctttatttttgttctcacaattgtctggcctgtatttgtctgtatttgtttatgtgtttatctgcttcctcctgctcagtttaagttctacgagagcaggacctcatttgtttttgttcactgctgtatgcttagcacctggcaggtagtaagtgcttagtgaatatctttgtcgaatgttttaagctgtagctactagcctgatccccattctctaagcagaggacattgaggcactgagaggttacgtaacttgcccagtgacttacatatccacacactcagagatgctgcaagccaagttttgaatccagacgaag

SEQ ID NO: 165565 - DNA, 105 bp, Homo sapiens
cagaagcagggattaatggagttttggttaatcttagactgtctgactccaaagcatgggcttagctttgaggggaggatgattggccaggggaagagctacaga

SEQ ID NO: 165566 - DNA, 190 bp, Homo sapiens
ctcccgggttcatgccattctcctgcctcagcctcccgagtagctgggactacaggcgcccaccaccacgcccggctaattttttgtatttttagtagagacagcgtttcaccgtgttagccaagatggtctcgatctcctataggcacgtgctactaacccctggctaatttttgtcttttaagtagag

SEQ ID NO: 165567 - DNA, 340 bp, Homo sapiens
ccctttaaatagcaagctctcctaaggtaactgaaacaatgtaattaacttttcaaggacatatctaacttgggcaacctgtagtcttttgcttaagaagactctactactcactctccaattaggattccactcctgatcctactccaacactttagagtctcattcctgtgtgaaaatacagcctttcttaggcaaattcaagtcatttccaggcctgcccacagttattatggggcaaggtgttgggatagaggaaagggaggcaaattccaactcagacccagggatcatctagtttgtagccaaacccaggttcagtaacttcatattttttttt

SEQ ID NO: 165568 - DNA, 176 bp, Homo sapiens
aaatggaaagagatgagaattgtataacttcaaccacaagcatttgttgtcaaagacacaaattcaaccaaaggactgaaacattagccaatatgctttcccagcactcaaattcaattcagaaatgagacttcccattaccaatatcatcccatcccatcgggagcatgcagctt

SEQ ID NO: 165569 - DNA, 397 bp, Homo sapiens
tggctgaacctgtggctgaagttgccctaaaagtaggggcagaggaattcctgtaagggactgccccgaacctagttggggttccagaacactaaatctcagggtaatcagtcaaaagcatttagtgctgcagcagtcctctcagcagacagcaggaaaagatgtgtccaaggtgagggagttgatttgagtgttgaaggaatttggttcagggccagggatagtttctgtgtgtttggtgaagagtataagggcagatgcgctgatgaaaaccattacgagaagagtcaactttgtgttaaagtgttcaaagatgtcaccttaagcagaaaagagctttaatacgtcttctttgacttattaggcatttccagagtccacatagttcagcgtctga

SEQ ID NO: 165570 - DNA, 367 bp, Homo sapiens
gtatctgtgattggtttctctcaccctattccctttccctgtatggactctcccactctgaaccccttaacaattggtatctggtagggcgcggtggctcacgcctgtaatcccagcactttaggaggccgaggtgggcggatcacctgaagtcaggagttggtgaccagcctggccaacatggtgaaaccctgtctctgctaaaaatacaaaaattagccaggtgtggtggcaggcgcctgtaatcccagctactcgggaagctgatgcaggagaatcgcttgaacccgggaggtggaggttgcggtgagccgagattgcaccactgcactccagcctgagcgacagagggagactccgtctcaaa

SEQ ID NO: 165571 - DNA, 427 bp, Homo sapiens
tacatatactcccgcaagactaatgaccccctcactcccaccaaaacaagctatgtagtaaatactttttttaaaaaatactagttgtttattttcaaggaaatatttcctctcactttttctaataaccaactcttattttaactcttctgtgtctctccattgattagttcagccatccacacacacatttgaccagtctcatcatgtcattccactgtttaaacccttttattggctttcttttgctcttacaatacaatcccaaattccagaaatggctcacaaagatgtgtttccagcccctgcttacctttcttgctttatctcttactattcccctattgatgagttttttgggcattggtgaactacttaaagtcttccatgggccatgtgctctcatgctgccgtgctcattccctct

SEQ ID NO: 165572 - DNA, 321 bp, Homo sapiens
ggcagggtgatggggaatacatttggaggccttggtaaggattctgatgtctttattttagaagaaatgagaagccactgagtagtttctcactgagctccccactgtgccatctctctgatgatcagattttcatgttaactttggttgcggtgtggacctgagtgacttggagactggagcagggctggcatggcgtgagtccaggttgaagtgactagtacctcggacgaggtgtcttgggcaaggtggagtctgggccctctgtgtcttttcagtttttccctctatagatttctgaagctgcattggctggcccac

SEQ ID NO: 165573 - DNA, 327 bp, Homo sapiens
ttaaggcatgaaattcattttttcaaaatgcaatctaatacctaatagcagtaagagtagagctgctttgcttgacataggagccagggtctggaagtccccttactgttgggcctccgaggcatcctctctcaatagggctcctagaagcacacttttaaagtcacactaggctgggcacggtggctcatacctgtaatcccagcactttgggagaccaaggagggtggatcacctgaagttaggagttcaagaccagcctggccaacctggggaaactctgtctctactaaaaatacaaaaattagccaggcgtggtggcacatg

SEQ ID NO: 165574 - DNA, 282 bp, Homo sapiens
tataacatactacaactaacatagcaaattcaagggtgtgaccagagacttcatgttcaactccatgggggtttcacagatttcactgtaaataaaatctatgaatatggtatcccctagagctgtgcaactcagacaaacagggcaccatgtagatcaaagtgtgttggctggcttctttttcagggcagtttaaggtacaccttcatttatttatttgtttatgttttagagatggggtctgtgtcacccaggttggagtagagtggcatgatcatagct

SEQ ID NO: 165575 - DNA, 158 bp, Homo sapiens
ccatcgtgaggattaaatgagatgaaaatgagtatctcaagcacctagaacagtgccctcatgaatcaccagctgactgggtggatacatgaatccacatggaaggggcctggcatatgggaggtgctaaacatggttccttatccgggggacgggtg

SEQ ID NO: 165576 - DNA, 187 bp, Homo sapiens
gtttaatcctctttagaagatggcttataatcaactatagaactagcaggtgttcttaaatgcaggtttctaataactttggaaattgtaacattggaataaaggaaacaacttttagaactctcattaagaggtggagtgttcatgaatggaatgttcagttaacaggagttaactgaattaactg

SEQ ID NO: 165577 - DNA, 340 bp, Homo sapiens
ctgtgtttctccaccgacttgtcatactgctcccactacttaacatcagaacgtgttttagttgaggggtggtggatagtgagttatttttatgaaataaaattcctaatgaaaggaggaactttttcggatagctgtaatttagtcacagctttatttctcagactggcctgttccaggcagaaagctgacaggccagtgtcctgacccactgtactcagtcctcttgggctggccatgtgatgacaatttcttagccccaccctattgaccttcatcaaagaagataaaacaggcatgattattttgtttctctcggtatattaaaaagtcataaatg

SEQ ID NO: 165578 - DNA, 295 bp, Homo sapiens
attacagagtgtgcttacacaaacctagatggtaaagtctactacacacctaggctgtaaggtatatcctatagtgcctaggctacactcatgtacagcattttactgtcctgaatacgataggcagttataacacaatggttaagtatttgtgtatataaacatagaaaagttacagtaaaaatactgtattataactatagtttccgttgttgaccaaaacgttgttaggtggccgatgaccgtaattgttttgttttgttttctcttggggtgcctagaataaaacataaga

SEQ ID NO: 165579 - DNA, 487 bp, Homo sapiens
tcatatgtacaacaccgtgtaagaactgctaagtaggatttggttgtttgggccttttattttaccaaattccaaaaaggactaatggaaacttagaaaatttattaagaatgaaaataatcacaccttataaaccagttatgctttctacaatagctaacatagaaaaatggagtttcaaaaagatactaaatcatggctaagtgaagagttctctgtatagtgattagttttttggcaccctgattgaatgtcatttaaaacatcatttttaaaaacttctaagcaacttatgttgaatgtttataaaagctacagggaagctgaaactattttaaggggtaaactgtgcctagattcaagtaacactcagcaattttcagctgaaatgttaacgggggaggatgggagattttctctcttattcaggcaagtagaaagtcacagtcttgtgactggaaataagtcagtcatacagggttttgca

SEQ ID NO: 165580 - DNA, 661 bp, Homo sapiens
tgagccatagctaccatttccactcaccacggggtatcctattggctgggcctggaaagtggtgtttttgtcggacatggccaggtttaactctgtgcccttaagacaacactctgagcctccaggatgatgtggaaacaccagcaggtatagttagggcatctccacacctgctgtataaatagggaatatatatactttttagcagtgtaattggcatgcagtaggaacacaaataggaattctgttcctttcctgtccctgcagtgtggttgctgagacatgaataaactagggaaagactttgagaggtgttgtgaccactctttagacagaatggaccactatccaaaatttagttcagatatcaagattgatgatgctatacatacactaaagggatacgaacaggttttctacttacataatgggagcttctcagcagagcaggacaagcctaccaaactagtcccaagatggcttgagagaagaggaaaagagacagctcggggtttttattgccattagggggtacatacagaatgagggctcctgcataggaacgggggcttgcctggtttgagtctcccgctggtgtcgaggaaggagcaccttttcttatcagctagcccagatgtgtagggcacaaggaggaagagga

SEQ ID NO: 165581 - DNA, 558 bp, Homo sapiens
ttttgcagttttagtagatatggggtttcaccatgttggccaggctggtctcgaactcctgacctcaggtgatccgcccgcctcggcctcccaaagtgctgggattacaggcgtgagccaccgcgcctggcttctttctttttttaagagacagggtctcactctgtcacccaagcttttgtgttcagtggtgtgatcatggctcactgtaacttccaactgctgggctcaagtgatcatcctgtctcagctccccaagtagctggaactacaggcacacatcacaacacctggctgatttttgatttttttttccagagatgggggtcttgccatgttgcccaggctggtcttgaactcctgggctcaagtgatcctctcacctcagccttctgattagctgggattacaggtgttaaccactgcacctggccaattcttttttgttgtttttgtttcagagaaaatcatatgaattctctttgaggttacactcttttgaactatgtcttgggcagaacttcttcttttttcctatttgctgtgatatgtttgata

SEQ ID NO: 165582 - DNA, 606 bp, Homo sapiens
tgttaattccacaaggcaacaagcagctcctctttccactatgtagagaaactaggctagctactttgattaagtatgaacgtacctctatactggatggaatctggacttacaattggcgaatgtgtatagcatattcaacccatagacagctttccgcactgttcatctatatatgtccaaagaattacttgagaccatgtccacaaagaactaacttgcctctgtaaagtctttgaaggggaagttttagagaacaatgaagacccaggaggatgatatggggtgcaggtagaaatatagaatgaatcatggctttttaagatacatggttacttttccctgttgcaagttaggtctgagtagccaaaagtcggctttggcaaaaggcatctccatttcagtgatcagctaccaccaggcagaactctaaatagaattctcagtttcatgttttccctttgtcaaattaaatggcctccatgaaagagaagtaccattctctcaggcttctgacagtatccctttcgtggaggccagaaatgagagggtagcaatcaaagaataagcattaaaattatatcctgcctttagataatcctgata

SEQ ID NO: 165583 - DNA, 118 bp, Homo sapiens
tctgcaccctcttctacacacctctggggtgagtccacatttgcccagtagaaatacctgctatctgatgtttgactcaactctaagactcattcaacaaatatttattgtgctttta

SEQ ID NO: 165584 - DNA, 113 bp, Homo sapiens
ccctggaccaccagaagaatggaaatacccttaagaaagaaaggcaaatatgaacatcaggatgtgcagcaagagatcagaaacgagaatactgccattcctaccctcgctca

SEQ ID NO: 165585 - DNA, 193 bp, Homo sapiens
atgaattttgtgtttagacttgggtcctatccccaagacatctcattacagatatgcaaatattccaaaatgtgaaaaaatccaaaattcaaaacacttctggtcccaagcatttcagataagggatattcaacttgtgtaataacagtagctaacgtgtatgggcatctacgatattccacgagctactcta

SEQ ID NO: 165586 - DNA, 410 bp, Homo sapiens
aggagtgtggctgtgaacaaggggaggctgaagaggctgggaatcacccacattctgaatgctgcgcatggcaccggcgtttacactggccccgaattctacactggcctggagatccagtacctgggtgtagaggtggatgactttcctgaggtggacatttcccagcatttccggaaggcgtctgagttcctggatgaggcgctgctgacttacagagggaaagtcctggtcagcagcgaaatgggcatcagccggtcagcagtgctggtggtcgcctacctgatgatcttccacaacatggccatcctggaggctttgatgaccgtgcgtaagaagcgggccatctaccccaatgagggcttcctgaagcagctgcgggagctcaatgagaagttgatggaggagag

SEQ ID NO: 165587 - DNA, 564 bp, Homo sapiens
atgcttcccaacaccaagattctatttctctgtgattcatttatcttagcttctcattccttttctgctttatcacccttccccctgttcttgtatttctcctccctctgttgctcggtttgtgaggagaaagtagaaatgcactccagtgtttcaaatacagggccagtggggattgtgatgtctcccatctgtaatatggggtcagtgatgctcagccctcctgtgtcttgagcccggatgaacttcagaggcaaagtaaacaccttaagtgcagcatattaaaacagcacttaccaaagaaaacaaacaaacaagaacactacaaggaagccactgtcattacatcattttctcttgtgttttcatttcagggaaagtcctggtcagcagcgaaatgggcatcagccggtcagcagtgctggtggtcgcctacctgatgatcttccacaacatggccatcctggaggctttgatgaccgtgcgtaagaagcgggccatctaccccaatgagggcttcctgaagcagctgcgggagctcaatgagaagttgatggaggagag

SEQ ID NO: 165588 - DNA, 581 bp, Homo sapiens
gaacctcctgacctcagttgatctacctgccttggcctcccaaagtgctgggattacagacttgagccactgcacctggccgcatatatatattttatttttttatttaaaaaaatgtttctgagacaggatctcactatgttgctgaggctggagttcagtggtgtgatcatggcccaccgcagccttggcttcctgggcttaggtgatcctcccatctcagcctcccaagtagctaggaccacaggcaccatcgtgcttggctaatgtttagtatttttttgtagagtcgagatttttgccatgttgcccaggtagtctcgaacttaggagttcaaaacgatttgcctgccttggcctcttcaagtgctgagattacaggcttgagtcacctcacatggctgcaaagcgattttttttgagacacatttagttttttcggtgatgtcagtaattttacaattaaagaaaaagttatctgaacaaagggagagtgcccttaaattgctaagagggagcattgctttgtttttttctagtttcgttgtgtcttacagtgttcaaacactgtactggaagta

SEQ ID NO: 165589 - DNA, 425 bp, Homo sapiens
ttgtgagtaattgaaagcttaattctcaggaaataatttctaaatccagatgaaacttgtgaggcagaaactccatgttattaaaaaccaaaagacaaatctgttcatcagtatcaatggccacttcttttcctcttccatgcaacacaattaggtgttttgtgtctcctttggctttggctttaaaggatgtgtcagacaaggaaaagtccttaagtgatgatgcttcagctgcaaaaaacgagcaatatatttaacagctaagtgtgagatttctgggtcagtgtgccataaatcctacagttccagaattgcaaagctttttcatgatttgaagctcaacacagagtgatttcaatgtaaatcctcccctccctgccctcctccatggctgtgtcacacaatgccctgatgtctggtttccc

SEQ ID NO: 165590 - DNA, 424 bp, Homo sapiens
gtacggaaaggaaaaaagccaacccagaattctaagtccagcaaaaatataatttaaaatgttgccaataataattgtgaatgccattatcctgaatgtcgaaatcccaaagattaaaacccggcctggcatggtggctcatgcctgtaatcccagcactttgggaggccaagtcaggcagatcacttgtgatcaggagttcaagaccaccctggccaacatggtaaaacctcatctctattaaaaaaaaaaataaaaaataaataaaaataaaataaaaaaaataaaaaagcttggcatggtggcacttgctactccagccactccagaggctgaggcaggatcaccccttgaacccaggaggcagaggttgcagtgagctgaaatcgcaccactgcactccagcctgggtgacagagtaaga

SEQ ID NO: 165591 - DNA, 554 bp, Homo sapiens
cacattagcagattaaagcagaaaaatatctcaatagatattttcaatttatttgttttaaaaatcaaaacctattcataattagtcttagaaaatgagatacagaaacaaaagtgaatctgataaagactatccaaaatcaatggctaaaatacatgtaaagaagagttctcagaaacattgcttttaaaatcaggatcaaaacagacatcatcactacataatccagcattggctatgagactcttgctggtacaagattgtattaataagaaattagggaaaaagtaataaactgccattacttgaggatggcaacagaaaaacaacaagaattaatactagttgaataacactggtgaatagaagatcaatttataatttctattccaaagcaataagtgtcataaaggatatcatttgcaatagcacaaaaatagggcatattgaagacatttagttgaaatatagagaaaaagtaaaaagttttattgaaagacaaaaatctataagctgaaaagtaaactatactcatgggtaagaagatcaagttt

SEQ ID NO: 165592 - DNA, 196 bp, Homo sapiens
aacctctgtccctctttccttgtcaggaagactgtctgtggagcaagaattaggaacaggaaaggggagatacgcatctgtggcactgatgcagcaggaaaataggggagaaaagaaacatctctggcagaaaaagtgaggattgtgtgaccacattattaccctgggcacgggcagtcactggagggtccactca

SEQ ID NO: 165593 - DNA, 335 bp, Homo sapiens
gacgtactgaaacccgctacaacatggatcaatctcagaaatatgcgaagtgaaagaagatacaaaataccacatattataaaactctatgtatatgaaatgtccagaataggaaaatctatagaaataggaaatcgtttagtggttacctaaggctaggggtgagaatggggagtgaccgcaaatggacatgagatttcttttgggggttatgggaatgttctacaattggactgtggtgatgattgcacaactatgtaactatactaaaagttactgaattgtacccttcaaatattatgcaaaatataactcaaaaagctgtattttaagaa

SEQ ID NO: 165594 - DNA, 280 bp, Homo sapiens
gcaaatttggtatagttaactctgccattgccagaggctgttcacttagatttgtcttgtaacatttttctgtagtaagtaaaggcagggatcctgtacccattttataggttaaataatgcagagttgccaagaaataagagggttggaatcacatactgggttggttggtaggtaggtcatatgatccaggaactcttggtccttgcaaggagataggaggaaatgctcaaatttgtctccccaaatgggggcctgggttgaggtttataagcatatg

SEQ ID NO: 165595 - DNA, 385 bp, Homo sapiens
caagacctctttattgaaatgcaggcagacttgcacctgcctgtaaaagtgcaagctgtatacttgtgtgtgttggcccagaacagtcaacacaaaacatgcctttgtaaagtcactggactttaaagataaagaaataatcctttaggcagccagacagaaagaccaagtatcttataaagcaaagaaaaccaacttgacatcagacttctccaaagtgacattcaataccagaagaaaaaagaagcaatgcctccttatctagaatttgtgggtagaattctgtcccccaaaaaggtatgttacactttgggaaactgaggtaagtggatcacttgagatcaggagtttgagaccagcctggccaacatggtgaaaccctagc

SEQ ID NO: 165596 - DNA, 195 bp, Homo sapiens
cacacccaacactcccacagccatcttcagcgggcgagcctggaaagaactgggcctgtcagtcatttagacttctgcactggtttgcagagcagtggtgtttccagctcactttccagcatggctagagggttagaaaaaaaaattattattattattttttaacatattcggcacaagagccccaggtgccct

SEQ ID NO: 165597 - DNA, 257 bp, Homo sapiens
ctgggtgccttcagctgggggtgggctcaagtaattggtgttgagtggaaaacactgaaattcctgtgttaggttgaactgtgggcccctccaaaatatgcctacctgccactatggagcccaaccttatttggaacagggtctttgcagatgtaattaaggtaagaatctcaacataagatctcccagcgtttagggtggaccctaaatccaacgacttgctgtccttataagacacaggagagggaagtttgaga

SEQ ID NO: 165598 - DNA, 396 bp, Homo sapiens
atgcaagataagcagatgcaagaaaaggcaaaggaggtctacatgacctttctttccagtaaggcctcgccacaagtcaaaaagaatatattttcactcaacaaaagatcttttcactcaacaaaaagatcctggaagaaccacatcctctgatgttccaggaactccaggactggattttcaatctcacgaagtacaacagctacagtagctgcttaaagtttgactaggtttgttgttgtttattttttaagagacagggcctcactctgtcactccagcaggcatgcagtggcacaatcctagctcactgcagcctggaacttctgggctccagccgtccttctgcctgagtctcctgagtagctaggactacaggtgttcaacaccatgctt

SEQ ID NO: 165599 - DNA, 259 bp, Homo sapiens
tccagtaattgtgctctttttctactggaccatgcccattagcacacagactgtaatacatacctcaaataaaaaacatataaactctccttctacttcacatccctctccagacactaccctacttcttggctccactttacagccaaacttaaaagaattgtctatatttggtaacccgagtcctctccctcttattgtctcaaatattctcccatctggctttcatccccaccactcactccacccaaactgatct

SEQ ID NO: 165600 - DNA, 599 bp, Homo sapiens
ctttgtcagatgagtagactgcaaaaattttctcccattctgtaggttgcctgttcactctgatcgtagtttcttctgctgtccagaagctctttagtttaattagatcccatttgtcaattttggcttttgttgccattgcttttggtgttttagacatgaaattactgcttctttaactcaggctgctttaaattattttttccccttgcattaaaagaaccttgactaacatatctcctattaccctctatatgctgccagaaggtagtcttacttaaacattaatttaaccttgaacttcttccactcacaatcttttaatgactccctatggttttagcctcctgataaccttccaattcctaagaagaaagagcttacctctccagcctcatcttctgtcacataaattcatgcaccataggtagtatccctaacttactaagcttctgtgcctttgtatacactattccccctgccgcaaatgctatatatcccttctcccactggattactgtatctttaagactttgctcagttgacacttctactaagaagcttttcttgggttcttcaggctaaatcaggtgctccct

SEQ ID NO: 165601 - DNA, 458 bp, Homo sapiens
agctggaaaggaacattgctaagtaggaatttcaggcacctgtgaactgagcccactcaataatcggccctttcccttaaccaaactcagcaaaggaagaaagaccaagttgctgcggatgcacagagccacgtgggtgcgggtcctctagaaacaggaattcagagtcagtagatatggaaatgttatggtttgcagtcttcggaccatgctgctttcatgctgttcacatgattctcctcggactgcgaggtaaagtccaagaaacaagtcgaatgtttgtattttcatagaaaaaacatctgtaagggtgcacaccgactgttaaccacggttacgcggggaggggaaacaagggagttacatttttttactcccttgactttggattttgtatttttccagttgtatttactttcataatttagaaagctaataaaacatgtttaaagaaacag

SEQ ID NO: 165602 - DNA, 341 bp, Homo sapiens
gactccatctcaaaaaagaaaaaaaaaatcaacaatgaaatatcattacacacttaccagaacagtttatcagaatagttaaaaacaaatagtggcatcaccaaatgctgttgaggatgtaaggaaattgctctcatgcattgctagtggaaatgtaacatggtacaaccactctgaaaagagttttacagtttcttatgaaactaaacatgctactgttgtatgacctagcaattgcactcttgatgtattttcctagagaaatgaaaggtttacacaaaaaattagacacaaatgtttataaaagctttatttgtaagagccacaaactggaacaatag

SEQ ID NO: 165603 - DNA, 296 bp, Homo sapiens
ctctatagcctacttatctctttgggaatatggtattggggatgagagctggacttcctagaccaaaactgtgatatggctgaaaagagagtttcaggggatacttccctctaatatcctgaatagaccagaaaaacatttcccaacactagaagcttctagtgtgtcctgttttagccagaactttggaagggagtacgtcaaacctttttttccctctttcttattatcctgatcctgtaaacactactaagagagttttgaagaaaatgtaaaagagactggtacttgagaaa

SEQ ID NO: 165604 - DNA, 338 bp, Homo sapiens
gtcgacctgggctgctggattgtctcgttatctgtttcacatgagacatattatattacgattcagatcgtattttaagttacatggataatagttcctaatggttttttttaaaattgtggttgaatatatataacataaaatttaccagtaaaaccatttttttaatgaacagttctgtggcattaagtacatccatgctgttgtgcaaccatcaccatcatccacctccaaaactttcaaaatcatatcaaacagaaactctgtacacattaaataagaacttcctgctcccctctccctgcacccctggcaaccaccatgctactttctgtctc

SEQ ID NO: 165605 - DNA, 700 bp, Homo sapiens
acttaaacactgatgaccttaggaaagccatctccagtctctaaacctgtaatgtgtggcttttggatcaggaagcctctaacattccctttcgatgaacatgaataatcatggaaaatttacaggtcataaagcataatcttgttgaatgctttttcatttggacacattgcaatatcgtcaccattatctgttgctattatactatccctgaaatgtcactattggtctgaacgtggaaatgaacagaaaataatagaataaaggcacaggaacaaacattgactgaatgcttttcgtgaagcaggccaagtgcactgtgctcaaacactttatctcctctaaccctcgcagcagcactgttatgtaggaattttattgatgaggaaagcgataactcaaattatacttaggaaggctatattggataggtttatcatggggaaaaagataattcaaaggcttttgatgaaagtaacattttattttcttgattttgttttaaatctttctttttgttgtttagttttaaaacgaaaatcttcaatatttttgtctagtattgatttaggcaattggtgatattcagtatataaatcttattctaatctttttttagatgttcttaactttgaaatgttaaatgaattaatctaatgtaaaaaataagcaagatattatttatttcagcaactgcttt

SEQ ID NO: 165606 - DNA, 346 bp, Homo sapiens
catgggtattacatttggcatcctcaatttataacagtctattttaaattaataccaacctaactttaatagcatataaaaacttggctcctggagagctccattctgtcctccttcatgatgctgctgttgtcatcacaattaacatgtttatatattgtgtgctcagtattgatttataattatttttatacatttaaattctacaggaaataaaaagtggaattacaaactaatgttataataatacctacttttatatttgcccatatgtttacctttactggagatctttacttcttcatatgactttaagcaactgtctggcatctttcctccctgtccc

SEQ ID NO: 165607 - DNA, 309 bp, Homo sapiens
ttaaatggagtttgtagcccaggctggagcgcaatggtgcgatctcaatctgtgggtcccagttcaagcaattctgcctcggcctctcaaagtgctgggattacaggtgtgagtcaccatccccagccagatcctgttaacagtattccaggtccttgccccaggcaggctaagccccctccttttctgaggcatttccctgttggcagttcttgcctctagcacccagtactgctttaacctttgactaaaatgagcttagtttgactttggtaaataggggaacaagttcatccctgcttttttttt

SEQ ID NO: 165608 - DNA, 552 bp, Homo sapiens
atgagtgtagaaaagagaaaatttgagcccagggctgtctcacagcaggggctgggattttaaccacaacactacagtgaacttcactgaaagtgtcaaggctttttacattctaatcattatctccacaaataacccccaagtatttggttatcttcttaaactgaactctttccagtttgcagctttggatcagataaggcctagggaatcagcaagccaagcttgttagtaaggcctgtaaagggagcagaagcaggtcccaggccgaaaccaaatgatttccacagtgcacacttggcctctggtgactgaactttctggcacctattttgggtcttcagaggctcctttgccttcctcttggttctcagctatgtcctgggaaactgagattatcagagaagtgactttcagataagccaggtgcccccatggcactgactccagccctgggtctgcccctgtccctgataccccaggtccgattggtccccaagtcctgcagaacacttatgaggacccctatatccagggctcccaccttgtccc

SEQ ID NO: 165609 - DNA, 871 bp, Homo sapiens
taaagataaatattctttagtagaatgttcttgttatactttcagtcagaatccaggcccttagattcttccctgtgtaacagttgcctagaaagtattaaaacacttgtttcggccaggtgcagtggctcacacctgtaatcgcagcactttgggaagccaagatgggcagatcacaaggtcaggagttcgagacaagcctggccaacacagtgacaagcctgtctctactaaaaatacaaaaaaattagctaagtgtagtggtacacccctgtaatcttagctactcaggaggctgaggcccgagaattgcttgaactcgggaggcggagggtgcggtaagctgagatcacaccactgcactccagcctgggagacagagtgagactctgtctcagaaaacaaacaaacaaacacatgtttctgggccctgccctgggaaattatgagtcggtagttctggagtggagtccaggaatctgcatttactaagttcccaaagtaagtctgaacttactaagttctactacttcttaagctttcctttggtgtttttttagtcagcattctgctgaatccttttggttttaagccatgagtctctctgtagtcatttttagacaacattgatgtaaattattcatgattttggattaggcaatgatttctcagatatgacaagcacacgccacaaaagacaaataaattggacttcaccgaaatgaatagtttgtgattcaaaggacactatcgagaaagtgacatgacaatttaagaatttacaaataatatatctgataaaggactagtatccagaacatataaagaacccttaaaattcaacaataaaaaggtaagtatctcactttta

SEQ ID NO: 165610 - DNA, 380 bp, Homo sapiens
  misc_feature (366)..(366): n is a, c, g, or t
taaaaattcaaagccccactcaaatgccacctattccatggactgtcccccagccctgcaagaactagcccatcaataatagcattcataacaacagccaacatctgtgaatgtgtgtcaattggtactttacacagacagtatcttatttaatcctcacagacaaccctatgaagcaggtaccactgttgtttccatttgaagatgaaaaatagtgaccaggcacagtggctcatgccagcactttgggcggacaaggcaggtgggtcacctgaggtaaggagtttgagaccagcctgaccaacatggcgaaaccctgtctctaccaaaaatacaaaattagcagggtatggtgtgctattgaancttctaaaactagg

SEQ ID NO: 165611 - DNA, 528 bp, Homo sapiens
ctaggaactccacacatacttctggggagaggggtgaccaaactttcctgagctggcacatgatccttcaactggttgtgctgaaatggaaactatgtttatgttgatggctagtcagtctttggggggccctcacttgctctctttgtaagggttcctcttttgagaaccgtaagttttatggatcaagaaagaaccatgttttatcagacttaatcatgtaataggcattttctagatgtggaaatagtggaagtagtttggtacacaatagcctcaagcatgacatcaaatgcagaagaggagaaagttacttcaaacatgccctatggctcaaatccatttttcccacaaagatttccatttctgccacaaagatttgaaaaagttaccatttgagcaattttcactaacagatctttagcaaaaaatattgcctgaagaaaatatgatataggaaagcattccttatattaaaaattgtcaaatatacaagcacaaggaacaacaacaaaaaaagtatttaaa

SEQ ID NO: 165612 - DNA, 606 bp, Homo sapiens
ctgtactcagtgctgggatgacatgtcacttactttgtccaatacaagtctcagtaccatctcatgaggaaagaacatgattaatccaccttcacagaagtggataaggaggctcaggggtcctgcagcattttcgtggtcacatggctgctaagcagcagaaccaggaataccaagtctgtctgataccagagctggattccaaccgattccctagacatcctccccccaggccaaatccattgaacatcagctgcactcagagacggcaccaaccaagcacttcctgtgtatctttgaacttaaatgaaatctaagtactctgcagccttgttctgtctcaaaagcccaataatctccatttctccacaattctcagcaattagctaacataattcttatgcctttatgaacatatattcatataaaattatggactgaatttcccatatctaccataggacaaaaataaccccatgaaattctggcattttttgctttcaggcctattattctttctagacattaataatgattataagcagaagaagtttagtccaaagaaatgagcaatgggtacaaaataaatagaaagaatgaaagacc

SEQ ID NO: 165613 - DNA, 478 bp, Homo sapiens
atcaatcatctatcgaatccatcatctctatctaacctatatctcatctatctatatcatctatccatctatctgttatctctattatcaatctaatctataatctatcaatctatccatacctatatatttcatctatctaatctatcattctatccatcatctctatctatccatccatcatctctatcgtctatatctctattacctactatctctatcattaatctatcatctatctctatcatccctctatctatccatccatccatccatcatccatgcatctttctctctctaatctatgtatctatcatgtctctgtctctccctctctctctctttcttcctacctacctatctatttgtctacctaacctacctatctaaaatgtctacagtgatccttaagaaaaagccaactttctgcttatcaatcctcataatctgggccccaccttgatggttgtcgctgcat

SEQ ID NO: 165614 - DNA, 556 bp, Homo sapiens
cctatgccttctcattgtctcctgaacatataactatcatttcacagaaaagattaatggtcctgattaggaatagtacataattttgatggcattattagttaattattttctttacattgtagtatatttccagagtcacccatgcttacatttgtaatatattttcctgatttgagagtttgtttttagcagtttttcttacctatactgcactgctgaatcaggaaaatttaagaaaaagaatagatttaaatgtgtaatatcaaagagaaatatagatgatcattaaatttttagaaattttggggagttaaggagaagcattgtttgttaaaaatatataaccgattcttatatttaaaataggtaatttttgcatagttgtgttctaaatatattataaactagtgccagtaactctaataaagctagtattactgcatatcactggtgggatagaatctaaggacaaaaactcacagtagtaaaatctaaaattgctttcatggtctcagggtaaaattatccaatttctctgacaaataaatggctc

SEQ ID NO: 165615 - DNA, 415 bp, Homo sapiens
gagggggcttccgggttcgagtgaagcaatctcttttggtccctctgtctcaggtaaatactcccaggctgtcgccagtgttactggacactgaggagagagatgagaaaagaaagtagtggccctttcctgaaggagatagagcaagacgattttccagtatttgtgtttgcagtgtaagaatttagttaagtctatgtagctgctaatgttttccagctactaaatccagttcttttccaataatcatcattaatagccctaatctaacagcaatgtgtaaaagcaagacttttgcttttgttgtcttcaaaacttccagtccaacatcactgagcacctgctctctgtcaagccctgaagagacaaagaggagccaggagctggatagaaaatctcttagaaaagaaatacc

SEQ ID NO: 165616 - DNA, 157 bp, Homo sapiens
cctcagcttggaacatgttcccccattccctccctctccaatttcctatgccctcaatttaaaagttacctgaatctaggacctttcttcctctgcaagactaggttagaggccccctgcagtgtgccgttgagcatcctgtggtttctggtgagta

SEQ ID NO: 165617 - DNA, 133 bp, Homo sapiens
gcagaattcatctgaaatttttttgtaatgtaattccaggtaaatttgattatttgcagaaaaagtgtacttaataatttggagctctagaatagtagaggggaaagagcatagattcaaagagacctcgctt

SEQ ID NO: 165618 - DNA, 498 bp, Homo sapiens
ccagatcaagaaacagagcattatcaacacaccagaaacatctctcacactccattctagttaccacctctgcctaaggtaaccgttgccctggtttctaacagatatattagttttgtctggtttttttaaaaaaaatcttgtgtaaatggaataattcaatatgcactcttgggtctggcttctttcgctcaacacaacaaccttttattaggtcaaataatttggactccccctttaaagatgatggaaacagtctggcttgcagaaattagtgaggcattacttaatatgatagaattaaggaaaaacactaaccaaactgaagccatatttatattctgatgacagtctggttagggagaccaaacagacacaagtgaaatgtctaatgtgacaccagtgtaggaagcaggaaaattcagaggcgttccttccactaaggcaacccagagtgtatttcaccgtcctttcgtgagggccagcaacccccataat

SEQ ID NO: 165619 - DNA, 286 bp, Homo sapiens
tatgttgtcattcctgactccagccagattgaacctggccttaaattgacaatgatcttgtaggagtaaaatttcacctgtattccttgccagaggaccagagctttttagaagaattccttagaaaatgaaaaaaaaaaaagattcaataacttcttgagacatgtgcattccttccagagcatttgtgaggagtgttcagctgctgcaaacatcccatgaatcctcagctacttggaacaggtgtacaactctgagccacggtggggaggcagactagcaataa

SEQ ID NO: 165620 - DNA, 756 bp, Homo sapiens
gcagcagtcgggggcggagcctcggcctccctgggcttccttcttggacccaggccggatgactggagcccaggacgggctgttcccgtctcagtgtcccatctctgcagaaagagaggcccccttggccacatgaacccccatcgctgcgggaaggccatattggctaccaggggccgggccctgccacctggcctagccagcctcacatcctcgctccccaacggtctgcagtcaggccccagcattcctgggctctggttttgcaattcactaggataacgcggcccttccatcaatgaatcatggactataaaccactgtgccagcgcttgagctgttccccgcaccgccccacagtccgtgattcacctcagggtggtggtgatggggctcggagcccaagagaggatgctcgggcctcaacccagcctccaggctcaaaagccgctcacggccgatctcaggggccaggttccgggaggtgggggctcggccctcccttgccaaagctcaggcctgtggggtctcatgggggtgggtgtggaggggctagcattccaaaagcctatgcccgggcctgcatccccgtgtcagaacacagagaagcttccagaaagaggatggcaccctccattaaacaagaaggcaatcccaccactctaaacagccatgcacatccctcgcctccagccggccacaaggctaagcaccagtgccatggatgccaaggtgggccagagtgaaggcggccgc

SEQ ID NO: 165621 - DNA, 379 bp, Homo sapiens
atagtcctttttgtaatgggaagtgaaaacaaatcaaaggactggctacataaactaggatacaggtatacaatgacgtaactacttaggtggggctacacgtatggatataaaaagatcttaaaaatatatgtgaaggctgggcaacagagtgagactctgtctcaaaaaaaaaaaaaaaagaattggaataggtggcttcaattcctatatgtaattccccagatatttaaataaagttaaaatggatgtcctggtgattttcagtcccatgccatggcagtgtcaactaggcctcagttacttttcagttggcccgaatggaccccatctcaacattgggcaatccttaccaagcaactacttcactcgaaacccg

SEQ ID NO: 165622 - DNA, 203 bp, Homo sapiens
gtagatccccaatccaagggccagcaggtgagacagaagcagagatggaagaaacaccttcaaaaattctttttagaaaatacacccttttggccaggtgcagtgcctgtaatcccagcattttgggaggctgaggtggggggatcacttgagcccaggggttcaagaccatcctgggcaacatagcgagatcctgtctctac

SEQ ID NO: 165623 - DNA, 340 bp, Homo sapiens
attcttaaattccaaagattatttacaatgtttctgaagataaactgtgtaagaatctgcatataatgaggctgaagttgagtaagaagagaactggcatttaggacactacttttcttctgtcaagtactgtcaagttttgtttctgcctggaaatagatgcacctcaagggagggttgcatgtaaaggtgtgtgtgtgtgtgtgtgtgtgtgcgcgtgcgcgcgcgcatgtatgtgggataagaaggggtgtgtagtttatccatgtaacattatcatatattaacacatatatctacattaatttcttacttattaaatgtccatagaaaatatctg

SEQ ID NO: 165624 - DNA, 594 bp, Homo sapiens
actagtgatgatcttggcaatggttttgagcttggcgagcctcagtttccttgtctgtgtaacgaaagatgggggtgtgtctacatcacagggttatcatgaggcataactgagacattgctcaggaagcacttcttattggtattacttacgaacgggccatgattgcataatgaatctgatggctacatgcttttgaaattacaaaaccaatgccatccaattgattggtgatctgcctgggataggagcaagttaatgcattgaccatggggggcttagcacagcgccgtttccctgggagacttgggctgaaccgaatttgttcagccaaagattctgcctcctccctgggaactaggaacaaaagggccttgcttgaaagaggctgttgttccttcaccaagtttagaaagccaaagttcagtttctgcaaccagttccaggagttatgtggcagggctagactttttccttttttcttgtgcctaattttgggccagttcttctggttagatgattgaggtgaccagaacatacaggaaaataaacagaaacccccaaactgccctttgaagctgtccatcctcgctg

SEQ ID NO: 165625 - DNA, 286 bp, Homo sapiens
gacggcagatggccatatagaggctgggcacgggatgggtctgcctgaagcaaggggtgccttctaatttgcacaaaggagccatatgggctggtggtggctctgtggaggggcacccacaactcctgcctgcatgcatgtggagacacagagggtgcctgggggtggcgtttgcaattggcacggtggttgttctagatagaatctgcctgcctctgacttcaccccgatgccatctttctgggtgaatgagcacaggcggcgtcagaggccactgtgtaagcag

SEQ ID NO: 165626 - DNA, 223 bp, Homo sapiens
cactgccttcaagcagctcataccctagtggaagaagcctaaatggtaaaatagctcattacaatacaatagattagtaatgctaaactagtcactttatgtactttcaattactggagcacagagtagtaagccaatcactttgaaggggcaacaaaggaaagaatccagttggatttctgagggtgagtaggagtttgccaagtaagaaaaggacatgcca

SEQ ID NO: 165627 - DNA, 473 bp, Homo sapiens
acctatgtagcaaataatgaaagcaagacctgaaaggatcagactgtttctaagtgatctaactacatccctgaacaaaactcaaggtttatataaaggaatataaaaataactaccacccaacaaagtaaaatctgtaatgtctagcatcttagtcaaagattaccatgcatgccaagaggcagtacaatgtgatcaataattatgaaaataaaaccaacttagaactgataaagatgttagaattagtagacaatgacagttaaaatatttatgataactatgttccctctattcaaaaagttgagacctagaagatataaaaacccaaatcaaatttctctaaacaaaaactgtaatgtttcagttgaaaaatataccagatgagattattagcatgttagacattgcagaagtaaaaattagtgaacttgaagacttagcaatgaaactatccaaaatgaaacaagagc

SEQ ID NO: 165628 - DNA, 510 bp, Homo sapiens
atttttctatagaacttgaacctttgaaaacaatcacttttcttttttagctgcgaaattccatactgggaagatctaaaatggccattaaagccattctattctgtttacaacaaatcagaattggacagctttccaaatccataaaataactagtgtactacttatagagtgtaaacatgactttaccaagattaaaataaacacatgtaaggccagctgcagtgctgtcaacacaccactataaagcctgataaacgttgaggaaaatcctgctgctgtgatgtaaacaatgatcttatggaggatcttttatttaaaaaatttaatcaaaatattgcatgcaaatggataaaaataagaaacatctgtatgaaaccacaaaagaccctgaatagccaaagcaatctagagcaaaaagaacaaagctggaggcattatactaccttacctcaaaatatgctacaaagtgatagtaatcgaaacagcatgggtactggtataaaaaca

SEQ ID NO: 165629 - DNA, 364 bp, Homo sapiens
aaaaacacatggtcactaatctacctagtgtgtatgtttttttcctcctcctctagtaggccccattatctggaacctggacagaatacagaatattggataagattattagaattgtcctcaatagacattttgtcagtcagcatgtggaatgaagagatagagaagcaagggaatttagggtgttattgcccagagagagattgagaagatagactgtggaatttaaaatgctgagtgcccggacagggctaatgaataggagaaaggggagaaaggggttagtatactgagaatcttcttaaataaaaatgaagaatgggagtactggcacaagcaagttggatggttggtaggttgtgat

SEQ ID NO: 165630 - DNA, 562 bp, Homo sapiens
tatgcgcgagtactggttgctgcattaaaagacaaacttgtcacgattggctttgatagcgataaaggcgactaacaaattcattgaaatgttgtttccctccggtaacctgaatctgtccttagcctgcacagaaaggggaagtgcgagtggagttggggaaatgagacggcgaatgtcaagtgcttaccacgtagtgcagactcaggctgacagggggccacagaaatgcaaatatgtgagcagtgtgggtaactgcatcctggggaggaagtcctatgtgctggaataccacaagcacccatttctgccctgtggtactgcgcagcgttggtgtgaagcgatacataggcgtgaagtcccgagaacgcaattttcctggttaaaggacagcaacgtctacatttcttccaagaggcctactttgttggaacttcacttcacttgtgaaattagggtgttgggcagtgagtgaccactaactcagctcccttcttgtgaatcttggcaacagaaaacttttcgtttgtattactgaataaagtgtgtttcttaaaaaaaa

SEQ ID NO: 165631 - DNA, 747 bp, Homo sapiens
caaagaacgagaggaactgccactgcttaaccctttgttgggctgtgctaatgaaattgaagggaacatggtgagcatgcgaggactgtgagagccagaaagaaacccccaaaataatttcattcaatagtttcatccaaactctcccagtttgcaaatgaggaagtgacttgacaaaggccgggcaccaagttgaagcagaaccagattttggccaaggtccctgggctcccagctgggtgctgggcattggatcccaggcctgctgtgagggctggctctcttagggaaaggggaagggtcccatggctctcccatcatgctgaaggttgacacctgacaagtcactgcagctttcccttgttctgctctgattctcattctactctaaggaggcacagccaccattatcctgattttatggctgaacaggccgagcttcagggtagaaactcatcctcatccacaaagccatgggaaggcttgattagaatttaccactctgtccccagacactctgggctgttcccaccttcaggtagaactcactgcctcaaaagccaccttttactgttctttgtcttatcttctgggattgtgattttccctgtaggaaaaatcatggacaatggcagtagactggcgtggtggctcacacctgtaatctcagcactctgggaggccaggcaggttgagaccagcctggccaacatggtgaaaccctgtctctactcaaaatataaaaat

SEQ ID NO: 165632 - DNA, 264 bp, Homo sapiens
gtgaaacctaacattagctttttgagatgttttttagacttttgcatttctgactccacacagaccctcaattcatgactcaaccagtcctgtggcccccacaggtgggctgagagcatgagaactgttttccagacccctgtgatttcatccccaatcaatgaacatcccccattccctagccccctgcccaccaaactgtccttgtaaaaccctaacctccaaacttatggggagactgattttagtaattacttcatctcc

SEQ ID NO: 165633 - DNA, 387 bp, Homo sapiens
agatggagtcttgctctgtctcccaggctggagtgcagtggtgcaatcttggctcactgcaaccttcacctgctgggttgaagcaattctcctgcctcaggctcccaagtagctggggctacagtcgtgtgccaccatgcccggctaattttttgtatttttagtagagacggggtttcaccatgctgggcaggctggtttcaaactcctgacctcgtgatcctcccgcctcggcctcccaaagtgctggtattacaagtttgagccaccgcgcccagcccagatgtttaaagtttaaggagtttcagcttatgttttttgccccctttttaaaaatttatgtcctcaatttttttcttacaaatttttatttttgccactttcttc

SEQ ID NO: 165634 - DNA, 198 bp, Homo sapiens
ccaggattagaggggaaaggaatagaggtgcattgcatatcctcttcctttcttcatgtacttgaaggacaagttgatcagcaatgaggggagggggacaggggacgttttgagaaccagaaaagtatttagagcttaaaactgaataaaattttagtaactgaagtggacaggaaattatgggctatgatctagata

SEQ ID NO: 165635 - DNA, 399 bp, Homo sapiens
acagtaagaagtgagtaaatctggcccactggcaaattgtggcctctgcctatttttgcaaataaagttttactgggacaaagccaagcctatcatttgcaaattgtctataaatattttcatgttacagaatcacacagtttcaacagagaccatcttgtctacaaagctgaaaatatctactatctggcccttgaagaaagtttgccaaaccttagtttatataataaaagatcagctatctcatagacacctatctcacacaacacattgtgggaaaggaccttctttttttttggagacggggtcttgctctgttgaccaggctggactgtagtggcatgatcatggctcactgcagcctcagccaagatttactcatcgggggtcctctagagt

SEQ ID NO: 165636 - DNA, 391 bp, Homo sapiens
agatggtcacgtacaaacagggacagaacaataaagttggataaggaagaatttactgctatgggagtacacttctattcaagatttgacagcctagcatggatcctgaaggatgatgtcgacacactactcaaatggctcttggaaacctggaaaaaggtaatggtccacacaaaatgaaataaacattaacaccatggcagatggtggaggaaggtatcaaaagactcagaaaagtggcatcttgaagtggatacactgtttggaagatagcctaccagctaattatgttcccaaagagggctcaaaggatgcaaaagtgatgtggaatgggctggtgagagggatattatcagctttgagaagttcagtggtactatcctctgtaggc

SEQ ID NO: 165637 - DNA, 422 bp, Homo sapiens
gcagattttgttgccaatgttctggggctgttccctggacaccctgctgtacctggtcactgcgcctggtcctaggggaggccttcaataagtgcatttactgaggggagaatgaggcctagagaggtgggaggactttcccaacgtcacccagctgggagcttggtctgaagaaggaaggggctgttgcatcttctaactgggatttctcaggctttcaaggatagaattgagtgtcaatggcaaggcagattttgtggggtggtgagaaaaatggccagtcacagcaactttgtattcaaatcctctttaacaccatcggaggccagcaatattttgggattattgagggccaatgatggcctgcgggacaaatccaacccactgactgattttgtgaataaagttttattagaacacag

SEQ ID NO: 165638 - DNA, 206 bp, Homo sapiens
ccaccgtgcctggcccaagttccaataaaattttatttacaaaaatggtggtggaccagatttggcctctggtctgtaatttgttgacccctgctttaaagttatctattgttaagtcacatttctggtttttttttttaattcaacaacattaatatcttttaagcctctgatttatagctaatgatattggatttggtggattt

SEQ ID NO: 165639 - DNA, 405 bp, Homo sapiens
gagacggagtctcgctctgttgcccagactcgagagcagtggtgctaccttggctcactgcaacctccgcctcctggcttcaagcaattctcctgcctcagcttcccgagtagttgggattatcaatagagttttcaacagatttttaatctaattgaaaaatcctttgctttgatcgaatctcctctatatgatggtgttcctccacttttgtgaggtgaggcagtccacattttttatattccagacaatgttaccttttaactacctttcatgtaacaaactgtcataacagcagacttcattgatcaggaatgggcaaacatttctgctatgatatgaccatacagtgcctatcatccagctattcagagtcactatctttgtatgtacaggaatctgctg

SEQ ID NO: 165640 - DNA, 373 bp, Homo sapiens
acactgaggcgtacccctagaaatcaatttatttatcaacagaccttttgagactgcttcaataaaataccaaatacctctaattgtcttatagccaatctttattattctatagtccacgtaatgacagatgttctaaaatatactatgtatccactgcttattggtctgccataataggtacttaggtactatataaatacctcttgaagcgaattcaaatgaacaataatcataccaaaagagaaaagattttcttgccccatgacttacagccacgtagcagcttacagttttaccacttcctcttctaggtggggaaaaataattcctttaataatctatgctaagctgtgatccaacttttaagttt

SEQ ID NO: 165641 - DNA, 395 bp, Homo sapiens
catacatacatatacatatatacacatacatacacatacatatatacacatacacacacatttttaaatgcccaccaaaagtcaccatgtgtaaacaatcttatgagaagggaattagaaccgaatggtacactggcaatgttcaggaggacgttgctgtaataaataaagtttcatttgaaagttttcataattcagatggtaactggctgaaaatatatgaggcaaaccagtttcaacagaaaataactttagccagaagtcacagaaatatacaaatagttaatattcacttttaaagtcagaaattccaactcaggtggcaagcaattatttcataagcgcagaatattatagtttgaagggaactttgagattacttgatctaacttcta

SEQ ID NO: 165642 - DNA, 453 bp, Homo sapiens
aactgtatcagtcttgactttttttgaactgccttccacagagatgggtttcaagagattgttcacaatcatggagtaactcttcccatttaaattctttaccaaaagatcaaatgacctctctgtgaaatgcacctgcacattctcagtgggaacttgatgaactccagttaaggtaatgtagattttcacaaacttatctgactgatcccatccataattactgattttcaccgtatagcccgttgtaatgggagcaaccacagcagctggtttttcattatcaagaagttctgctttcttctgcgatttctgttgcaacttgttcttgatttcggtctcaatcttggatttttcagctgtaagggcatcacgtactcttcctagtagccttttccagcaacacctttacctcttctagatctttctgtagctcttctgaagccatggggg

SEQ ID NO: 165643 - DNA, 204 bp, Homo sapiens
atcatcagctttcttgaagtggtagatactttgaatgaatcgattttttttttttttgactctcagactcatccgtagatatagacttttgcttaagcagaatttatggattttcttttcttctagtggtgatgacaaatttattttgttctatcatttttgtcaggttcttctagctataaaaacatgcattgtgagtcagtg

SEQ ID NO: 165644 - DNA, 236 bp, Homo sapiens
tgtcttttgtcagggcagcagtggtggtccaggcattggtagcagcagagatggcagaagaatggaaaagaaaagagggcagggaaaataagtgaatcagaagctagagcagcctttgaaaagggagtgtcctagaattgagggcaagagaattgaggaagagaagggaattcctaccacaaggcaaccggggaattccctggttggggttgccattcactctgtcactgactggg

SEQ ID NO: 165645 - DNA, 485 bp, Homo sapiens
agagatgattaaggccaaaccaaaccaatacctggcctttgcctccccgagaccgctttccgtagattatttgggatccccaaccagtgatttccagaaaccgaagtagcttgccaaccagtcccctgttccccctagatcttgttaagaccctaccgtggggggaggtctaccccttctcatcttcatcaggtagtcagaccagccaactgattctaccaatccgctttatgattttggagggctcttcactccaaatgactatgctgggggcccaagccatagccgtggaggctcctccgagagggaattcccctgagatcctctggcctcctctggaccccctgggggtttggaagggggaaaaaaaaaaaaaccttatctcctcttttactttgaagagctgaaataacccgcttctgtttcaacttccctcacttcacttccacatttctctagctctctgcctattttattttcttatc

SEQ ID NO: 165646 - DNA, 308 bp, Homo sapiens
ttgcctcccgaggatatcatgaccagcagagactgagaaactacagataattcagagctcagaaatcaggggcagtgaggtaccagtctgggcatcagactgcactgccttatctcgaattattgccacaatttcaacctttccctttccttaaaccccaagctcatacctgtgcccttccttctctcccagaagaaaaccttatctcctcttttactttgaagagctgaaataacccgcttctgtttcaacttccctcacttcacttccacatttctctagctctctgcctattttattttcttatc

SEQ ID NO: 165647 - DNA, 462 bp, Homo sapiens
actgacagaggagcggcctgtgtcctggcaagacaatagacttggtatcagccaggcctgggataatgttctcaatctctgatcatggcaccctgggcttggtggtaaagtcactttggcctaatcatgtctgtaaaatggaaatccaggtacctccttggctggattgtcatggtcatgatatgaaatgacacgtgtgagaaaggcccatggaatctgagagcattagacaacagctagttcttagggtcaccaagtggtcaatcaggctttcctttaaaatcatgctcatggtgacaaataagtcaccagctgttgaggcaagctgtttgagttgtggacataatggttctgccccactgaatcatacatggggaagctatgctggagggaggtaagaaacttgccccaagtcccaaagctagtaagagatagactggaacctgggtcctgggcctgact

SEQ ID NO: 165648 - DNA, 320 bp, Homo sapiens
gcagtggagacaaagtgaggaaagttcctctgtctattttgttgtggatggaaagggtagtgagataatggactggacgatttaagtgttccaggtaggttttgcttaggtctatctctgggtgacaggtttcctttggagaacttacaaagcaacttataaaagcaagcccattctccaggtcctaaggacaaaggaatgtaattctgtagacattttatgcttctataaaaactcgaagacactttctagaaatctacttcaggttatggaaatttggtgcataaaaactaaaattaggcgctacaggagtttacaga

SEQ ID NO: 165649 - DNA, 321 bp, Homo sapiens
taggggaaactccccctgttttctggtccttccagctgttcctgattccttccttcagcttaactgatccccaggccagtttctgtgactcccctccctccctggctggacaggccaatgatattaggagctgctcaggaggagggatcagacctcttccactgctgccccctaacatttgatcccagggcttaacactctgatgcaacacctgcctcacctttggctgtttccctggtggcaggtgcacagtggggcagtgtgtgggacctggagcttgcagcttccaggctggaaaacctgaagggaccttctcatctt

SEQ ID NO: 165650 - DNA, 361 bp, Homo sapiens
tggggtaagtcactggggagcccttttgcaccagttcaagctttcctcagccaggaatgctcagccaggggtccattcagctaaggaggatgtggcaagctgccaccattaacgaacactgatagcgtgctttacccgggtcaccccattgaaccctgcagtagcctgcctctaagacataaattgcagaattcacttcacagaagaaaaggcgggctcagagaggctacctaaggtgctcaccaacacacagctcataagtggctcgacaagtcttccaatgctgctgcgccagagcctggacctactgctacagctcccaagcaaccagtgggctttaccatgcactggtgaacgcagc

SEQ ID NO: 165651 - DNA, 474 bp, Homo sapiens
atgctctgcttcccttttaaacgtaagtttcaatttcagataatctaagttcaaagttccacagctctttagggcaggggggaaaatgctgccagtctctgcttaagcatagcaagagtgacctttgctctagttcccaataggtttctcatctccatctccagacccaaagtcgcttttacattgctgggtatctttacagcagtacccaactctaccagcacgaatttactataatagtccattctcacactgcaataaaaatcttcccaagactgggtaatttataaagcaaaaaggttaaattgactcacagttactcatagctggggaggcctcaggaaacttacaatcatggcaaaaggcaaaggagaagcaaactggaccttcttacatggcagcaggagaaagaacatgtgtgtgcagaaaaaacttcgatttataaaaccatcagaattcatgagaattcactca

SEQ ID NO: 165652 - DNA, 377 bp, Homo sapiens
aagcattggagtccttggagctgcccgcaggactgctgcccttgatcaccaactctcctcacttgtcagaactcagctattaggaccccaagtcaggtcagggctgtcagggagacctcggcttgtaactgacagatgctgggctgtcaggctgtatgtgctggaggaggtaggaggtggccttggtcccaagggcacagcttttgagtgagaggacagttgccagggaaaggggatgcatgccctctcctgtctctctgtgtgtgtgtgtgtgtgtggtgtgttttgggggctgaggcacagaggaagaggatgcatgtggctgaatttcttatccctctgtttcttctttgcatttaattcaaaggccaaaaaaa

SEQ ID NO: 165653 - DNA, 334 bp, Homo sapiens
  misc_feature (308)..(308): n is a, c, g, or t
ttactaaatatcgatgagtgtgcatctttttctaaataccatggggataattgtaataaataagattcagattctgcctcagcaaacttgtgatctattagacagatggtggtagtcagacaagtacacaaatcgcctcaattacatgcaaaatgtgataaatgcaatgattaaggcacgaaaaactatagtgatttaaaaagggaattgttacatctaattagagtacttaagagaggcatcttataaagtaagggttctcaacactggctgctcattagtatcacactgggagtggtgcgatgttngtgcagttgcacaagttgtcgagatt

SEQ ID NO: 165654 - DNA, 437 bp, Homo sapiens
aatgagatcacataacttatgcagatcatgtggacatgcagtcaacaaacaatttgttgatgacctaaacttacactgttatgctggtggttaggatgccatctaaacattcttgacttagttgagttattgcaagacacttacacatttaaaagttctgatttaccgtgtgcaatgcttgtatttgatttgcttagcaggcatatttcatataacatatgatttcattgcatgaaattttacattatttcctcattagaagtactttatatggtaaaaatttcccactcgatatcagataacttcttgagacttggtgtctgattttgtacaagggaaaaagaattatctggtgcagtttctgtttttatcccagctacagcatataaccattttctttctgatactgcaattctagggtgctttgtttgttcctc

SEQ ID NO: 165655 - DNA, 210 bp, Homo sapiens
ttattccattgtggtccaagaaaataactgatatgattttgatatttttaaatttgttgacacttgttttgtggactatgtatcacatgatctgtcctacagattattccatgtgctgatgaaaagaatgtatattctgcagttgttgaataaaatattctgtaagtgtctattaggaccattttgtctaaagttcagtttgaacccaat

SEQ ID NO: 165656 - DNA, 498 bp, Homo sapiens
cagcctcttacatcaggattacaaacctgggagggactctttggggagaataaatataaatttgagccaataccaaccttatccttaaaaaacagacaaatatcatccctttcccagtgaattttgtgcaattaaagcttctggaatgaagtgatgattaggtgtagggtacacactgtattagactgaatatttctgaagcaagaagctttgctttactcatttttgttctgctaaaggcagtaagaagacacccatgagcctgggaccccgactttccctgtggaaatgtttttcaggactcctgcacttaatctagggttggggatatttgatgaaaggtggggtaggtgtcttaagaaaattgtactcttgatatctcgctcctccactccctgaagtaaggagttggtcacttgcatgcctgggagtaggcagcaatatttctatatatgtgtctgactcttagctttcattgagacttttctttctcatttc

SEQ ID NO: 165657 - DNA, 335 bp, Homo sapiens
caaaaatttagaggatgttggtccttaaatgaccatttttttcttctgagagttcactgatgcttttgaataaatgtccttctagtctaaaaggagaggtcatagtataacaaaatgcaaataaaaatataagcatatattgagtgtttactttactcaatacatgcttactttatgccaggcactattttaagtacttcttgtgtattaatgcatttaatcctcataacaactctctgaggtaaatattactatttctattttatatatgaggaaattgaatcacagaggttaaggaatttgcccatttcacatagccaagaagtggttaagcc

SEQ ID NO: 165658 - DNA, 363 bp, Homo sapiens
atgcaccttggaaagaaagtgattttctgaaaaggctctttgctagccttaaaattctgtgggtttatgagatcctagcaacagaaaggcattttattttctttttaacagcaatttttgtggcatctagaagcaagtgcagtaagtctctgggtttgaagggagcttcagtgtgttggtcagtcaggcaaagcgtgggtgaaacttaggaatcctgtgtttctctttgaactcaacagaaccgctacatttcttgacttccaccttcccaaatgtatgtttaaaacaaaaacaaaagtattctgtctccagtttacaaaggcaaccttcctgaacagaccaacatggattagtgccgcctgt

SEQ ID NO: 165659 - DNA, 126 bp, Homo sapiens
caggaaggccagtattgtttcagtaatcctataaatgccattttaaataattattttaaattccctaataatgggagattatgctaaacatcatttttagctattcatgaacaacaaagcagtgct

SEQ ID NO: 165660 - DNA, 193 bp, Homo sapiens
gtggggatggtgtggcaggggtgggtagggatgaaagccatatcatatcaaagcaagcagtgagggctatctacatgactactgcatcttctcggtatgccagtctaatttttatttgactacgcacaatctggcactcaaacataagatatctacaaaatcacaaatctcaggttttgtttgcttcttctgc

SEQ ID NO: 165661 - DNA, 123 bp, Homo sapiens
aacacgtcacacgttatagctacacagaaacaactgtggattacaagtcccagcagcttctaagcttctgggaggaaatctgtagccctgacccagtgtgcctccctcgctagtgtatctcca

SEQ ID NO: 165662 - DNA, 447 bp, Homo sapiens
gacctaaacccagaccatctgtttttttactggaaatgacgtttggatcaaaagctctgtatcttaaatgaatggtcattaaggcttatgttagttaccaccgtctaagacccctcagactccagagggaaacatgagctcacaaaacagtaagacatgactgagctttctggggtttatctgtcattcctcggctccttctaccaaggttctctgttacttaaaatggaaaggacagggcagaggctttggcctagggtctaatccagctgggcaagtcacagggttctaagactccgtgcttagctgtcttatgtttcaccccttgctttcttggtttcactagtttctgatgcttctgtaagagcaaagtcaagattcttcaagcagcctgcatctatgtttccctcacaaagtaattataaacttgactggcttagatcatga

SEQ ID NO: 165663 - DNA, 364 bp, Homo sapiens
accgcccaggacatcttctgtagtgcgagctgtgccctcactcgtgaccacgctgtgtgggctcatcctggctggggctggtcccggctgtgctgagcgtagatgaggttcccctgcatcctgcgctggttctgtcgtcgtgttgtgtaaaagcctcacagtgcgtagtgttctcctgcggtgactgggaacgcagtttcttgtccgcagtttttaccatgagatatctcgactggtgggtttgcacttgagcttgtggggctggtgggcagacgtctgccgggccttccagccttcagcttcatgtgtgggacgcggagccccatgagcttgaggggctggtggggagatgtccgccgggcct

SEQ ID NO: 165664 - DNA, 394 bp, Homo sapiens
agtagggtggggatatgggatggtatattcacaagcagaaggggagctcagaaaagaaacttagttataagaaaattaaattgactctgtggcactgggagtggcacctgctacacagaattgaagagttaaggtttgtactgatgtaactgcctctaggcagagatcatcatcatgctatgtcgtgtaaggacagctatgcagttggggagccacagaaggcttcagggagggggtaaaatgtgagcaggggtctcaggctgttaagagttttcagagatggagatagcaaatagggaggttggagaaaaatgcatttcagaaatgagaaatccttagtcaaggatgcaggggcaggaaagctttgcatacataaagcaatagctcctctgac

SEQ ID NO: 165665 - DNA, 577 bp, Homo sapiens
catgggccatctcattcaacttccattacagttgagaattaggtattggcagccctgctttagatggagaataccaagcacagcatgattaaattggcaactggtatgcatgcagaaccaagatttttcatactggtgtgtacatcaaagttttcattatgtagaaaattatacagaagctgtatattgagaagtaaataggtaaacaatcaactgttgagaattaggatacctgagttattaagagatgtgaaaaggattcaggatacaactaatacttattgaatactgctatgcttttaataccctctaccagaaaggagttaggtagagttcaagttcttagaacagtacctgatacataatgtaacaaaatcttactcatcaattactactattaatgttaccactccactaaatcctgccaacaatcctgtgaggcacatacagttacagttatccccattttagaaataagaatgatgcttagggaagtgaaggtaatacactcaaggacacggaactgggtaaaggaggatcaattttgtgtataagaactaaaatggggctgagcgcg

SEQ ID NO: 165666 - DNA, 181 bp, Homo sapiens
gatgattaaatcaggataattggggttatcccatcacctcagcatttatttcttctaagcatttaattacagatcttagaattgttagtggctttagactctttactttgtcaaatgagaaaaacaaggcctagagaacctaagtaacttgcctaatgatttagaatccagaactgctatg

SEQ ID NO: 165667 - DNA, 506 bp, Homo sapiens
agggacaatgctgactctggatggtgtgtgatactgacacttctgctgcagaggtgacgtttgtcccctctcactccagcaggaggctgaacgagaagttgggaacacagggctctagtcctaattccatcagacttgtttcaggaccccagtaagtccatgaacgtctccaaacccgtaagggtgagaagaattccacctgggccatcttccataaatgattccagctagaaaggccaggtgcaagggctctgaaaagagtggcagggccctatgacctaagggttactgctcagacaaccagtctccacccttgctcagactgaggctcacgtttttgatgtcactggtctcaagctgctggcttctctgagaacataaagaaaaatgaagtgacagttcccttttaatcctggtggctcagaagagcctgcagggtacccaacggaaagcctaggacatgttattcctgggccatgtgaggtcagctctgttcctaggagcct

SEQ ID NO: 165668 - DNA, 145 bp, Homo sapiens
tatctgtttgttgccatctttgcccagaggtgatttaattttcttctgcctgtcagttagaataggacagtaccttacttgtgcaataggaacatttgcatattgacttttttttttttttttttttgagaaggagtctcactct

SEQ ID NO: 165669 - DNA, 313 bp, Homo sapiens
ggcagctccggctcatcaaacctcactgcagcctggtctggcaggaccatcccataggatcacctacctggcccaccactgtgaccttacctggagctgtaaggccagcaaagagggcacaggaccttctactttcttgagaggtactcacccctgtaaattaataaatgacgtggcatctggtctatcagccatctctcattggctcagttagccaagttggaccgcctgagcccagtgacctgggagggcctcaaagagggatttctgggcccctcctaagctgagggtcatcccttggaatggaacgtgg

SEQ ID NO: 165670 - DNA, 227 bp, Homo sapiens
gttctggattctcctctatcagtaccttttgttttattctggtctcttctgcttttcctgtcttccattaagaacttcctctctctctatctgcgtctcatgcttagaatactctcctctatttttcctctctctctatccaaattctactcacccttcaagcaaggttcagaagcctcatcctctcccaaagcacgtttcccaatgactccacctcccactgatct

SEQ ID NO: 165671 - DNA, 526 bp, Homo sapiens
agcattctccaagtcaatgtacagaaagctctctgtgactccagaactgttggccatggcaaaaataaaaccatcccatcatatgaactaagcttaatagttactaatcattactaaatgaaaagtcagatgatactgcttaaaagaacactatacctaaaggaaaattaacaactgtaggcctaaccagttagggctccgtaacccagtgaaatggcctgtgctgctaaaaggtggatggcaatgacatcgcccagcataggaggacaagaaggaagcttgttgccagggaaaaagcaatacaagcagggaagcttttccgctcccagcagatatctgaagctttagattgttttttcttgctggcctgacaggcctcaagtcagatgagaaagttaaaggctgaagtggttatgtttaggtttggtcatgcattaatcaactccaaattcctcttgaggtataaaagactattttttccctctttaacaagacattcactctcacttctatccctgtctgccaa

SEQ ID NO: 165672 - DNA, 577 bp, Homo sapiens
cggtatgaaggatcaagaagctggagtgggctgagaaggtaaaagtgccttggacattaaaaaagccttttaaggtatgattagaacaagaacaagaatcaggaagtgatcggcccactcatgggctcttgctgcaatattaacagaaagcagaactactcagcttcctccttttcctcaaagaaaatgccccagagatggcagaagggagcccagctgtgttcaagaggggattaaaaccacaggctgaggagctctcccagggcctgccacaggcgaggttcaggaaatctctggccggacacatggatgaaagaacttgcatttctgctcaaagaactgtatttggtggcttttaagaaattgtgaagaatatgaaaagtattggaacactggaagcaggcagatgttctcattttcaaaaaagcagggaaatggattctgaataggaacaaaggcctgcttcattcccttgataagtttctagactcagtaattaaggaaaagggaagtgaaggcattcactaataggcagcctggttcatctatttttaaaaaaataaaatctcacacagaa

SEQ ID NO: 165673 - DNA, 496 bp, Homo sapiens
tcatcagagcagaaggagacgtcaccctgacctggagaaacctgacctgatctgtttactccaacctacacgtatcctttggggctaaactggaatcaattaactccctaagatatagagaagaataagccatcctccttgagaacatttacccaagagacatttccaggatgcccagatgtcctcttcagttcattcccaaagtaactgctcccaaggaaggttaccaaccataccacccgcagctaattttatggttgataaacatgtttcaaccttgagctcctagataatgtgtttctatgggtcaactgggcagcctcgggagtgctgacctttgaaatgtgggcatcacaatctgatacgtgagatggtttagtgcctctggcgtccacatagctccgtaagtcctgcttctcacaaagccgcctcccctgctaaccctgactgttcccaaatataaatgagaaaattaaacatttacctcaatgagaaa

SEQ ID NO: 165674 - DNA, 459 bp, Homo sapiens
  misc_feature (9)..(9): n is a, c, g, or t
  misc_feature (99)..(99): n is a, c, g, or t
  misc_feature (110)..(110): n is a, c, g, or t
  misc_feature (114)..(114): n is a, c, g, or t
  misc_feature (117)..(117): n is a, c, g, or t
  misc_feature (120)..(120): n is a, c, g, or t
  misc_feature (131)..(131): n is a, c, g, or t
  misc_feature (144)..(144): n is a, c, g, or t
  misc_feature (176)..(176): n is a, c, g, or t
  misc_feature (180)..(180): n is a, c, g, or t
caaagaaantcctcatattaaaataacatttccatatgcactttctagaagagtgtagcatccatctaccatccatcccaggaatgtttgtatcttgcncatagtattancaanaanttntgatgggtganaaaaatgcacttntctatttattggaaaagtgtagagttattganttanattctcaagtgggactccagcatcaatcagactcctctgcatcccgtctcaccggcgagactgttggtgtgatgagctgcaagcatccaggtttgtttgcttcctgccacacgtggcaattcttaaaactagtttttggtgttaggataagcacacccgacaaacacctgctgaagtgtaagcttgctcatcagggagaatactctgattgatgtggactttctaggatagcagagcccaagtggctttgtgcaattgatagtagtcatgtgtatgtta

SEQ ID NO: 165675 - DNA, 731 bp, Homo sapiens
ggtactaattatatttcaaacagtctatactctaaaccacagtaagcagaataaggcagatttctgcttacattaagcagaatgaggtaaaatttcttacctctggctggaattttataataccgattacttcaggttgatcaggagctttcagtaagcttttgattaatatgcacctgccttcgtctttgcactcagggtttattctctcatccctcactctcttcctgaaaatgcccgcttagctatttttattttttaaattaggcagcctcctgcaccggaataggctcagagagattcccacttggctctgttcttctggttcccgctcaaaagagaccttccctatccccccacatctggaatagaacactcccccaccccactctgccttactattgacccctgtcaccctgcttgattctcctccagagcattgaccatccagctggaaggtcagctccatgagagcaaagacttggctttcaagttccctgctgtatcccgtgtctaaaccagggtctggcacataggtgttgaatagacagttgaatgtatgtgtttgtttaataaaagaaaaaaaatgggccgggcgtggtagctcccagcactttgggagaccgaggcaggcggatcacgaggtcaggagatcgagaccatcctggctaacatggtgaaaccctgtctctattgcaaatacaaaaaattagctggccgtggtggtgggc

SEQ ID NO: 165676 - DNA, 612 bp, Homo sapiens
agtatgatatcctgttgggcattctggacaacttagacccactagtgttcttcaaatgtccttccccagggtctgccagcctggagcagctcccagaggtctactcagaaggacccaattcctaaccagcctccctttctctgtcagtggggacattatcagccaagcttgaagctattaatgaactaattaattttgactacatatatgccaagcccgtagtctgagacagagagccaagctaatgcggtagtgaaaatcaaggaagcacctctcagccttttagagaatgatcacccagaattcgtggtctcagtgaaggaagactttgtggaagatgacttcattccagacctgggtatctccaatctacttccatccagccactgcccgaagccatcttcctgtctactggatgtttacagtgactgtgggtatgagggctcccctttccccttcagcgacatggcctctccacttggtgcaaaccattctaaggaggagactggccaatgaactctttcaccagctggttagtgtctaaggagtgatccaatactgttgctcttttccttgactattacactgcctggaggatagcagagaagcctg

SEQ ID NO: 165677 - DNA, 518 bp, Homo sapiens
gaatttgataacacccataagtgccttttcgaggtcttcaattggttacaccctatgaaggattggcccgtggccagaggctgaactggagacttctgtgttgtcatcacaggagtgaggatgtggcctgtgtgctgcttaacctggcctagaacttgctgcacctgctgttcttttgcttccaccttaacccttggttatgctaattttctattctcctgcctcagaagtgcctctctaggaagccaagcaggctcttacctgcttcaggtgagcaggtaaccaggagggagaggaccacagttgctatcatggctatgattcgggtttggaaacctgtgcagagcctttggctccacttggtatgggatagccaagagaacagttaatgtggttttcgaatcatgatatgtctttgaatatttgtgtaaccttatgtattaccatcagtttttatttgttaggtgcagttgttcttgctcatattattattattattattttgagacagagtctca

SEQ ID NO: 165678 - DNA, 170 bp, Homo sapiens
gctttacactctagatgagcatccattgattattcttacccacaccaatggtacagttatgatagttggaaaatgctgcttttttccaactccactactccctccatttcatggtattctaatgaatgatcattgtcacaaaattcaacacctaattgtatctgttatga

SEQ ID NO: 165679 - DNA, 269 bp, Homo sapiens
ctagagaggcccttcccccactggtaccagtggatactcttggctggcagtgacgagatttgcccgggaaggaaaaggaatatcagagctacatctctgaggctctgatactaccaaatgaaagttactaccaaatgaggtctggcactcagagccctgcttgggttgacatcacagagccatttattcacagaagctttccagccctgcctgtcctaactgggagggaaaatggggagaaggtagtcagtgataattagagaaaagag

SEQ ID NO: 165680 - DNA, 357 bp, Homo sapiens
cttctctttactgtagaaaacggcttaacataatcttttataagaatgtaattaatacttatgtatctccaaactatatattatgaccaattaaactagtaactacgtgcatgagagtgtgtgtgtgtgtgtgcgcatgtgtgtagacttataaaagattaattgatctgagagaggagggagaagtaaaacaacacttatctctagaattgtcctttaatggttttagaacaatatttgaaatgtttttaaggatgaaggaaatatgactgaaacttacatctgtttccagtttctaatgctaaaataaactaagttgttttagacatattttatagaatttaaactcacttccct

SEQ ID NO: 165681 - DNA, 343 bp, Homo sapiens
ttttatttttctttcctcaagcattgtgtccatcctcactcttgccctaagctcctgctccaaatgaacttctcacaattctcaggaagctccctgttctcttccctctggggcctatcatgatggcccctcttctggaacactactgtactcttcttcctcttcctgaataacttcaactcatcaagtctcagcttatttatcattttctctaaaaatctttcttgacactccagaactaagttaggaggggctcctccataacgtcctgtgttcacactttttttttctttctgtttttgttttttttttaagggaccccggaattaggggggtcccggag

SEQ ID NO: 165682 - DNA, 348 bp, Homo sapiens
accataagataaaatacataaaaattgaactactaaaaattcctgtacaaaaaaggcaccattcatggctgggtgtggtggctcacgcctgtaatcccagctttttgggaggccgaggtgggaagatcacaaggtcaagagatgcagaccatcctggccaatatggtaacaccccatctctactgaaaatacaaaaaaattagccagatgtggtgggcacgtgcctgtagtcccagctactcaggaggctgaggcaggagaatcgcttcaatcagggaggtagaggttgcagtgagctgagatcgtgccactgcactccagtctggtgacagagcaagactccatctc

SEQ ID NO: 165683 - DNA, 493 bp, Homo sapiens
ggtatggttagattataggggtgctccttagtagtttggtgtgtcatgatgagaaatgagacctgaaaagcgtaggactatagaatggaatagcagaatagtattcataagtttgtatattatccttgagatgatggagggactattgcaagtattgagtgagataaaatgacaagttttagaaaataaggattttggaaaaactcaccaagtaatgttattgaaaggttgcttgaaatgaaaagatatgtctgtgtgaaaggagatcagtttggacaactcatatagaaagtgatgtgaggccgacactgggaaattagaagtagcagggatgtatgaatgttatagatgctgtggaatatattttgaagaactttgcagccagttaaacagtaaagtaggagaataacaggagagtttaaggccaagcgtatttagttcatgaggtagaaagatgagaaagaataggtttgaaggtgtctgtaccattgtt

SEQ ID NO: 165684 - DNA, 367 bp, Homo sapiens
tccaaaccataacacaagagctatttgacaaattgtaatcccaccaaaatgaaagagattcaactttgatttagaatctacaatagcaaaattttcaccatttagtaaacagccatggtgaacacatgatgcagtatcaagtctaaccactgagccctgtcaaacacaggagagcttcctaagtgtcctccttaaagtacatgttgcacctgtacaggtgagagccattttttggacaagataatagaggaatccatgttaatgtaactcactgctgagttggcaatgagctcgctcattggcagccaaatgaaaaagcccatatgggaagaaattaataaagctggcatgttttctgttcctatca

SEQ ID NO: 165685 - DNA, 298 bp, Homo sapiens
actgggttccagagtagactcataatcatgcttctgatttgtgtctgttaaaagaaggatcagaaacagactggcaaggtcttacagttcttggtaaaactcttggaaaagactttcttttttgatttgcttgtgtattttagtggtgtcttcaggctatttagagaaaagtagtatgtctattgattcggccattggcagggacttaaatgatggtacgtgttggctgtgtagtacctctgcttcttctagttggattaaatccgaggacaggtaaattcttttggcatttggcttg

SEQ ID NO: 165686 - DNA, 547 bp, Homo sapiens
tgcctctggataatttcactgtacatttagaatgaaagagcaagtaagtgtctttagtatttattatgaaaataatttttttttttaaacagagtctcactgtgttgccgaggctggagtgcaatggcacgatcttggctcactgcactctccacctcctgagtttaagtgattctcttgcctcagcctcccaagtagttgggattacaggcacctgccatcacgcctggctaatttttgcatttttagtagggatgggctttcaccaggttgaccaggctggtctcaaactcctggcctcaagtgatctgcccgcctcggtctcccaaagtgctggaattacatgtatgagccaccacgactggccttattgtgaaaataattttgaccccatggatctcctgaaagggtctccgggaccacttggtgtccctgaattgcacctggagaacccctgctacagcttaataaaatctctaccaattaaatgtgatagccattttgtttcagtttgaattgttttcatgtttggctatttatacttctt

SEQ ID NO: 165687 - DNA, 424 bp, Homo sapiens
aaggggttgtcctggggaccctttgttcagagtagaaaggagagtggtgttagtggaacaaaaccagagggcgatgagcaccaggacccaagattgagggaaacgatgcgccgatgcgccgcggagtagaggagccaccacgggtagcaaagtgaacttcccccgaatcacggttaagccccctgggccacatggagctgtcatctgcagtttttcccacctcggaggcctgaccctgtgctctccataatcaatgagtagatttggccctttatgttccctgaggcttccctgactgctcattaaaaggatctgctcagtcctagtgaattgatttactttgccacagtccttgaaggatgctacagatcaaaaggtgtccaggaaagtgatcttaaagatgctgacactactcccagttact

SEQ ID NO: 165688 - DNA, 412 bp, Homo sapiens
cattatgttaagtgaaataagccaagcacagaaaaacaaatattgcatgatctcacttatatgtggaaggtaaaaaaagatgaactcatagaaacaaagggtaaaatggcagttaccagaagtgaaaggaatggggagatgttggtcaatagacacaaaatttcagttatacgggaggaataatttcaagagatctagtgtacagcatggtgactatggttaatatcaacatattgtatacttaaaaattgcttagagtagattttaattgttcctttccacaagtagttatgtgaggtaaggcacatgttaaatagtgtggtttagccattccataagttatacctcattccataaggtatacatctatcatctatatgtcgcataccataaatatattcaattattactt

SEQ ID NO: 165689 - DNA, 317 bp, Homo sapiens
gtcatatcacagacccagaggatctcattctgagtgtgcactgggtgaattttcacgctgagcacacttgtgtaaccagcacccagataaaggagcagaatattgccagccccagggtcccccaccgtgcccctgtggtcatgactccccaaaggggaaccactgctgcgacttctaaacaactaggttcactgttgtacttgatagaaatcagatcatacagtatgaaaccttttgtgcctggctctcggctcaacatgacacttgtgaagttttccacgctgttttccaccgtggtggcgagtagtcttgcataa

SEQ ID NO: 165690 - DNA, 222 bp, Homo sapiens
ctcaacctcagcactattgaaattttgggctgcataattcttcactaggggaaagtgaggctgtcctgtgcagtacaggatgttcagcagcatccctggcctctatccctggatgccagcagcaaccccagcaaagaaccactgccttaggacatgctattgtactgcttgaggagtcagctagagatcagaggtggggtgatgatagttaggatacggtcg

SEQ ID NO: 165691 - DNA, 367 bp, Homo sapiens
acttttagtatattataacacaacccgggggctaagcagggggctaaagagtactgatgcatttcaaacaagattggcactggtattgaaaatagttgagactgggtaatagtacacaggggtttattatataaaagtagaaacattataaagaaaattatgtgcctattagagtacacacttaacattaaaaaatatgtctcatataccagaggattctgtcttatctaaatttaacacttaaatgtaacatgcaggaaacctgccatgggacaatcaaaagggtcactacataattggagaagaaaaatagcatttttgaggtaaagaaaaaacagtttatacaggtatcaaaaatgaacatttg

SEQ ID NO: 165692 - DNA, 278 bp, Homo sapiens
ctacagacatgggtagctaaagttcagtgcaggcagggaagaaggtgggggcagaagctgtgagtggcaggcattgttctcaaggctttgtatgcattcacttacagtacaaccaccatgggagtaaagtattattaacacgcagaggacaatgtggagaggcagaggaaggctgggctgggttctaaagggtttgaaatacaagggctaggcaagacacgttctctatttcctgtgggtcctgcacttggccaaaggacttcccaggcttaggccag

SEQ ID NO: 165693 - DNA, 234 bp, Homo sapiens
tgtgggctgagcaactaatgatataaattgatatagaaaaggtttatagtaagggaaagaggggtgagaaagaacagactgggagtaaatattagttggatatagattcacttgctggaataaagagatccagtggtttaaaccagattaaaagttctctttcatgtaacaacaatataagcagtctagagctaaaatgtatgcttcaggtattcagaacctacactctttcta

SEQ ID NO: 165694 - DNA, 534 bp, Homo sapiens
gtttcaggaagatagatacaacaggacagatttccataaaatggaaaacttacaaaccaatactttatattacttaggaatgaatactgtaggaaaatctaaaaaacaggcttgagattaatacacagtaaatttaaggttgtggcatctctgaggagtagggaaagggaatgagatcaaggaggccttcatctgtgtctgtaatgttttatgtgtttttttctaaaggcttgaaacaaatatggcaaaatattaagatctgataaagccatgtgggcgtatgacatttgttatatttctctctatccttattcatgtgtttaaataattctctgaaagcagtttactgagagttcagcatgtctcctgagacatgctaggaagttatgtgcaggagtggagaatatgattcattggaagagttaagtgccctaaatgccagccaggctgtgaccccaggacagaagtagggtgggggggccttcttgcttgctagtgacaatctacaccaaccagcaccacaggagccccagg

SEQ ID NO: 165695 - DNA, 178 bp, Homo sapiens
aggatactacagcacgacccagtaggatggaattcaagtgactgtaattcactgtagtaatagaaaatgattcaccacgtgatcatctcaagagctgccaaaaaggaaactgccaaaatccaacatccattcttgatagaaacacaccaatcctggagcagatggacactgcctgcct

SEQ ID NO: 165696 - DNA, 233 bp, Homo sapiens
aaattgataatcatatgcatgcaagaggtaagggagaagaaatagcccagccttactctcaagcttttaacttctgttataatttgactattagcttcagctatattatttaattctgaaacaataattctttcttttaagtaaattatgctttgccttacagaaagtggcaaggttagcattcaagaatttatgactaaattatccgatatattgacaattcctaaagctgc

SEQ ID NO: 165697 - DNA, 332 bp, Homo sapiens
atcatgaagcccctgcccaggcccctgatcctgttcaaccctgtctcaaagccacgctcttcctgatgtccctttcctagcttggcctctttaattattttcttcctgtcccaatcagttatgactgtgtggcttcatctttcaaccccgctcctgggtctacctgtgccttgcctcccacacctgcctttcttctcgatgagatagtgtaagtgaaatggctagaagtatgcattttgcaaggaaggggaatggccatttgatagtcacactacattgtgcaccaaggcattttagagcttttgtttgtgtaaaactttatgtgaacaaat

SEQ ID NO: 165698 - DNA, 710 bp, Homo sapiens
tctccttcctcctgcttcacattcttcctctaccagtggttaagagcaagggctctggagacagactgactggctttgaatctgggcttcatgatctactggttatgttaccttggggttgttactgaactttttgtgcctcagttttattatctgtaaagtggagataataacagtatccacctagcatagttatgaggaccaaatgagttaataattttaaaagcacctacaataatgggtggcttatagtaagcaatatgtacatatttacttaataaaataaacacttatatttgtcatccagcccttccttatgtgctaatgttcaaggccagaaggagaacagcaacagaacacatgagaataaaagaagaggcaaaatggcctggggttgtatcacagcaatggtgtgacagttctcgggaactaggaaaagagtcaatgaaaggaactggaggaaaggtggggatcaggaagggagacaaataagaagaaaattacatttcaaaataatctgcaaagattaaaatatatataatattagcttttagtattttatttcaaatataaaccccaggaaaataaagggatattttttataaatgcatagaaagttcccattttgatgttagcagttaattcaattttggtcttcatccaaggcagaaatgtggtagccacatatttaaggtacttaggctaaatca

SEQ ID NO: 165699 - DNA, 727 bp, Homo sapiens
aattagccatcttaaactaaaataaattgtgtaagtcagatattcagttgatgggttacatgaattagacataattaaatagtgaattgcaagctttgtaaaaaatttacctgaaatattatagagacaaggagacaaatgaatcaacagacttaggaagtaccatgtattccaagctggaaaagtaaaaagaaatccatacctacatacattatagtagaactacaaaatagcaaaggcaaaggtatcttaaagcatccatttcagtcagggtactgtcaggaaaacagaaataacactaggtatttcagaaaagcaaatttgatttagagaattgatgacgttgtagagggctgaaagagaaaaaggaaacaaggaagtaaactaaagataactgtagggaacagctcccacctctaggtgtggaaaagggcagcaagtgattagggttttcagaatttagaagtttacaggagaaactgaggagctggagctcttgcttccacagagagggacagccttgtggcagaagggtgcagtgagcctgggtctgggagtgcttaaagaacctggagactagagtgctgttgctggaataacactgacaggagcagcatgcaaataggaagaaagaagtcccttctccctcttgccttccaatcttctagtgcacatgtttgctgaacctaacaagaagcctgttaacaaaggagaaatgtggtttgca

SEQ ID NO: 165700 - DNA, 367 bp, Homo sapiens
ctcccccccccccacctcgcgtacccacaagggcacatccttgtcacctttgcccccagccccccagactttcagccacagcttctttctcaactgaagacctggggaaggggtgctgtctgtgttctttcttccacttctgccctctcctagccttgagggtagatggtgtggttcttcagtattggatagtgcctgctctgcggacaaaggagaagtttaaattgtccgtagagaaggggatatgattggggcctttgggaaatggtaccaggtgagaagggggagcatggaggaaagatgtaatgggtactccttcttttcaaagtcttatcctttaaaggaaaggcggtctctggagaaactg

SEQ ID NO: 165701 - DNA, 324 bp, Homo sapiens
tgagaccagcccgggcaacatggcaacaccccatccctacaaaagatacaaaaaaaaattagccaggcatgatggtacacacctatagtcccagctactcagaaatagaaagctgaggtgggacaatcatttgagcctaggaggtcgaggctgcagtgagccgtgatcatgccactgcactccagcctcgcgacagagcaagaccctatctcaaaaacaaacaaacaaaacaaaacccaaccaaggtaagtatatggcaatatttgtccacaaagagcttaataggaaatttgatattataactgagtactaaggggagcagtc

SEQ ID NO: 165702 - DNA, 373 bp, Homo sapiens
gtgacaatatgatatgggacaaaatacagcacttaaagagaggtgttgctcaggccagccactataatccacccatcagccagaacattttatttcttctaaatggcacttgagcaacattggtttctttgaaaagaatgaacttgagaatgcaactcccaggaccagaaaagaatgaaactgggccagtgcttgcatggtcctgctgctgctcactgcactttgcttcaaattcttacatttgctctcatttctacatggcaggtacttggttctctctctctttctccctctttctctgtgtgtgtttataatttttttttttttttaacagagaattaaaactaaactaaaaattttttttttccttttt

SEQ ID NO: 165703 - DNA, 270 bp, Homo sapiens
aagatattaaaagttctttgcatcggcttttgtgcccctataacctcatacctaaaatgtgcctaggtaaaactaagacactttttactattcttttaaacaaatctattttgcttccttctgaaaacacctacttgattccttctatatgccatataactcatgagtggcagaaaggttaacatgctataaaggggtgtacaaagtagttatcacctcatgttgaaaataattattgtaaattagtatattcttcctgctttgattatt

SEQ ID NO: 165704 - DNA, 567 bp, Homo sapiens
gagctggttaacccttaagccatctgtggatggcaaggctaaaagagtgcactgtaacacatgcacacttgggctttgaaagttacagacacccacccctagatgctgccatagggctggagcccaaaagcacttgccccagttcctgcacctaccggtatgcatgctccccatctcttaaagagtttgagcttgcagtggcagaacagagagccacacccctgtggcacaccctgtggtgggggaccaggaccagggaactctctcttttcactatcatgagaacaggctgggggaaccgcccccagcattcatttatctccacctggtcactcgtatgacatgtagggattgtgggaactacaattcaagatgagatttgggtggggacacagtcaaattatatcagtaacagagggagatcattctaggttgaagaagcagccaatacaaaggccagagcctttgtatttgtgggattgttttggaggaacagcaagaaagccagggtaatgaagcggagtgagaggagggtggcaggaagagagttctgacacaacatttcca

SEQ ID NO: 165705 - DNA, 472 bp, Homo sapiens
tttcagtatgtagttagtttattgtagtaaagaagctctcaacataatgaaattttgttcttaattttgtcaatcttttgaagcttgaaatacttttttttctgttgaaacgctgtacatttccttattttcttcgtcagaagagttcatgacatttaatttaatacctttgctcttttaaaacaacactgagttagccatgcagtgggccacagacactgcaaaacagtgtttcttagagaaaagcgtggttctagtgcctgtttagaatgccactatcacaattccctctgtttcaggaaaactgggatctttgctttaacttccctccgcagtctttgtgtagcagacttttgctgtgacttcagccctgagtttaggcaacataggagagggttaaatgcattggttttggaatacagcagattcaagttgaaatattccctcctccacttactagccacataacctg

SEQ ID NO: 165706 - DNA, 386 bp, Homo sapiens
agccttccccagtggcacttcaaactcaaaaacgtttacaaaactaatcacattttccaaacctgcttccaccactacccgacctgttgctcctccttcctgtatttcctatacctcggagattagcctcacattgaatctacctcccaagagtcatgttgcttttaaaatccttcactaactccttgctccctacagaagaaaatccaaactatgtatcatggcattcaagaccctttgtggtaagttctctatctcttcagtcatactactttttctgtgctacataataccaagttttctagccattctaaaatattcaaaggtccctggaatacaaaatcttccttatacctggaaagttatccctaccctactccatctgt

SEQ ID NO: 165707 - DNA, 359 bp, Homo sapiens
aggctggttaggatgtgctcgacagctacctggctggctggagacatgcttcccacaggctaaccaagtgcatacagtgaaggtggatggtggtgtctgttcatctcggaagagcccaggatcaaactatcactccctagtcaccctgtggtctctgccatgtttccacagatctctaaagttgcttaaccctgatttatgcagtgctgaacatctctttcagcgttagaactgaatattaccacctctgatgatttctcaaggaagcagtagatatgacagtaactgtcattgagatggtgaggcaaaggtgggggtgaggagtgtgggaagaaaattccatggtcctcactggctgg

SEQ ID NO: 165708 - DNA, 380 bp, Homo sapiens
gtgcaggtttacctgaggaaaccagatagtcagtgaatcacgctaacgataaatctaattgcatttcaaatttcacgaagcctgatttttttggagagtggagtaaaaccatcatgaaaccaagccaatatcttagtttttataaacacatagttttataagcttattgtaagaattcaagtgaagagatggggaggggtgctaaatgtctgctttccttgtcactgggcctccttaccatttggactccaaatagcttgatttttcttctcgtgggagtacatttttgagtcgctttggttcttccctccagggatatggggcaatggagtggacattttttcagagcctgcagaggagtaataaaccaaaatttaagt

SEQ ID NO: 165709 - DNA, 658 bp, Homo sapiens
acaataaaaaaaccagcacaataaaacagtaagcaaaagatctaaacagagaagatatacagatgacaaataagcatatgaaaagatgctcaggctgggggcggtggttcacgcctataatacgagcactttgggcatgtaaggtagaaggatcacttgagttcaagaccagcccgggtaacatagtgagacaccatctctatttcaaaaaaagaaaaaagaaaagatgctgaacattgtacatcattagggagttgcaagttaaaactatgagataccactacacaacggtcaaaattgaaaatacaacaccaaatgctggcaaggaggtaaagcaacaagaactctcattcactgctggtcagaatacaaaatagtacagctactttggaaaacagcttggcagcttcttacaaaactaaacactcttaccataaaatgtgctgactcaatgaattgaaaactcatgtccacacaaaaacctacacataaatattcagagcggctttatacataattgccaaaacctggaagcaatcaagatgtccttcaataggtaaatgaataaatgaactatgaaacacccatacaatgcaatattcaacaatacaaagaaatgagatatgtagccacaaagagacatggaggaaccataaat

SEQ ID NO: 165710 - DNA, 397 bp, Homo sapiens
cagccttgtaatataatttgaagtcagacaatatgttgccttcagctttgttctttttggtgaggttttttgatgattcaggctcttttttgattccatatgaattttggtattgttttttctgactctgaaaaacaacattcataatttgataggggttgcattgagtcggtggattgctttgggcagtatggtcattttaacaatattgattcttctaatccatgagcatgggatgctttatttgtttgagtcttgtacaatttctttaatcagtgttttgtagtcctccttatagagatctttcatttccttggtaaagcatatttctaggttttgtttagttttgttgttgttgctgttgtagctattgtaaatggaattgctttcttgattt

SEQ ID NO: 165711 - DNA, 142 bp, Homo sapiens
agagcatgggctttgaagtcaccgacatgggtttgattctggctctgtcactggttcctcactgtgtgaggttgggctagtcacaatcacaatctttgagcctcagttccctcacctatataatgagggtaataatgcttac

SEQ ID NO: 165712 - DNA, 182 bp, Homo sapiens
tgggaggtggacgagggacagtggcaggaagaggaggccacagagaggcaggaaataagccctcagggacctgggggaggcagtgctgtgcttcaggtgacaaagctatgtccatttgactaacatcactatatgactcgaaggggcgagcctgggcctgggagacccgtcaggaagtggtt

SEQ ID NO: 165713 - DNA, 312 bp, Homo sapiens
cagagtaatagtgtgttatctctgccagaagccagaggagaaatttttactcagagaaagagccattttcctatggctaccttaagacataaaagtatagtaacatccatctcgtaactgatcatgttgtctgtctgtactgtagcatcccatggctcaccttttatgaactaactgaatccctgggcctactctactttgtagtcttgttccctctgctatttgtgtcatataaattaattagctctttagctttttacttttatcatgtaacactgaactaagttacttagccatcttaagtcattttct

SEQ ID NO: 165714 - DNA, 140 bp, Homo sapiens
actcaaggtcatggtgccccatagtaccaccatctaaagatcactagactgagactttggctagtgatgcttgacccaggatagtctgttgtccctctttatttgaactgtttatgtttggcaggtgagcgggtaggtag

SEQ ID NO: 165715 - DNA, 566 bp, Homo sapiens
atgtgccaccacgcctggctaatttttgtatttttagtagaaacggggtttcaccatgttggccaggcttgtctcaaactcctggcctcaagtgatctgcacatttcagcctcccaaagtgttgggattacaggcatgagccactgcgcccagtctgtttttggcttttttgagacaggttctcattctgtcacccaggctagagtgtagaggtgtgatcatggctcactgcagcctcagcctcctgggctcttgtgatcctcctgccttagcctcccaaagtgttgggattacgggcatgagccactgcacccagccaaatctgcttctcttgagctttgcccatgtgtcaggcatgtaggactttatagtccttatctctcatcataaactctgggtacaggctgttgctactcccattttacagatgtacaggaacattctcagactctttaagctaggaagaggcaaagtctgaggctagacctgctaacttggggccagatggcctcattcatgcttcaccccagctcctcggacaggacctggcccacagtggggaacag

SEQ ID NO: 165716 - DNA, 412 bp, Homo sapiens
cagtccaggattataatttaggaagatatagacaatcatggtgtccttgaaagccttagagaattactgtgtagttagttttcctggattatattaggagttaggtatttgacttttccttgaggaactgactgtaagaaagactatgaggctgggcgcctaacgctttgggaggccgtggcaggtggactgcttgagctcaggcatttgagaccagcctgggcaacgtggtgaaaccccatctcaataagaaatgcaaaaattagctgggcatggtggctcgcgtctgtagtcccagctacctgggaggctgaggcgcgaggatctcttgatcccaagaggtagagattgcagtgagccaagatcgagccactgcactgcagcatgggcaacagagtgaggccctgtctca

SEQ ID NO: 165717 - DNA, 455 bp, Homo sapiens
actgtaataggtgcatattttggtgtgatgattctactgtctgagtctcccttgagtgcttcccctcccctccatgctcgggccaccattaggacaagccatgactgtcacctggatcacaggggcctcctcccactccatctccttgcctcttgttccttagcaatccattctgcagagtaattggcctaaaacaagtttggttcatattgctgttctttgtaaatcctttcattggcttcttactgctctacagatggggcacgcatttcttaatccatcattcaaaactcattatgatctgggcccattttacctctcctgcccttcaatagccactcctcattttttttttctggcaaacatatttcttcggttccatagtcctgcttacctatggacggtaccttcggtctggaatagcttctttatcctgccacaacctcacgtccctt

SEQ ID NO: 165718 - DNA, 394 bp, Homo sapiens
ccaaatgggttaatacatgataaatgcttagtttagtgtaagttcaataaatatcaaaatagtggtatgttaaagatagtgtttacatgataacctaaaattaattgccagtttgttttaatttactggtcaagtctatcaaatgattgaatcagcatgtttaagtggatatatctcatttatgtccagatcattttagtatattcatgactcctcactttaaaattcaaatgataataggtacagttagtcctccatatctgtggattcaaccaagtaaaaataaaaaattgcatcacaacaaggcatggtggctcacatctgtaggtctcggcctcccaaagtgctgggattacaagcgtgagccaccgtgcccggccaagactgtctcaaa

SEQ ID NO: 165719 - DNA, 629 bp, Homo sapiens
ggcttttctttttagtgtcattgattactgttagtattctaacagttaatatctgtaggactctttctttccaaagacttggaaaactgtttttcctctctgctatgaattttgtaattattttattgattgcagaatatctttttgaggcaatgattgaaattgcaaagtttttttcatcagttccagattactttctttctgtttattcatagttccttgtttcattttcgatgtttatttgttgactatttgctttatatcagatgactttataggtattttaaggggatttaagaaagatatcactagttacctattcgtctataaattccttgcttaggccaagtgtggtggctcacgcctgtaatcccagcactttgggaggccgaggcaggtggatcacaaggtcaggagattgagaccatcctggctaacacggtgaaaccctgttattaaaaaatacaaaaaaagaattagctgggcgtggtggcaggcacctgtagtcccagctactggggaggctgaggcaggagaatggcatgaaccccgggaggtggagcttgcagtgagctgagatcgtgccactgcactccagcctgggccacagagtgagactccgtttcaaa

SEQ ID NO: 165720 - DNA, 217 bp, Homo sapiens
ccctcgcaatagctgctgttctgtctcttggcccttgctctgcagagcttggtggggagcccctcattaccacctccagacagtactctttcctaccacctcccaaaagctgaatcttctgtcatgagattgcatcattcatgagccttcattgttgccatcatgtaccaatccctagttcactcccctgtttcttaatgattttagccccagctca

SEQ ID NO: 165721 - DNA, 113 bp, Homo sapiens
aaataggaattactaaaattattgagccttattggttaagtcaggtaccaatgtgcaggcttttgtaagtgaatgctagtgaatcttttgtaagtgaatcttagaatcaatta

SEQ ID NO: 165722 - DNA, 454 bp, Homo sapiens
acttccctatcttcattctgaacgtgcattctacttcactgagaaaacagaagcattcagaaaaaaacacttccacaagttcctgcactatctaagaacctgtcatcataagcatctatgtactctgcctttcctccagtctcataaaagtacacatatatatagggccaatccctcttcaaggaaagaacattgccaatttctctttctcctaggtcattcccagtagcattattaaaaaaaaaaaaaaaagggcaggggggtcataaactcttccatcttatagaaaactctgccaactcctcatcggcattccccttctacttcttctgccccctctgtagaactcttaaaagaaatgtctaaactcaatgcctctcctcccaatctctctgaaacccatctgaaataggctttcacctccaccactcccaagaagctacttttgacaaga

SEQ ID NO: 165723 - DNA, 229 bp, Homo sapiens
tgggatgggacctggcccagggtccccaccctctccttttctgttttgttcagggctagttaggtttcctcttccacacctctcttgcctccagaccttggcatatgctgttccttctacctgggacacccttcccactccccaacctccctgccccagcccagcgcaatttctcccatccttctcatcttagacatcacctcttcctggaagccttgcgacatccccc

SEQ ID NO: 165724 - DNA, 522 bp, Homo sapiens
ttttatacctcagatcacaaagacaacagatacccttaataataaaaagacattcaaatataacaataaaaacatacttaagatagctcagtgactagcatttggccttgtgaacataagaacacttagtaaataagtgaaatacttaacattttctttgtatgtcaaagacgagtgagagtcaaataacttttttcccaaaaattcaaattggtctttctgcttataaaactgcttcttgagggcatggcggcaagtgcctgtagtcccagcactttgggaggcccaggcaggtggatcatctgaggtcaggagttcgagaccagcctggccaacatggcaaaaccctgtctctattaaaaatacaaaaaaattagccaggcgtggtggtgggcgcctgtaatcccagctacttgggaggctgaggcaggagaagtgcttgaactcgggaggcagaggttgcagtgagccaaggttgtgccattgtactccagcctgggagacagagcaagactctgtctc

SEQ ID NO: 165725 - DNA, 472 bp, Homo sapiens
cagctccctttagtctcgtcctttcttccctgtgttcaatggctggctgtgcttcaggagtcaaagaaaccaagttcagctgagcactggggcgcagcagccagagccagggaggtgacagcttccaggcatactaaggtgtaccacggggttgcctgagcagtcaccttgcttgggcccctgtgccaagcacctcagggacagagactctgaaaaatgcacatggctaaaaaggtttaagttgccatcaaatatgacatgataagaagctccctagaagccatgttaatggaatgttggctcccagcctagagaaatgaggtgatgacccttaatcacctcctcacctaccctggctctgggaggtacccttccggggctcacttgcaagacccctatttctattacaaaaatgccagctctgtctatagctggcttcacccaatgccatgatctagggtaagactaaagt

SEQ ID NO: 165726 - DNA, 779 bp, Homo sapiens
gatggggtttcaccatgtcagtcaggctcgtcttgaactcctgtcctcaagtgatccgcccgtcttggcctcccagagtgctgggattacaggcgtgagccaccgcgcttggtccaccctgggtttttattcatcaagcctcgctgcccccttggtacaggggccaagaccacagctgggaagctcctttcctcttgccccaagagccagcctgggttgctgctgagccattgcaggctgaggcacagcctctctttctccttttacgcttcctgatgtcttctttaacataatcatggccacctcagcttctttcagagagcaatatgttcctgagctagagacatgggtgaccagctggagtcaggatttggggggtgtggtgtaggtctagagccaactgtggcactggaacaaggcccctaccttgttcagcctcagtttccctaatcagctagagaggcctacttcctccttggaggttaaatagatgacattcataggtcaacggaaatgctgcatttatggcaataactgaccttgtaggtgtttcaaaattcaggccgtttcagaccagagtgcacacaggatgatgtgggaccccccagcaaggcaggcagctccccgtcagcacatatgctagcacttctgcgaagatttctgcagcaaatatatctgctgctgttgatactaagagggagatctaaggacagccattgcagttccactttgccccacaatgagccaggaaaaaagaaaaggatggctttagagatttt

SEQ ID NO: 165727 - DNA, 449 bp, Homo sapiens
acactagagcatccccccccctccccgggtacatggaacttactaactgcagtgttacagggacaggagttaaacagaggtgaatgttaaggttctcactccgccctccgtgtccttgatccaggtgatgaccttgaccgaggcaatgagagtatagagaagtggccatttccctaaagaatctcatagtctggtgtattagtccattttcatgctgctgataaagacatacccgagactgggtaatttataaataaaaagagatttaatggactcacagttccatgtggctggggaggcctcaaaatcatggcggaaggcgaaagccacgtcctccatggcggccggcgagagagaatgagagccaagcaaaaggggaaaccccttataaaaccatcagatctcatgggacttattcactaccacgagaacagtatgggggaaatcgc

SEQ ID NO: 165728 - DNA, 558 bp, Homo sapiens
ttagggctctcagagtgccatgctggtggacagtgaattattcataattactctgcatttggtatttgagccattgtgaatgtgtatcttttgaaattccgcagaatctctgcttctcttgttttgcttccaacaattatggataatcatgtcttagctaaaagggccccaagttataacatactgtttttctctaatatgcttcttacaaatagccaatccctattagctgtgtggcattgaaattcaatgctattactaattttcctttgacatcaatagtaacgttacctcataatttgatagtcattatagctatgaagggaactaatgcccaagattctcaaaaatgcaagattgatgtgtttctttcttttcccctctgtcataatttacctatataacagagtatttacagtcatcattcattcctttctttaggaatccaaagtggtaattgcccaggaatatacagtgttcttgattggattaataattatcttcagtaattcagaataacacatgagggaatgaatgaatgaataaataaaaaaaaaa

SEQ ID NO: 165729 - DNA, 429 bp, Homo sapiens
ccctacttgccaaggataatctgtcttctagatttttctatgcctacgttcttagttatcaatatccattttttagaactagaactatactatacatatgactgtgctatgtaccagtactttgtgggcagcatttcatgttagcataagggatctatttcattttttttgtaaaaaaatgtacacttatttagttttagtttttgtcagttacacacacatatggttttggctgggtgtagtggctcatgcctgtaacaccagcactttgggagtctgaggtgggcagatcacatgaggtcaggggttcgagatcagctgtccaaaatggagaaaccctgtctctactaaaaatataaaaattagcgggttgtggtggcacacacctgtaatcccagctactcgggaggctgaggcatgagaatcact

SEQ ID NO: 165730 - DNA, 358 bp, Homo sapiens
ccccctccccgggtacaaggggtctggactcttctccctgtcttcccctcctcactcaatagcagctccatccttctggctgctcaaattcagacccctggagtcatcctggactcttcccacaacacccagccctgatgggctgctgagtcctgctggccctgggtaggttgtgaaggcagagccagcaggactattattaagccccttttacaggtgaggaacaaagaggctcagtaacctgtccaagatcacaccacaagctagtgggggaggccaactttgaaccctgatctttggccccagggcctgtgctccacttttccatggtgatctctgccccacagaaggagacctg

SEQ ID NO: 165731 - DNA, 282 bp, Homo sapiens
ggccttgtagaccggtttcgagtgaagccaacaggagaacactgccaggttaagtagtctgaggtacttctttgttcagtttttgaaaggagttttctgttggtttactcttcacgagataaacatgaacgaggaaatactaactgaatcaagggagaaaattggcttcctccagtatactgagcagtttttgagtgcttactggtagttaccaccatacaattactttttcttctaactcccacacctcccttcactcgaaacccggtaccgagctcgatt

SEQ ID NO: 165732 - DNA, 457 bp, Homo sapiens
atacatagtaacactgagacagagtgtaagtgctcatcagttttaaaaatggctaaataaattttgcaaatttttctaccaaaaagacacatgcacttgtatgttcatcacagcactattcacaatagcaaagacatggaatcaacctaggtacctatcaatggtggattgcataaagaaaatgtagtacatatgcaccatggaatgctatgcagccataaaaaagaacaaaatcatgtcctttgcagcaacatgaatgcagctagaggccattattctaagtgaattatctcaggaacagaaaaccaaatactgcatgttctcacttgtaagtggagttaaacaatgggactcatggacataaaggtgtcaacagtagacactagggactactacagtgggaggaaagaaggaaaggattgaaaaactaactattgggtactatgctcagtacctg

SEQ ID NO: 165733 - DNA, 340 bp, Homo sapiens
gtggcagaacagtgagtaaaaatagctggaatcctcaacacaatggagctgccatttgaacccaggaggacttggggctaagtaagagaggagtaactttgtatcctgttttgattcttcataatagcaacccaaacctgtatctcaatcaacaaataatctcagctccaaccacacttcctgtttgccccatatttttcttcaactctggtcctgagacatagcactgaataagaatctccctcccccatctcacttcccagaaccctgtcctcactacatgctggcatgtagtgaggacagattctttctggtgggtggagataagagggtaccgagc

SEQ ID NO: 165734 - DNA, 431 bp, Homo sapiens
ggttaaaatcttactgttcagttgcagtcattatttcagcccttgtcgttggtacacgtatcacagagcgtctgattgtaatgatcggttgtacatgtgaattttgtccattgccacaatgtttttgaaaatagggagggtaggccgggcgcgctggctcacgcctgtaatcctagcactttgggaggctgagacgggtggatcatgaggtcaggagatcgagaccattatggctaacacggtgaaaccccttctctactaaaaatacaaaaattagccgggcgtggtggcgggcgcctgtagtcccagcaactcgggaggctgaggcaggagaagggcgtgaacccgggaggcggagcttgcagtgagatgagatggcgccactgcactccggcctgggggacagagcaagactccgtctcagagaaaaa

SEQ ID NO: 165735 - DNA, 652 bp, Homo sapiens
ctagtcacaaaatgaaaactataatttcacgatggagaaatttagctgatcctaccttaaccagtaatcaaacttagcatcaataataatgggccagccaaacatcatgtgcctctgatctgctgcatcattcataaagggttgttttctccctaaaatgcttaacctaaatctaatcaggtctctagatctaagttacagtttatagaatacacagggcagagaggaagaacctgaacaataccccaaagaaacaatcagacaaatccataatgtgaaaagtgaattcatgttaagaaataagaagtgtctaaaactgaactcccagcctgggcaacacaacaagagccccatctctacaaaaaataaaaaaataaaaaaatagcagatttagcagagtgtggtggcacatgcctgtagtcccagctactcaggaggctgaggcccccaccatctaactaaaactatccaagaagaccccgagcaacaaccccagaaccaggcaagtattgtggttttaagccactatgttttggggtggtctggtaggcaggacactggtaaatccagcctttcaagagccagccctgagacctgtctctggagtcttatcttgacactcctcaatctaccctgccaaggacaacaaaca

SEQ ID NO: 165736 - DNA, 378 bp, Homo sapiens
cgttgaacgttatcataaaaaattgcaaattaggtcggaagccctggctcatgtctgtaatcctagcactttgggagcatagatggtatatataaagtactattgaaagtaattcaacatatatgtgctgatacacattattactgtctctctctctcctctctctctgtgtgtgtgtgtgtgtgtgtgtatgcaaagtgacagaacggaagaaagaagctagactgcagtgtttaccactgcagaagagcatgtgtattcagaaggaagagaggaatatactgttactttgttagaagttttgtgcctactttttttttctttttgaaacagagtctcgctctattgcccaggctggagtgcagtggcaggatctcg

SEQ ID NO: 165737 - DNA, 399 bp, Homo sapiens
tcagaggattttcacaaataaatcttgtaaaatctttataagacctataggattagaattattatcaatatcttcattttataaatgaagaagcagattcagagagtgctattttcttgggcaccacagctactaattataatagccaggaattggttccaggcctctggatttaaagaccttctcctcttttcactatgtcatatcccttcttcaaacatacagtagaaccatatacaatagctatcagatcaatagttagatatgtagactataagccaggaacctctagaaaacattataaaatgctgtactaagattacataccaaattttggaactgcttttcattttcacacgttttttcccctgagttctctacctgttaacggaaaaggtt

SEQ ID NO: 165738 - DNA, 107 bp, Homo sapiens
ttgtctttgacgattacgggcctgttgttttgtaaaatatacctcagtttgggtttgtttggtattttctcacagttagattcaggttgcacatttttggcaggtat

SEQ ID NO: 165739 - DNA, 482 bp, Homo sapiens
tttttttttttttgcttgtgatctgaacaaagagcaggctgtcactttcatgacccaggtgttcttgaacagactgtacctcctcagggcttaagggctcccatggcagctctttcacttccacaagaccggaagcagtcagggctgaacacagcttgctgtcttcgctttgctgttgttatctacagctggatctactggttctttcagaaaaagacatccactaggccgaaggatccgggcaatttcagccaaaatctcagcactcagtagagtggtgcttcccaggactaaacccaacaaaataatgtcaaagctggattatttgtgggcagactgcaacagctggttgttttccacagacacgcggccctcattgccagttaacacttgaagcttatccaccagatctttcagagcctgcactggggatgacttatcccagaccactgccacaaactggccagcagagatcccaaaat

SEQ ID NO: 165740 - DNA, 1605 bp, Homo sapiens
  misc_feature (2)..(3): n is a, c, g, or t
gnnggaatatgggccaggaatgtctgctgcacatatttttgataattaaaaacgaggatagcagtctttttacatgttgataaggttaatcaaggcaacgtcattgcagttgtcaaaaaatcctgattattctcctgcactccattcattgtgaatctttgctttgaacacaggggagcttctggacctacaggtacaactataatctgattatgtgtttttctacttgaagagactacgtttttaactagtaaggcttaagacagatttcagtttttattaattctcaagattaagaacagatagcggcaacatgtcatgagtttcattaatgcaaaatgggaaccaaagttttgttcttatttttaaaaataatagtgataataataatataactaggcagtaaataaataaaaaatctgaatccagagccctttgttaagtaaaacataacagaaagaaatcagggtagatgccggccaacattcggattaataaagtgtgaacgtaccactcttgcatgcagattagcaagaattagcaatcatatagatgagtatagtaagttttaacctatttgctgttaccctcccaaatcctattttgctcagggcacacctccattttacaactagttaataaagaatactataatttaaagttcatgtttctatggtaacagccaattataaatgcaatctgaagagatggaaggaagctgccaaaactcttaaggaaaaaaaacatgatctgggttggcaacccacaagaaatgttgcttgataagggcttttgccagcttcccctagcattggcctgcaagtttatatctgaacaaacatcttgcacccattttctaagcactgcatctgtaatacattctaaaaggataattgtgtctggggctcaacatatgtgatggtgaggcaggaaaaaattcgcactttttttggtataatttctcgcatatgtttcttataacttcatggcactaacatcaacactagagagagaaaagaaccttaagtgggctagcttttttcagaagcatattcctaagttttaccttaaatattcttatgttcattgtttatacataacaatggataatggtaacatttatggagataataattatagaacttaaataaaatgttagccatcaattgggagttttaatgtttaacatatgtatacctgattacatatatatcttaatataacactgtgattacatatgtatcttaatatcttcttcttaatcactctgtatatgattgtgctttgttttcaggaagctcaatatgcacacataaggcatttccaaaatagatgaattaaattgaagataattcatgttaaaatatatttcacattcattattccatgcatcttattaacaacctagggagagaggatgttttcatttccattttacatataaagaaactgagaaatggaaaagttaaggacttactgaaagtcacacattgttagtagtggaactaggggcaaacccccaccttggacctctagatccagcattgttttcactctacaatatgactcctccactagctcaaaattaaatacacctggatatca

SEQ ID NO: 165741 - DNA, 804 bp, Homo sapiens
acaaactttttcatttgctccaaggaaaacactcttcccctttgcaaatgaaaaagtttgtagaatggctcaaaaatgctgaagaagaatctgaatctgaagctgaagaaggtgactgaattttgaaactacaccctcagtaaagcaaacaggagttgtagataaaatgtcatgtctcatgtgtcctggttcttacatcttcctacctccctgtatcaagcatgatataagggctttcatggcaaattttattttaactgtttctatggttgctggaaatgttgggtttagtttctaaaaccatgttttaagtagctacaggagctatagatttgaatctaatgttgcattagtcttttcagttatcttctacctcctgtattttctactgtaataatgtaatttaaggccttccacaatgaacagttcactttattccctgggttttctataaacagttttaaggatatgatttggttaaaaaataatttgttataaaaattctgtttgcaaattaaactggaaaagtatccagagtctcaaaaggcaatgatttgtgagataatatggcatgcccggagccctgctcatcaatgaaaaacccatatgtaataatcgaattcatttaacatgaatcttgagtacgtggaccattgcttgcatgttaactttttgttttgttttgttttgttttgttttgcatttttaactccagatatcctaaagctcaattgtttggtctctggttttcatccttagagaagccatggagaacagacttgaaaagtttaggaaatcataatg

SEQ ID NO: 165742 - DNA, 227 bp, Homo sapiens
gaaaatagtggtgcttttttataaagctgaagtcctgagcgaggagcccattttgaagtggtataaagatgcacatgttgcaaaggggaagagtgttttccttgagcaaatgaaaaagtttgtagaatggctcaaaaatgctgaagaagaatctgaatctgaagctgaagaaggtgactgaattttgaaactacaccctcagtaaagcaaacaggagttgtagataa

SEQ ID NO: 165743 - DNA, 246 bp, Homo sapiens
agagcacttacagttctctggctaaaacatctgctgcctactgttgaatgtaacaacatcaagtcagtttccggaagaaaaatcgtgaaagatgctctcacttcttctgggatctcaaacttagaccatggcctgggctgcctgcctgcgtgttactatatttcatcaattctaaaaatgtacatttttattttgcatttaacaaatctttccgggtgtcacttatagtcagtggcatattagcat

SEQ ID NO: 165744 - DNA, 489 bp, Homo sapiens
agtcaggtgctgggagagagtctcctccgtctttaggaaccagaagatttcactgtcctgccacaacattctggaacttatatctttcaactctcacacacagtcctcctttaattttgtttttcttttttacctaagttttctctcaagatctaactttaaattcctatggtctgatctcctctgggcctaattcatttcaatttagtatttactaagcatctatctatgtccaaatctaagaaatatgggtttagccatgttgtaaagtccacaaaatgcaattaatgcttttctttactgtgctgtgtatattaaaataaaaagacaagattattcactgttattaacaagattcggcaaatacctcaaacaaatagtaaaatatgatgtgccggaccaacaaagccctgtatgcctcaggcatagcagcttttattctgtatttgaggaggaaacctcttaatttttagattttggtcttatgtc

SEQ ID NO: 165745 - DNA, 607 bp, Homo sapiens
taggctcggcttgatgaggagctgggactacagtggcgcgtgacatagcccggctagttttttgtatttgttagtagagatggggttcaccgtgtgagccaggatggtctcgatctcttgacctcgtgatcggcttgccttggcctcccaaagtgctgggattaacaggtgcgagccaccgtgcccggctgtcactttgctttttaatgaaaaaagctggtgtccaaataaaccatccgcagggagactattctcccagataaaagcgtcctagagacctcccgcctccatctgacctggcagtgggccccagagtctgatgctaattatatcctccagggctggaccctcctgaccaagtggagacacggctcctgactgaggcagccaggccagcagatgtgtttgtgaaggggtagggcttcgagttctggtcaagtttgtggaataactgaattccgatttttttgttgtgtcgggtactgtttttgagatggagtctcactctgtcacccaggctggagtgcagtggcatgatctcggctcactgcaacctccgtctcctgggttcaagcgattctcctgcctcaacctcccgagtagctgg

SEQ ID NO: 165746 - DNA, 484 bp, Homo sapiens
tttagggtattttacctagataggtcttttcagtactgaacttgttcacattgctcacatcgacatgtactatccatgttattgttttaggaattactcttttctgtctatcctgttagaaagactattaaattgcactggttgacactgggttactccatttgtgttcttcatgactagcatgaggctatttttgggtgatacttactgatgacatatatgatatagaagacacaggagaaatatactgcatgaaaatcaagattcagctttagctagacaagatgaatcaataaactaaaatctaacaagatggagttctataggaaaaatgtcttaagagtttggtttaataaatcaatttcatatgtgaagggtaagccataatttaacagcactacatattgaagatttaaggttttagtgacataaagtgaatcagtgatatgtggttgtcaaaataaaaaactaaagtggtattagg

SEQ ID NO: 165747 - DNA, 274 bp, Homo sapiens
gagccactgcacctggcccactttttaaaaaaatatgtgtagaaggttagaacagttgaatccagcacagtggaactgagcatgaattcatccaagtgtaaaccttgactgaagtgacaaaatgggatgggttttccttaagtattaggtataaaatacatgtttaaggaagtggctagtttcttttcatcttagggtgtatcatattcttaaattattggtgtggccagttatttcagattgaaaacgtttgtagtatgtgactttacatttt

SEQ ID NO: 165748 - DNA, 536 bp, Homo sapiens
agtaatggagcagcaccagctccccctcctttcaggaaaggggtccacagagcggccaggacaaatctgctgccactcactgaaatccctccccaagaaaaacctcctgcaattcatccctgtccatagcagggctacagactgtgagaaaacaagcctgatcaactcacgtggacaccacaaagtcaaagtaccctagacctagaatccagtctttgtgttgagtaagttttcatgaaagctttctctgtcagtgtaactgctaaaatgcactcattgatgacaaagcccaaataggaagatgcctccaaaacaccagctctagactactctacaatcctcccccatcagacaagagtagacatgtggctaatgaaaagagccagtaatctaaaactcaagtatgttcatcaccaaaacgaggttttacatttccacagcccctctgccatcaaatggcacagggagaaatctcagaggtcaatgccctctgccccccgctcgtagcctcactctggtttgctctctctttcccc

SEQ ID NO: 165749 - DNA, 386 bp, Homo sapiens
atcttttttctttttctttctctttctttctttttttaaaataatacccccatacttactggcactaaaagattctctccttctcctatctctagaatcagccatttctccaaggagccttggttgcttctattggaaaatggtatttagaaaccaagacctgggtgctgaatgtactcatagttactaaggtgtcactgatgtctaggctgtttctatcaacagagctaggaaatttatgtatgtgtacaaacctgtatatatctatatttttgtatctgtctacctggagaaggggtgtgtgtgtgtgtgagtgtgtgtgtgtgtgtgagagagagagagagagagagagaaagacagagagagattatagcataaacacgagt

SEQ ID NO: 165750 - DNA, 236 bp, Homo sapiens
ccacatctctgtaaatagtcccttcattaaacttcccttaatcaccacttgagttcatcatctccttcttccaggatactgattgacacagacatatctgcttcccacctaccaatcatatcttgaatggaaccctataactcgaactacatccttgccatggacatttactgataatattgaatggtcttggaaggaggcgggaagatcctttgcaagcttagtagaccaaagga

SEQ ID NO: 165751 - DNA, 382 bp, Homo sapiens
tcctagttgtcaaatccagtggctcccctcttagtccccaaattgtcccctctgcagtattttgatactgttgattgttcctttgttgaaacattcctccattcttaatgtccaccaataaagagttggttaaataaaaattatagtgtaccgttttataatattctgttgttctgttgtggaccaaaaaatgcagccagtctttccataagagcacgtgcaaacttctaagatatattaagtaaaaaagtaaggcataaaatattgtgtataatctgacccctttagtacacagtgtaaaaacatctgtgtctgtgcttctttatacttacttttttctcccctggtgaatacaggaaactgtgagtagtacaacacaatt

SEQ ID NO: 165752 - DNA, 482 bp, Homo sapiens
cgccaccttgcccggataattttttttgtatttttagtagagacagggtttcaccgtgttagccaggatggtctcgatctcctgaccttgtaatccgcccgcctcggcctcccaaagtgttgggattacaggtgtgagccaccgcacccggccccattcttttattccttcactttcctaataaacctgttttcactttactttatggacttgccttgaattctttcttgcatgagattcaggagctgtctctttgggttctggattgggaccccttccctgtaacatatgctggcctctgcctgtaccccctgggaaaggccttgtagatgatagtgagaagttcttggtttattttgggggcctgctaacctaacaccatgtgagcagttggtggtgaagactggtaagataaggaaccttcatgggtggtaggaagaggtaagatgtttagaaataggagtcaggggccaggcatggtg

SEQ ID NO: 165753 - DNA, 205 bp, Homo sapiens
ctgaaagtggtcattagggggcagtggggaaaggagcatttcagtttgcaacattcctgattagcattaggcagacatgattctgctggaagaaatactcatgggacactaatcctacttagagggttaacatattgcttgatcagaaacatatgcaataatgaaaagtttcaggaattccttttcctaggggtgtgtgtgtgtg

SEQ ID NO: 165754 - DNA, 636 bp, Homo sapiens
atctatctccatatctcatctgaactctcagatgtttgttcttagatactgctacatgtataaacatgtatatatccaaaactgaagttatagtcttaatccctataactgatttcctaaatttcatagcaaagagtattgcaagagattaagaggatcattttgtaatgaagaaggggtgaattcatcgaaaagacttgataatcctaaacatttatgcacctaataacaaagctctaaaatacacaaagcataaactaatagctgcaaggagagagaaaaatcacaattgtagttggagaatattctttctcaataaacgataggatagatacccagaaaatcactgaggatataggcgacttgaacatgactgtcagccaacttgacctaatgaatgtttatggaacactccccacaataacagcagaatacacaatttttcaagtgcattaaaacattaagcctgatcatattctgttctattaaacaagtatgttatctgaccagaatgatattgaatattaaagtagaaatcagtaacagattggaaaatcctttcaatatttggaaactgaataactcacttttgttttttgtatattttttcaactcacttttaaataactcatgggt

SEQ ID NO: 165755 - DNA, 439 bp, Homo sapiens
agggccctgggttccaaagccatcctgctgagaagagataacagcctgattctaggaccaggacacagtctgtctcctcagggtttattcactggcaaatcttgttagcagatgctagaggtttttatttgcactcctgaactcccaaagaaacatatggcatcttttttcaaaaaaacctaaagaggcggggtgtggcagctcatactgtaatcctagcactttgggaggctgagctgggaggactgcttcaggccaggagttcaagaccagcccgggcaacatagtgaaaccctgtctttacaaaattaagaaaaaacagccaggagtggtggcacacgcctatagtccagctacccaggaggctgaggtgggaggattgcttgagcctaggagttcaaggctgcagtgagccatggtggcaccagtgcactccagc

SEQ ID NO: 165756 - DNA, 132 bp, Homo sapiens
gctgaggggcaaggggaggttctgagacttgctcttaattcttagggaaggaagagacaaggtctgaggaagcctgacttagttctgaagtgaggcgttgactctaccccgtttcctgccaaaagcaacgtg

SEQ ID NO: 165757 - DNA, 427 bp, Homo sapiens
cctgatgcctctcactccgccttttaaatccatcccgctcactcctactcttcctaaaagttccactttaatcatctcattcctcttctaaaaatggtcaaacaccttggctggcacttgaagcccatctctgtagggctccaggacacctttccacccttgtctcctaacaacctgaactgccgaaacccatcctcttaaattttgcacataaactgaatccatcaggccgggcacggtggctcatgcctgtaatctcagccctttgggaggccatggtgggtggatcacctgaggtcaggagttcaagaccagcctggccaacatggtgaaaacctgtctctactaaaaacacaaaattagccaagcgtggtggtgggctcctgtcatcccagctacctgggaggctgaggcaggaaaattgctt

SEQ ID NO: 165758 - DNA, 267 bp, Homo sapiens
tggccacatagggattcatcaggcctgccaagggaaaaagaaagacagccagagaggcttgagtacagggaacaaggggaagacgaacgggaaaagctacagaggtcaacagggccaccctacacaggggctggcagggcagggtggaactgggtctttatcctttaatcttgaagtgtggtccatctgggaccctaagtggtctgtgattacctgggccaacttgaaatgtcacagatgagaggttatctttgccgaatggctaaa

SEQ ID NO: 165759 - DNA, 669 bp, Homo sapiens
aatctcaaatgtttctagaactattcattgattctgagtgaccacagtcacctttattttctcttttgattaatgttcagaagtgatagaaactactaatagcaacacctaagtatgacaaagttattcattctaatgctttttttctgaaaaaaaagatttttatttagaaactgatcgcactcaatattcataaggcttaaatgattgagaaaacatggccagattgaaagattagattgtcttccagttgttcaatgtaccctgagttgatttttatccttcccaccaagtaaccaagtgatgaaaaggatgaaatgtcaacaggagagaggaggatgggggaagtataggggtgaagaattataggtggatggaagctcaatagaaacatctaagacaagagcatgggggtggttcaatatcttgaataaaagggataatagattgttggggagggatatgaaacatcaaaagagcagaggaatattatagtggaataatgctgaaaaaggcaaaaagctacatcatttaaaaagtgggagaaaaatcaatagcctttttatgttgaatgactgaaatatatgactggaaagatcaggttgcacatgatttctattgacatactttttaaacatatattcaatataaatttattatcttttagtc

SEQ ID NO: 165760 - DNA, 493 bp, Homo sapiens
gctgaatatgagtatcctaccaaggcctggtggagcagctgcctggctcgctctcttcatgctggtatcaggtactggggtgacagatcaggtcccaaaacaggtgacagaaggatcactggatcctaatctaccttttctcttatatgctgttctaacagcactaacctgggatgacaggacagtcaggaaaacatggaatgatgtccttctcatcatctggagatgaccatgatacgagaggttcctacattcagctgtcttctcccctacaatttggccctacctcttgtttttttttttttttttgagaacagagtctcgctctgttgcccaggctggagtgcagtggtgcaatctcgcctcactgcaagctctgcctcccgggttctcggcactcaagaaagggacacggaaacccttctcttggcttctaactagaactacggtggtcgattaactgggagatacaatggccaaaccaccagtgaag

SEQ ID NO: 165761 - DNA, 402 bp, Homo sapiens
ggcttagcttatttacttaaatatttaaatattttctttactttgctataaaattagagtgatgttaatatacaatgatgataatttaataatttgtaaataatctgtagactgcaaagtgtcaaacatattacagtaacccctgccttcatccatggtggatgtgttccaaggcctccagcagatgcctataagtgtggatagtactgaacccaatatatactgttttttttcttttacatacacatctatgatacagtttatacattaggcacagtaagagattaacaacaagaactaataataacatagaataattataacactataccataataaaagttatatgcatgtggtctctctcaaaatatcttactgtactgtaactaaaactgctaaaag

SEQ ID NO: 165762 - DNA, 452 bp, Homo sapiens
gcgggtgactgccatctgagactgtgtgaactgctctgatgttgggaaccaacccacactcaagggaaggcagtgctgtccacaggtggccgagcagagggccaggttgaccaccaggaaatagattaggaatcggatgggatgtagggggttccactgggcacctcccagcagaccaggagtcactgatgaggcagccagacaggcgcggggcagcaggaagggcccagcgtgtcccctctgtgtgacctcgccctgaaggctgcagggcccaagaagggccccagcatgctggggtgagtgaaagctcaaatgacagatgtcctcaaacagcctgtttccacaattcctggggcctgcaatgtgctaagggaaagagaggctgaagagctatctctgtattgaaacactttgggcagtacttgccaagacgccgtgactcaggggagcag

SEQ ID NO: 165763 - DNA, 526 bp, Homo sapiens
tatagaatgtgagctcccaaaggaaacacctagtaaagttttgaacacagtaacaaggcaataaatatgttgaaaaaaaggaatctaaattgccttttaaaatcatttatgaatgacagcacagcaattgcaaatgtaacatatcaggctacaataatataaccaagcctccatatattcatttaatcaacaaatacctattgaataccttatagatgccaggctgtgttttaggcactgggcattcagacatatgcaaaacagaaaaagttgctgacttcatggtgtttacacatcagtgacaaaggcacagcatatctggacaattacctgaattaatatgtttaacattctctaaagaacagatattttaatgatttttcaaataattgcaccatgaatacaccaattgactaggtatttcacttccttaagaattgctggctctggaaaagaatgcaacaagtcctatcagattatgccttaaaaatgtgcaaaatgtttgttgtcagatctggctgtacat

SEQ ID NO: 165764 - DNA, 124 bp, Homo sapiens
tgccaggtgctactctaagactaactctgcggcctcattcttgcagcccggtctaccagctgccctaagcctttgctcgggtagccccactggcctgtccctgccttgggtgggatggctggga

SEQ ID NO: 165765 - DNA, 363 bp, Homo sapiens
cttctggaataagtagggcaggaatcatcacctgcattgtacacatgagcatccccatctcagcatgtcggagcacacagatagggagttactgggcagggactatgacccattatttgtaactactgatgcttgagctgtgacctgtacctgcatcaggacagtgtttctcatgcagtgatcagggtggtgatcctggtgtgactgccagtgattaatcctcctgcacatccacctgaggcaatggggaaacagaaacatatccgggtctattctcagctcagctgtctctggctagctctgagtagacttctttatctgaaatgtgaagcctggagatgatgcgtatgaagagttgggtgg

SEQ ID NO: 165766 - DNA, 452 bp, Homo sapiens
agctcctaaaacccttggaatttcctgagtgataagggtgataggagtgttctttgttctaataagacaactcttggaaagcccctagatagcttcaggatgagggctacctagaaagacaaagccttgaccagaagttcagaactttcagtaccacccaccaacttctgatgaggggagaggggcttgagcaaatcacccactgtcaatgatttaatcaatcctgcctacataatgagacctccataaaaacaactacacaaaagggctcagagagcttcctgattggtgaatacatctacatgctgggacggtggcatattccacaggacagagactcctacactcaacactcaggaccctcctggactttgccctatctatctcctcatctggctaattgtatcctttataaaaaactgataaacataagtatttctctgagttttttg

SEQ ID NO: 165767 - DNA, 883 bp, Homo sapiens
agatgaataaatacgacctcatatcagctaataaatcagaacacgattctgccccatggagaaacccatcgcgagtgctgtgacccggcctcccggtccttgctctctacagcatcttgaagctgcagcatctttgcagatgccccctttacaaagcacattctccccttgcttcttccagcctctcctcctgtgtctacacgaacgtttactaggcttttgtcctgagccctctgattttcttcttctgcactctccctttggggagctcatctgtgtccacagatttaagttacctttccaagtaaattgttgctaagactgacatctccagtgctaagcctttccaaaggcctggccccatatttcccgcattggagaggcctgtggaccggtgcagcgaccgctgaggcctgcacatcattacaacccgagagaactccaactgtgcagaccccagctcccctgcggatctgattcacatttagtagttctggggcatggtctggggatgcgcatcaaaaaatttcctcgcagggatgccgatgattagtcagctttgggaacaaccggcctcttgggcagagcaaaatttgagttggacagacctgacttcaaatcttggcttctccactttaagattaagtctgggccgggcgcagtggcccatgcctgtaatcccagcactttgggaggttgaggcaggtggatcatgaggtcaggagatcgagaccagcctggctaacacggtaaaaccccatctctactaaaaatacaaaaaattagccaggcgtggtggcgggcacctgtagtcccagctactcaggaggctgaggcaggagaatggtgtgaacgtgggaggcggagcttgcagtgagccgag

SEQ ID NO: 165768 - DNA, 390 bp, Homo sapiens
cacagttttgaggttctgccctgacttacttatcacattgtaaatattattgttctctgaactatgcatcctttggttaaaaaccttacttagcatttacataatacattcccaaagagtctgtcattttccattatttctatccctttcatcatgtgatctctgttctaggtcacttgttatttggctaaaaccccttcttgaattttctcagaggagttaagtgggtattatatccttgaaatttttgtatagttgtaacatgtttcccctcataggggagaaatatcttcaagggaaatagggatttgggattgtgaaatccccaatctgtaaatactcttctaccatctcctagtttccagtgttgtgaattagaattctgattcc

SEQ ID NO: 165769 - DNA, 316 bp, Homo sapiens
acaggtgcttatcagtttattcataactgccaaaacttagaagcaagattacttagtaagtaggtgagctagataaactatggtaactgcagacaacagaatattgttctgtgctaaaaagaaatgaggtatcatgtcatgaagacatggaggaaacaaatgctattgcttagtgaaagaggccaatctgaaaaggctatattctgattccaactgtatgacagtctggaaaaggtaaaattatggatatagtaagatctgtggttaccagggccttatagaagagatggatgaatgggcagagcacaagatttac

SEQ ID NO: 165770 - DNA, 245 bp, Homo sapiens
acaacaatggaccagggtgaatgctgtggactgcagttgctctagagtaatacagggaaaggatgtcttatctgtggactcatgcagcccaccaaggagctgtggaaaaaatagaggagtttgaactggactaagtagaaatgggggtatattttaggcacaagggacagggattcaggatgctgtcaaagtgaggcaaatagttgttgagggcctcttatttgctaagtgctagacagagtgag

SEQ ID NO: 165771 - DNA, 543 bp, Homo sapiens
tcactacccaaatctcaccttgaactgtaatccccacatgccatgggcgggatgtggtgtgaggtgactgggtcatgcaggcggttttccccatgctgttctcgtgatggtgagggagttcttaggagatctgatagtttaaaagtggcagtttcccctgagctctctctctcctaccacctttgtgaggaagatgcctgcttccccttctgccataattctaagtttcctgaggcttccccagccatgtagaactgtgagtcaattaaaactcctttctttataaattacccagtctcaggtagtatctttatagcagtgtgaacatggactaatacagagaactggtaccagcagagtggggtactgctgcaaagataatctgaaaatgtggaagccactttggaaatgagtaacaggcagaggttggaacagtttggagggctcagaaggcaggaagatgaggaaaagtttggaacttccaagagacttgttgaatgcttttgaccaaaatgctgatacggatatggacaatgtagtcca

SEQ ID NO: 165772 - DNA, 317 bp, Homo sapiens
ggagtttgaggttgtagggagctatgatcgtgccactgtactctaggctgggtgacagagaaagaccctttctcaaaaaacaaaacaaaacaaaaacgggatctttttcagctttctaaaaaataaccagagttctaagaatttgggtcccagaacctacaaattaaattggaatctacgacccaccattcattagttaggtaacactactgaacttcgcaactgggcaactattgaacttctctgagcctcagtttcctcatctagaatatgaaaataattacagcacctacctcctagaatgttaaggaggataa

SEQ ID NO: 165773 - DNA, 612 bp, Homo sapiens
cagccttgacaacagcttgcttcccttcctctaaatggcatcacatcctttccggctagaactttcagggacataactgagttatcacttcacttccacattctcatctttaaacacttttttgagatgaagttttgctctttgttgcccaggctggagtgcagtggcatgatcttagctcactgcaatgtccacctcccgggttcaagcgattctcctgtctcagcctccgaagtagctgggattacaggtgcctgccaccacgcccggctaatttttgtatttttttagtagagacaaggtttcaccatgttggccacctaggctgggctcaaacccctgatctcatgatccgcccgcctcggcctcccaaagtgccgagattacaggtgtgagccacggtgccaggcctaaaaactttttctgatcatggattatttaaaaataaatatgtggcttgccttctcaccctgcagaacactagtcctgtcatccatctctgtttaagggcagggaatgctttctcgtggaaaaaacatgctcctagatgattcagcttctttgaatgtgacagctgatgctaaactaacatgtaaaccctcaggaagaatg

SEQ ID NO: 165774 - DNA, 433 bp, Homo sapiens
tgggtccttagctaaaggtcaaaagcagtgaattatttccattgagttctttgtttaagaacctgtatttttttttaaaaaaagcagtgaattaaaaattatcaccattgaactgaattgaactccacatctagaaacaagcattaatgctccctgcaggagagccaaattcaagcagtagatgggtctcataatcctgtgaaaatcagctcgccttgtttcagttggaggaaaagtgtagccagtgtcaagggcagagcatcctcattgggcaggcagagatctacctctgagtgaaggccagcaggctcaagtttcagaactatagacaatcccttagtttttctgtactcagtggacctttcccttctataaagagaaaacaactaactccctgtttatatcactagaatgttgtaaggataaactattg

SEQ ID NO: 165775 - DNA, 575 bp, Homo sapiens
ttgcatgtggaagcagtcaagatcatacaacttaatatgattttggagttggtgacctgattgtccctggctttagctcaaggtctatgcctaaccagctgggagatattgggcattaggcatgccactcattgtatctgggtctcattcatgaatagggatacaaagtctacttctgcaaagttgttttgggagttgaatgagaagtggcatgaaagcacttggttaaatatgatgcgctgtttgaatgtgaggtattgctattttaccctcaaagaaaaaaaatagtgtcctggttaccatattttatggtcagaaatatttgtttagtgcagtaagatgccctgtgatagaaggatttcatggtcaaagaagcctaggaatccccagatgcctttctgccttcggtgatccccagcgctcacaacccctttttctcctccagaaatacaaacactcattagcctttgaaaggccctgagaagtccagcagcaaagacatcagttgaagtgtgttttatctggtgttttccaacataatttgacaaataaagcttctttgtgtaacatctcac

SEQ ID NO: 165776 - DNA, 387 bp, Homo sapiens
gtacacaactgagtgtggccgggttccaataaaactttatttacagaaaaaggcaggcaggcagaatttggcctacaggctacagtttgctgacccttgacctagctgtactaggacaatggtccccaacccttttggcatcacagacggtggctgggggaagaagggggatggttttgggacgaaactgttccacctcagatcaaaggagcgtgcaacatagatccctcacgtgtgtagttcacagtagggttcgagctcctatgagaatctaatgccgtccctgatctgacaggaggcggagctcaggtagtaatgctcactcatatgctggtcacctcctgttgtgcggcccagttcctaacaggccacagacccatactggcc

SEQ ID NO: 165777 - DNA, 334 bp, Homo sapiens
  misc_feature (220)..(221): n is a, c, g, or t
  misc_feature (270)..(270): n is a, c, g, or t
  misc_feature (294)..(294): n is a, c, g, or t
cacccttaagaagtaggtttctttagagcggatgcaaggtcccagaaggacagtgatggtgctgagaggagaggagtgcaacctgagtttagttgaattttccttcctcacatataaaatatcgcatacatacaaaaacatgtgagatctccgtgtaaataggaatactcacatagtcaccatccggcttagaaggagaatactcgtgccgaattcggcnngggttcaccctgggcatcttcaccttgtcgacctcaagacatagacttncatgttccatcttgagtacttaanggacattcacattagggataagctggctgcaataaaactt

SEQ ID NO: 165778 - DNA, 503 bp, Homo sapiens
tgcatgggattagatttttattcacattggatgttgcctaaacaatcctggctctattttgcaacttcccgcatttgtaaaacttccttttaactgcaacaagcaactggagaaaaggattaataggaaacctggcactacagttcaccaaataacacagtacacaagtagacacaggtctgtagggaaatacagtcaggaccagccactgaacacaattgctttttgagtccaaagataaaacagcttgaatctcagattgtcataagcatttactgtgggaaaggtcctttaaaatgatctggtccaaacccctggttttcttgatgaacaatggtaaagaattagactaatttcaatccaaatattcacgtgcctgctatgtgctgtgtattagttcacaaactgaattttctaaagagacttctttagtaaacacatgaaacatgcctgtttacaatacagtttttgttttttgttttttgagatggagtctcgctctg

SEQ ID NO: 165779 - DNA, 262 bp, Homo sapiens
agctaaaggggaatatggggtcaaggaagaacattttagggatgatacaagtgggaataatccagagaggggaaattcctaaaatgcatctctaccactgctctggtagggtttcgattctggcaacagtaagtactctgatattaaataggtacaaggagacactgtcagtctgagggccttgctgaggaattggaaataactgctgattggaatttgcttttatggtaaatgaggcagatggggtggaaaggcagcaatg

SEQ ID NO: 165780 - DNA, 645 bp, Homo sapiens
tatggcttcttagcatgtggatgtgtgcaccacccccaaagctctccaaaccccataattttgagtttatggaggttttattacacaggcatggttgatgaaatcattggctatgggtaattaacttaatctccagcccctctcccctccgtgaaggttaaggggtggggctgaaagttccaaccctctaatcatgccttggtctttctggcaaccagccccaatcctgaaactatctaggagctcctagtcaccagttatctgattagcagatagaaactcttatgttgggaatctgggactaagactaaataaatatcataacaaaaggtgattctataacctctatcactcataaaatcacaagagttttgggagctttgtgtcaggaactgggatgatgagcaaatatatgtatttcttattatatcacaatcagtgtttgaacattataaggaagaagaaagaggtcaactcaacgtgatagaggcttgtttgttttgttttttgttttgtttttttgaggcagtcttactctgtcacccaggctagggtgctgtggcgcaattttggctcactgcaacctctgcctcctgggttcaagcgattctcctgcctcagcctccccagtagctggaattacag

SEQ ID NO: 165781 - DNA, 191 bp, Homo sapiens
agtaagtctttacctatcggaataattactctgaatgcaaatggattaaattatctaatcaaaacacagaatggctgaatggataaaatgttataggagtcaacgagagaaaatgagcagaggtaggaaaaaggatacaagtagcagatatgtaggatgaacaagtctgaaggtctactgtacagcatgag

SEQ ID NO: 165782 - DNA, 90 bp, Homo sapiens
gaatgaactaaggtgtctaccatgattatttttctaagctggttggttaataaacagtacctgctctcaaattgaaataaaaaaaaaaag

SEQ ID NO: 165783 - DNA, 473 bp, Homo sapiens
ttccttgctcctcagcttgcagatggcctattgtgggacttcaccttgtcatcctgtgagtcaatactccttaataaattccccttcatatatacatctatcctattagttctgttcctctagagaaccctgactaatacagagatggtatttagttacttttgaataatttgattctttcaaggcttgcttttaagttttattagacagtaccagcccagtggttagtctagaactaattttccccgtgcagcagaggtagtactcttctgagtactctacctggtgccttgcaaattgcaaggtttttccacactgactggtgggaatacaaacttttcttgcccagtattaatctggagatcgtttcttctgagcctttctagtggttctctccctggcctcaggtgatctcctgacatatatgtacagatcattcattactcagctgaagactccaggaccccctcggc

SEQ ID NO: 165784 - DNA, 354 bp, Homo sapiens
ccctaatgtaaatgttggcacaagccactctattagatactttaaaagtatatttatagaagtttattcttccagagcctttcaatacagaataacccaattaaagacaatatatctaatgtcattctatttgacatgattttagatgttgctcatagaaggtaaaagttttgatatggttccaaagtaaatttattaaatttctcccagaaaatctacattcctctgcttttgcacacttcagtttatgtcatttagggttgctgtatatatttcattagggatgctaattgatctgaacacattatttacagaaaatacctttagcctacaaagttccgttgaagccgtaag

SEQ ID NO: 165785 - DNA, 700 bp, Homo sapiens
aagacatcagccgctggataaagactgaggctctgtcttccggatcaagtaactgggctacaatgcctaggcagatctccatctgttaaatcagattagcagtctgcccagttcctcaggtgttgaaattttagaaactctccccccaggactctaacaggaatccagagttgagaaccactgctttcataaaagcagattttgtggaggcaagggctgccagggtagaagcttgctaaggaaaattacacaacatgtttatacctgcgaaatctgtgtaaaataaacaccagaaagcaactaaaggagataaacttccaaagcatgggagaaaataccaacccaaagttatagtttaggaagacacatgacattgacagtcattaataaaatgcaaagtaactctaaggtatcgttgcacaactgtgagatgggcagaaatatgtaataatgataaaaggctgccaggattatggcgaaaattgttcccttaaaaactgctgttagcattacactttgattaattctactctgttttgagacaataatctgcaactgtgtaaccaaagctcgagaagtctttgttctatttttagaatatactataagaaaataaagaagaatgcagtttattcaaaattgcctgtagcagtggcatgacataaaagtgaaaaattagaagccatctaaatactgaatt

SEQ ID NO: 165786 - DNA, 751 bp, Homo sapiens
ctctaaagtagagggactctgtgcactaaacctctctttaagctttcctgagctatttgttatcccagtgtaggaagttggttgcaagtcttctcacatggtttttcatgcagaataacttcatttcatatgacaactcttgtttttgatttttaggtttttaaaaatttctaatgacaacccttgttttagatttgttgtgctggttgtcagatgaccatgatcaagtgggtgttaatcataaacagtatgctgcacatgggcacattcttcactaatgtgacttacttttaaacatctccctaatttctactcagacacttgataatatgttttatttgatactttgaagacactaggatggggcatatgactaaataaaagtaactgggtaatcccagcactttggaaatccaatggggggtagatgacctgaggccaggagttctagaccagcccggccaacatggcaaaaccgcctctgtactgaaaatacaaaaaatcagctgggtgtagtggcacacgcctgtaaacccagctacttgggtggctgaggcaggagaatcacttgaatgcgggagacagaggttgcagtaagccaagattgtgccaccgtactccaacctaagtgacagagcaagactctgcctcaccaaaataaataaataaataaataaatggccccataacaggacttcccaagatgggtgtgccttggtgtgggcattctctatctggtcttcagctttga

SEQ ID NO: 165787 - DNA, 499 bp, Homo sapiens
cccgccccctcagggtctcctgtggcacctgctgcccacccactcgtctgggtatcctgacaagatgtccatccgcacccagcctgtgcctagcagagcaggtgagcagctctgggtgtttctggaatcagatttcagaacttccagctgataaagggcttttgtttggccagtgttttgccccagcctcctgtccacagccaggtggcaggtgattctgggacccaacccacatccggaaggggcaggtatctgagcagtggtgcaggatttatcatatggatggttgtttgctgcaggaacgagaggccatcatcattatagcacctttcaatggtcagttctttataaatcctcattgcctcactggggcacttagtctactgtcaggatgagagggcagccagggggaccttcagaactcaaatatagcctcttcatttgatagatggggagactgaggcacagaaagagcacagggcattccatattgcatcag

SEQ ID NO: 165788 - DNA, 314 bp, Homo sapiens
aggtcactctcaggatcccacatttccacgagtcgcaaaataaccaacagagagacagggcaagccatgttcctagcatggattaaatgacaagctccttgctcttactatggaaaagtattttcatctctccgtttttcatggaagagtttaaatagggaaaacaaatgctcactactgtccttgcaaaaataaactaatgaaaaccagtaagagcagccggctttaaagtttaataattatctgcaaaggcagaagtttccagtttcactcaaatttgtccttttatactaaatgcgtgactcgtggaaatg

SEQ ID NO: 165789 - DNA, 310 bp, Homo sapiens
tctaaaggaggggagcggtgctggaggttgtgtgtcagggacccactggaaagtgacacttggctagacttggaaagatgagtgggaattccccagacacgagtgacatgaacagcttggagttgtggacataacgtgtgattttagcatattctagtttggttagagtcctgtttctcaggatgtccacagaccatagggggtctccgaggctaaaattagtttttgtggtaatgtttacatattattgccatttccactgttggtgccatagcaatgatgggtaaaaccgctgatgctttaccaaaca

SEQ ID NO: 165790 - DNA, 249 bp, Homo sapiens
tcccggactcaagcgatcctcccacctcggcctcccaaagtgatagtattaaacgtgtgagccacctcacctagccagatggtggactattcatttctatttcctttctgagccactgctgggaagttaattccttagtttttttaaaaaactctgctttatgtctgagctattctactctagctagagccacatataactttcacctgcattcttgggtttttggacagaagctttcttttcttttta

SEQ ID NO: 165791 - DNA, 237 bp, Homo sapiens
cctattcaaatattttgcttactttagtttttgccttcttattattgagctataggtatttttagcatactctggttacaatctgaataaactatatgtttttaaaacattttttttcccaggataaggcttgttttattattttctctaagatttcttttgaagagaatttctaaaaattcaatgtggtcaaaattatcaactttttattgtgtggttcaaaattttcgctttccc

SEQ ID NO: 165792 - DNA, 423 bp, Homo sapiens
cgactccagaggataaaactccataatgtgatcccagacacctacttacaagagtgctaagaacaggaaactgtcctaggtgcagacaaggctagactcttctagggtccctaaactgtttcttaaaattcgtttttattcctcctagtccttggcaaagtggtgggtgtatattaggtattaataaggtaattgttatttgatggtatacttttgcttcacagaaactttgtttatttctgtggtagcatatgcttgtagttgtcagggaccagatcagctcaggcttttttgcagaatacaggttatttccccatagggttagtatccccaccttcttcccccaagaactgaaatcattttcagaagggagtcattgcttctggatcaagactttaattatgggctttttttcaaaggcag

SEQ ID NO: 165793 - DNA, 542 bp, Homo sapiens
accagccacatccccaccaccgccactgccacgatttcaatgctggtgtcccctctgaagtccgtgctgagatcactactgcggccttcaagcgactgatccatggggcccactcatgtgaatgggatgaggggcccttataaaagggcctgatggagggaggccacggcttttccgctccttgcaacccctctgccgtgtaggaagcagcacagggcctctctggagggttgctgaccaggcaacctcgtgggaacagagagcagccctccccgacacagccctgccttggccttggacctcccagcctccagaactgtgagagattttcgttctttataaatccccaggctgtggggttttgttccagcagtgcaaaggggccgagatgatcgccatcaccaccgtcgtcatcaccagtgtcagcacaacttgtctctgtccctgcagggcgcagcccagagctgagcagcaaagcatacatccccttttgttctaaaagggcgcctcattgagcctgcgtcaccccagccagaagtgcc

SEQ ID NO: 165794 - DNA, 548 bp, Homo sapiens
cgcaactgcttgggatggggagctgctctaatgccaccttctggctggtactagaaagatgaggacctggccaggcacagtggctcacatctgtaatcccagaactttggcaggccgaggggagcggatcacctgaggtcgggagtttgagaccagcctggccaacatggtgaaaccctgtctctacaaaaaatgcaaaacttggccaggcatgatggcgcatgcctataatcccagctattcggcaggctgaggaaggagtatcacttgaacccgggaagcggagtttgcagtgagccgagattgtgccattgcactccagcttgggtgacagagcaagactctgtctcaaaaaaaagaataaaggaaaaaaaagacgaggacccggtcgtggcttcagcctctctgacccaggccagagggcccagcaatccagttgtacattgtctgattggttggttgattggttggtttgctccctgccttgctgcagagaggacctcaggcagcttccaaggatgcgtgatacacaaccagagcagaaaaaa

SEQ ID NO: 165795 - DNA, 264 bp, Homo sapiens
tagcctcggaccagagccacggcgggatgctttcctggtgcgtggcaggcagtcaggaaatattgctggactgaccttgataggagatgcttgggagaattgcccaaaaaactagcttaaaatgcaaatattggccttcttttgcgttggctaaagagtagcatttctccgtttgcctcccgggtaagaaattgatggcgaatgcaatgtctctagggaggagaagaaggtgacaaaaagggtctgtataacggggcacacgct

SEQ ID NO: 165796 - DNA, 255 bp, Homo sapiens
tccttcatttgcagtcaaggacgttttcattctcttgtaaagtttcatatagcaacctcataaatgatagtaaagcaaaggtttgctaaagatatataccatgcaaaagacacacattgccttcagtgcacatgcctgacaaaacctttacatttttcttgattatttacatgacaatctcttgagtggtttccaccattagagaaaagaatcctggaacttctctttgaggaaacttatggaaactgaaatgag

SEQ ID NO: 165797 - DNA, 379 bp, Homo sapiens
actagatccactctttctccattcattcattcattcggcaatcattccttccctacctactctgttttgagcacaaccctcagcactgaggagacgaaacctggacgtgattcttgccctaaaggagctcacagactattagtttaaccgttcatcaaatagaatattttagacaaaaaggcacaatgtctcaaaatgctacagctgaagatgggaagggtgggatccaatcatttttaagaatagcagaagaaaacaggagagaaaaaggaaaataagggaaaattgtctgatttgtgatccttatagataaatgtctaatgaggaaaacatcaccaatttcctccttcaaagcccgggagaaggcatatatgaaaag

SEQ ID NO: 165798 - DNA, 272 bp, Homo sapiens
aaggagatttgcatacataacttagaatgacttaaagatgttcattaggaaaattgtgataaacttcaatgaataaaggaatatcaaaaggagaaccagtttggatattttaaatctgagtgatgatgtgtcaaacgtttggaaatatcacagacaggcagagcaagttttagtcaagaggtcaatcctaaaaataagaatttgttagcagttaattgtcaaataatccatggtgttcttcctttttcttttttattgagccaacacaattt

SEQ ID NO: 165799 - DNA, 123 bp, Homo sapiens
gggtgccagcacacagaccgtgtcttccctcctactggtctccaagtttctccagacctgttgcatctctgggtcatttgaggacaggatgagggtctagagggccagtgtgggaaggattct

SEQ ID NO: 165800 - DNA, 443 bp, Homo sapiens
tcaaatattcgtcatctaattttaatataacattcattcaattcagaatatatttgcattttctttgctaaaaaataatcacccattagtattctgtactgcttttaggaaattattggtgtatgactgtgtcaacagattgagcctcaataagtaactttgatatcttaaattgctttgagggagacatttttaatgccatcagatatcttctcccaataaattcttcaacctttatcaaaataaaactacattttctattgccaaaatgacaaagacaagacagattatgttttaaaaaaagacctcacgtgtttttttttttaatgcagctactctaaatctattaaccattggacagtgatgaattagggttacacataagcacacttaagcagcaaccattatctatattagtcatctatcttagaattcctagggtc

SEQ ID NO: 165801 - DNA, 502 bp, Homo sapiens
atgagtatataagggcacctagaccagcatttcctcatttgcttgcttttagaaaattaacactcattgtgtactagatgcacttcattttgttgaatccacaccacaatgttatggacacatgttttggccccatcgtacagataggaaaactcaagtctagaaaggtaaagtcactggctctaattgagacagccgaaggtgggcagagcccagacttaaactttcacatgcaagtttcaaagtcagtgctctttcgggaggccgaggagggaggatcactggagtccaggagttggagttcagcgtgggcaatgcagtaagaccctgtctctacaaaaagttttaaaaattaagctaggtgtggtggggttagcctgtagtcctagttcctcgggaggctgaggtgggagggttgcttgaccccaggaggttggagctgcagtgagctatgctcaagccactgcactgtagccccggtgacagagtaagaccctgtctc

SEQ ID NO: 165802 - DNA, 326 bp, Homo sapiens
agcccaatcatgtgcatttttgctattctgttattttaagcaaaatactgatttttttcactatcaaattgcagaacaagggccatgtcctaaaaaaaaaaaaaaaaaaaagccaataaaaaatctaatatatgcatgttcccagaattgttttcatttgttgaatctgacattaaaataaatttagacataaattggctcaagaaaaaacgtaaagataatactaaggaagtaattaagaatttgatattttgatttttacgtgcacatacgccatcaaaaaattccaacaaatatatcctgatggcttttgttctgttctaaat

SEQ ID NO: 165803 - DNA, 574 bp, Homo sapiens
cgagctcggcaccccgacagattggcccacggagaaaacccaagatcactgcctcccgcaaactcttgctgaaggtgaggctgggggctgcagaactggaattctggtctaggacaagacaagtgccagccagcgttctctatctttatccggaatcctctgctcaccctacggtgccttaaaagctcatctttgttatttaacctctgcagttcagagaaggctgcagtcagctaccttgacctaggggctgaagccttaacttcccactctgattctgctgctgctgaaatcttgtaagatactatgagggccacatggcttctacaggcacctccttcctcatctgtaaataaggatattaggacccccccccttacttagttcacagagttattgcagatgaaatgagatcatggatgtgcaaatcctttgaaaatcgtaaaagctatgtgttttcacactccaggtagtaatacagcaataccttgatgatccgtcatgctgcataaataagctgtgaatttcccaaataaatgaaacgtatctatgtagacctcaaaacttttaaaaa

SEQ ID NO: 165804 - DNA, 647 bp, Homo sapiens
catgtcactgtactccagcctaagtgacagagtgaggccctgtctcaaaaaataatactaataataaattttgagaagctgtgaagcccatgtacaagttttccaaagcatttgatttttttatgaaagcccagttgtgcatttctggtttctaagaatcaaaccacttggctgtttttaggagttacttcccatgttataaagctgaggaagctttttttttttttttttggaaacagagtttcgtggtcacccagggcgggagttgcagggggtgcaatctcaggctcccgggtctcaagcaaattctcgcgtggcctcagccttcgtggagtagcctaaaattcacggggtggtgcgccaacacggtcggggcttatattagggggattttaagatagagagggggagtttcaccagtggtgggtcagggggtgtctcaaattccgtgagctcaagtgatccgaccaatttcctcccaaaggtgcgggatggcaggacttgagcgcctagccgaggaagctatctatctggagtgatgaacccttggcaacgcgggtccaaatgggggtgggccctccctatagcttccatatttctcaataattccgaagggcacatacctgaggtctcacaggggacctctg

SEQ ID NO: 165805 - DNA, 729 bp, Homo sapiens
ggagttcaagaccagcctggccaacatggtgaaaccccatctctactaaaaatacaaaaattaaggcgcctgcaaccacaccgagctaattttgtatatttagtagaaatggggttccactaccttggccaggctggtctggaacaactgacctcaggtaatctgcctgcctccacctcccaaagtggtaggattacaggtgtgagccaccaggctcatctcaagccttacatttaagcgtctaatttattttgaaatggtttttatatacggtgtgagatgagggtctcattttatttctctgcctgtggacataaagttttctcaacatcatttattgaagttactgttcttttggctcatgcctgtaatcccagccctttggaaggctaaggagggtggatcatgaggtcaggagatcgagaccatcttggccaacatggtgaagccccatctctaataaaatacaaaaaagtagccaggtgtggtggcacgcgcctgtagtcccagctactcaggaggctgaggcaggggaatcacctgaacccagatggcagaggttgcagtgagccgagatcgtgccactgcactccagcctagcaacagaacaagagtccatctcaaaaataaaaaaagaaattgtcagctttattccaaatcacttagctgtaaatacatggatatatttctggtctctttttttctactgcattggcctatgtgtctgtt

SEQ ID NO: 165806 - DNA, 154 bp, Homo sapiens
gaatggaaagagagaaagaataagagagaggattcagaaatgggagaagcttgggcagtcgagggctatctcctggtctgtgtcctgtctcaggcccctgcctgagacatccttgtacccaagcctcctctgacaacttctcattccagaccag

SEQ ID NO: 165807 - DNA, 353 bp, Homo sapiens
ttaatgacagttgttgcattcttcatatttgtaataccttttgaacaaggggctccatgttttcatttctgctaggcctctcaaatcatgtacctggtccagttggcaccaataagaatatcaaactactgtccaggtggtcacgcaaggaggtgatgcacaagcctaatttgggcagatatggagtgttaaagaaaggacctggggttggtctagatattatttgggaatctgggtggagatactatttgggaatcttggtggagtcgaagaaaaaacacagatggagaaatatgtagtattgcataaatttgtgactctaagctcatctgtcagtaaactgttggggacag

SEQ ID NO: 165808 - DNA, 253 bp, Homo sapiens
ctcggtgtggtggtgggtgcctgtagtctcagctacttgggaggctgagaaagaactcgggaggtggaggttgcagtgggccgagatcacacaatggcactccagcctgggtgacagagcaagactctgtctcaaaaaaaaagaaaaagaaaaacaaagccataaaatcagcctatacttgcaaagtgtaaagcagagtttggccatctgtcctacaacagagaaagctgggtccagtggctcacgcctgtaa

SEQ ID NO: 165809 - DNA, 720 bp, Homo sapiens
cagtgaacaagacttctagttctacatccttaccgaacacatataatgtcaatttttttaagcccttctagtgtatctcattgtagttttcatttgtacttcccaggtgattaatgagattgagcacctcttcttacatttattggcaatttggatagtctgtttcgttacattcaattcaagtcttacctctttttcatttggactatctgtcgtctcattgattagaggaattctttattctggagattacccctttattggatatatgcttttcagataccttctcccactctggggcttgcctgttctgtcttaatggtgtctagtgagagcacaagctcttaatttcagtgaaatccagattattagtcttttcctttacagttagacattttaagtcctgttcaataaatctttgtcctacctcaaagtcatgaagatattctcctatgttgtctgctagacgctttattttttactctttacacatatgtacctaatccacctggaattaatttttataagagttggaggtaggagtgcaagatctgtttttctccataaggatatctacctgacgcagaacctgttattttaaaaactatccttcccctgctgcaccaagtggcacctttttttcataaatcaaggatccgtgtaccgtgggtctgcctccagatctagtctgttccactgcaccatcaccacccaacccta

SEQ ID NO: 165810 - DNA, 343 bp, Homo sapiens
acctaggtaaccaacacccaaatcaaaaaataaaatatgaccaacaccctggaagctcctctcatgttatcttccagttaccacttccccaaaatgtaaccagtaatctgactgttataacaatctctggtactttttaaaaaaaaatcgaggtgaaatttacattataaaatatgtgaaattttcatcacccaaaataaaacactatttcccttaagcagttagtccccattcccacctacctgcagcccctggcaatcaccaatctgttttctttctatattgatttatctattctggacatttcatataaataaaatcatacaatgtgtgacctttcatc

SEQ ID NO: 165811 - DNA, 255 bp, Homo sapiens
ttttttgtacagctggttggataatacttgtcttacagatgatcaattaattaatggatgcttatatatatgggggaagcaatgatttggggaacatggtggttggtacctgaacctcggatcctatcttgattgtctctttgaagcctccaagtgcacacagtgcggcaacggcctggcgtgcaattctctgaagtttggcaagtttcctgccactgctgctgccattttccagaatgctttctgcgtatttcc

SEQ ID NO: 165812 - DNA, 641 bp, Homo sapiens
gggatttttcacctcttttgaggttcaacccctcgtaatggggatttctcagttctttgaggttcagcccctgaaattagcggaaggctcaacccatcaaaccaggggtgtcttccctcgcctgtcctggaagactcaacccctcaaaccagggatgtcttgccttgcctgccgtggaaggctcaacccctcaaaccagggatgtcttgccttgcctgctccggaagcctcaacccctcaaaccagggtgtcttgacttgcctatcctgggaggttgacatgtttcctcccctttccccctctgaaggtcccttgcacacttcccactcatgttgtcctctctggctgctcccccaagggagaattaggcccttcttagtgttggcgtgctggtataaatcccacagcaggatccgccctaagccatacgaggtagctgtggaactgcagagaggacgcactcactccatccagcagtaggacttgtcaccatccacacaacaccacaagcagggttgtctgtgatcattcacgcacacacacattcagccctccagactttgaccaccaaggaagtactttactggctcccgtggtttcttcttcattggtctgtgcacagtcattgctgtggtatgtga

SEQ ID NO: 165813 - DNA, 417 bp, Homo sapiens
ttgaaccctagctggaatcctcccgtcacttagagtttatggttctaccttccatatgaatcttatatgctgtcaaaatcaacaagaaatgtaaatgcacatgccttgaagcactcttcatgtttccttctaccagtcacttccaagagtttcatgagacaaagtcagtaattacccaggcagactttaggtgttaaatatttttcaaacaagcccagttaatggcatcagtaataaagagcagggcaacaaagagattacagtgtttcattccaacccgacaccctcaggagaacagacagcacaaaggcaaacccataagtgtttatatactccctgagctgtacagagaaagttcacaggaagcagttaaagatgcagcaactaaacccaacatttaactgggtttctttggaa

SEQ ID NO: 165814 - DNA, 411 bp, Homo sapiens
gacaatttctttaaacattaaacatacaactaccttacaacctagcaattgaacccataggcatttctcccagagaaatgaaaacttatgctcacacacataaaagctgtacacaaatgtttatagaaggcttcttcctaatagccaaagtctgggaaaacctatgtgcccttctaaaggtgaatggttaaacaaaatgtgtgctgtgtatcatactaaggaatatcaacccagcaataaaaagtaacaaactattgatccacacaacaacttagataaatcttcagaggattatgcttttatgcatgtaacttcacagtataaaggaaatacaaacaatgtctcccttctctagtttattccacttaccccagtcctcctaggcttctgtgaatttcagaaagcaaaaac

SEQ ID NO: 165815 - DNA, 1726 bp, Homo sapiens
cctgcttccaaacgccttcttcgaggctgaagctgggcaggtctccagaggtgcagcagccacaacaatcccgcagttcaaagttaagcagcagttgcacaacttccagcaactttctcagccggctactaatgagctgaaagccaggaacatccgaggagaagagaaagcttccagccctcctcccttcaccctggaaatccagacacccccacccccaccctcagatcactttaagataatttctttattcgtttgcccgacagaccatggctccctttggaagaaacttgctaaagactcggcataaaaacagatctccaactaaagacatggattcagaagagaaggaaattgtggtttgggtttgccaagaagagaagcttgtctgtgggctgactaaacgcaccacctctgctgatgtcatccaggctttgcttgaggaacatgaggctacgtttggagagaaacgatttcttctggggaagcccagtgattactgcatcatagagaagtggagaggctccgaaagggttcttcctccactaactagaatcctgaagctttggaaagcgtggggagatgagcagcccaatatgcaatttgttttggttaaagcagatgcttttcttccagttcctttgtggcggacagctgaagccaaattagtgcaaaacacagaaaaattgtgggagctcagcccagcaaactacatgaagactttaccaccagataaacaaaaaagaatagtcaggaaaactttccggaaactggctaaaattaagcaggacacagtttctcatgatcgagataatatggagacattagttcatctgatcatttcccaggaccatactattcatcagcaagtcaagagaatgaaagagctggatctggaaattgaaaagtgtgaagctaagttccatcttgatcgagtagaaaatgatggagaaaactatgttcaggatgcatatttaatgcccagtttcagtgaagttgagcaaaatctagacttgcagtatgaggaaaaccagactctggaggacctgagcgaaagtgatggaattgaacagctggaagaacgactgaaatattaccgaatactcattgataagctctctgctgaaatagaaaaagaggtaaaaagtgtttgcattgatataaatgaagatgcggaaggggaagctgcaagtgaactggaaagctctaatttagagagtgttaagtgtgatttggagaaaagcatgaaagctggtttgaaaattcactctcatttgagtggcatccagaaagagattaaatacagtgactcattgcttcagatgaaagcaaaagaatatgaactcctggccaaggaattcaattcacttcacattagcaacaaagatgggtgccagttaaaggaaaacagagcgaaggaatctgaggttcccagtagcaatggggagattcctccctttactcaaagagtatttagcaattacacaaatgacacagactcggacactggtatcagttctaaccacagtcaggactccgaaacaacagtaggagatgtggtgctgttgtcaacatagttccaatggctcctttctgacctgctttcatgttttaatgtttgtttaatttaataggaaacctcattttaaatataacactcaaaaaaatgtaaatcatattgtagtattcaatagttaataaaaactcgagaaatgtgttgtttctg

SEQ ID NO: 165816 - DNA, 533 bp, Homo sapiens
atttaaacatcagctcttcagtatatggaagacccttaaacatttctttgtaactgcttgtgtgagtcaatcacccacgttggcaaagtttccaaagtattctgttgttttgacattgcatatatgcagcccaatagcagccaaatcagtggaaaacactcaccgtgtttaattgtaaccacttgagtcagactaaaaagcaaacaaggctaacgccatctatggaaacatcctaaattcacttaagaacctatgaccccactcccaagtatattcatgccgagtatacttttcacctacccagtgactccctcaattaccttttccttcctatcaccctcccaatagatatctaagaatagcagagaaatcttcatctcttttggaggagaatatcattttaatataatcaaagctccattgatgtctatgtaggttacatctattgcttccttcatatctgcatggcctgtcagtctaccatgcaaagatctttattaattctattatgatcatccttgttgtttgaactt

SEQ ID NO: 165817 - DNA, 220 bp, Homo sapiens
agtaaattggacaaattggcaaacagtttcagaattttaaatatgtacctcatttgacccagcaactccactctagaaatacatcctacagatagactttctttttgcacaagatttatatggaaacacagcttttaaaggcagcgttgtttctaatggtgaaaacaggaaaccctgcaaatttctatcaaataaaaaaatgattaagttaatagtggca

SEQ ID NO: 165818 - DNA, 251 bp, Homo sapiens
cttgctaatttttgtaattttagtagagatgggtgaatattggtcaggctggtctcgaactcctgacctaaggtgatccaaccacctcgacctcccaaagttctgggattacaggcatgagccactgcacccggctgtgaaatactttttttattgtggacaagaagaaggaaattctgtctatgccagtaagactttgtgctcctttaagacagactttcttttaaagtgtttttacttgcagaccttaa

SEQ ID NO: 165819 - DNA, 261 bp, Homo sapiens
aaggacttaactttatgactgtgtaagtgctaggattcaaactagctatgaggcatttccagggtctctcgtttctctgctgtctctgagagatctcaggagaagacagaggacccaagagggcccccagctgcctgctggcctgtgatcaggccctgagggtggaaggtgtcagacggcagagcgcacaggctgaaggtgggctgatctgctcactcactgcttcccaccatggaccagagcctgagaaacaaccatctg

SEQ ID NO: 165820 - DNA, 401 bp, Homo sapiens
tctgttctccagtattggcagaagccagcccaccatgtacaattggtataagagcctggttgtggttcttagaggtagctctctttctcgggctgggcctcctacatatactttacccttgacatactcagagcatgttgagtatcatgccctgtggtctgagtttaatgatcaggcacgaccttactaatgtttttagtgttgggttgtaagtttggaaagggttgaaaccatatctagtacaacttactggtagggagaagaatataatcaaggaagaaagtatgtttaggttttgtcacagaacagtgttaaaaaaatgtggagttcagtgtgagatagattgtaagaattcattatttcttttctaatctataaacttaattattgcattggctttc

SEQ ID NO: 165821 - DNA, 364 bp, Homo sapiens
gccatcccagcacgaataccccactcccactaaacacacagagtcacccaggttgcccacctcctagcacccggctaaagcttggggagtgcacagacttctgagatctggattaagagctcattcacacactgatctgagtaaccctccgagaagttttatccacaaactggtatatgcataatctaaatcaacaatcaggagtaaggtactggactcgagtttgaagtgtttgtcactaaactctctcaaactcttccaggctaactagcctcagagggcttctagcccatagtctccttgtattttctgccctcctcacttggagtgggagggaaccagatgtccagtgtggagagagggg

SEQ ID NO: 165822 - DNA, 469 bp, Homo sapiens
tctacaggatctctgacggtctgtaccccctcagtagatgctctgtgatgtctagctctgggtgagaatggctgaatccaaagccgctggtgacaaagtggggtgaattgaaatgaaccagctcccactgaggccaactggaggtagaaaggaagaaaaatgcctaagacaaggggaacgtgcaaagggacaaaacatagaggggtgagggtacagtgtgcccaaatgtctttattgatatctaacaccttttcaaaaaggatttgaggttgttggtggaaatggtggtgtggggagtgcatttccaagtcaagtactatttcccctatgctgaggcctgtgatgttgagatggagaaagaaacaaagaacagaaaacattttggttgccgttgtcttactttgaagaagaagcaattagtgaaagacataaaacttagcagaaggagaacagattttagatgttgtca

SEQ ID NO: 165823 - DNA, 372 bp, Homo sapiens
atagctcactgtagccttgacctcctgggctcaagcatcctcctgcctcagcctcccaagtagcaatgactgcatgcgtgtgccaccacacttggctaatttttaattttaattttttctagagactgggtcttgttgtgttgctcaggctggtcttgaactccgggcatcaagcaatcctcctgcctcagcctcccaaattgctgggattacagggcatgagccactgtacccagctacttttacgtttttcattctcacccctttcttctggaaacactgcagagaccatgagaacaggagcttgtcttacttgatagtgcaaacagtcttacaaatagtgttcaaccatcgattgcccaaaacacgtgt

SEQ ID NO: 165824 - DNA, 113 bp, Homo sapiens
gtgatttgtcagattaatattctacaccagggttgtccagtcttttggcttccctgggtcacgctggaataattgtcttgggcaacacataaaacacactaacaatagctgat

SEQ ID NO: 165825 - DNA, 456 bp, Homo sapiens
tattccaagggaattcaaaacccttgtcttcatgactttcaaaagcaacccaagtcctgaaaacaacatttttgtgaagtatattagtgtaatccaaaacatgataaacactttttaaagatatttgcagataagactcccctaccctcactgttacagtaacagtgtaattttccctggtattgctctgaacattaaggaattaaaacacttgaggctggatttgtcaagagacctatttttgttttgttatgttgtaatagctgttgtttctgatatttttctttttccttcattctgctttttctttctccaatcttggcttaaagggcaacttcctgtgcatgttcaggaatctgtggcaaagggaacaagtatgataatttgtctgctaccatttggatgttactattgtctcagcagccaggaaaacagacagagcccctgtgagcatca

SEQ ID NO: 165826 - DNA, 211 bp, Homo sapiens
tcaggccaggatggcagcaagggaattagtgaaaagaaggtgggtacattttgaaggtagagcagacagaatttaccataccacgtgtgagtgtgagagagaggagtcaaggatgatttgaagaacaaaactgaataatatgccctttctaaatttcagtataaataaaaaaaaaactatagaaaatgttatcactcagtcaaacactagg

SEQ ID NO: 165827 - DNA, 480 bp, Homo sapiens
ctgggacatgagtttgctgcctctcccatctgcaggtgtagcatggatgctcaattccatttgggccaatattcactgagcacccactatgctgaagttgggagatacctgctgtcgaagtgcgttaattacaaacacgcatcattcaaccccagaaccgtgtttgaggaatggcttgggaggataaagcactgtgggtttcaacagtggaggccacatctgctgatgggatgcttcaagaagaaaatggcatttgaggttgggcatgggggctcaccctgtagtcccagcactctgggaggctgaggcaggtggatcacttgaagtcaggagttcaagaccagcctggccaaaatggtgaaaccccatctctaataaaaatacaaaaattagccaggtgtggtggtgcatgcctgtagtcccagccacttgggaagctgaggcaggaaaatcgcttgaacccggaagacagaggttgca

SEQ ID NO: 165828 - DNA, 364 bp, Homo sapiens
caggactgcctaacttatcagcctagaacagacctttctctaaattacatcaatttataacaactattacatcatcaaataaaaacagcatctttatcatcccccctcagagaacttttgaagttgctacagatatgaatttctctccctttttaccttgtggtctacaattacaatttgccacctttttgatggtcataaaaatttatcttatcttctgtgactttgaaaaaaaaagcaattctagtctttcttttctcaggccttgccttgatttcccaagcctcaatcacatacaaaaacatacaatgatgggctgggtgcggtggctcacgcctgtaatcccagcactttgggaggccga

SEQ ID NO: 165829 - DNA, 463 bp, Homo sapiens
agagaagtgaggtcacaaagcaaactgctgcccccaaaattggacagataggccaatacagagaatgatgatgtatcagagcaaaaaatcccatggatgggaaccagtgctggggtaggaaaacctgaatgtaactgctagaagttaggtatggacaagtctgaaagttaaaaactccagtcatagaaggaacccccacactcttgtgaattttaactttagaagcttgacctagttcttacagtaaatattgggagaaaaatccccttccgtttccagcagtgggagggaaaaaagaacattttgaaatatgttagagaactcagttctcaacaaggtctcccttcaggagaagctattttaactagaagctaccctgctggggctttatcaaagcctaactgacctgggaaaaactcaatacccaatccagcccacctagccatcatggcccacctaagaa

SEQ ID NO: 165830 - DNA, 367 bp, Homo sapiens
tctttgttccttctctacttgtactgtttcccttgactagctttaaaaaaagcttttattatgaacattttccaatatacacccaagtgagagaatagcaaaatgaaccagacttttctaactattgaaatattataatgaggaatacaaaggaaaagatggacaggtataatttaaattttttcttccaaattttgactatacaaaactaaaagaagaatattaaattggaaacatacttagaattaatttttggtataaaatattaaaatttataatatatgcataatgtatatgtcagtaaagcaccaagatcctaaaaatgggcaaaaaatacacaccaataattcacaaagaatacaagttt

SEQ ID NO: 165831 - DNA, 314 bp, Homo sapiens
taccacaggccttaatacaacaacagcttctgtcctccaattttccattgggtcaggttcatgtcgctttagttattcagaccccagcatcatcgtgttatatgccaagaataactctgcggactggattcagctagagaaaattagagccccttccaatgtcagcacaatcatccatatcctctaccttcctgaggacgccaaaggggagaatgtccaatttcagtggaagcaggaaaatcttcgtgtaggtgaagtgtatgaagcctgctgggccttagataacatcttgatcatcaattcagctcacagac

SEQ ID NO: 165832 - DNA, 178 bp, Homo sapiens
ttctttttcattctctatgtctctattccacatgctgtttttcatattatgttcacataaccctttaacatccaggctactttcttctgaattaaacgataatgtacagctattaatatatatctggaaggctggtccaactgagaaacagccaccactttctcattctaaatgccag

SEQ ID NO: 165833 - DNA, 336 bp, Homo sapiens
cctgagacatttctctcaacatgggtagatcattggaatggcagtgtgtacagtgtgtgtaccagaacttgagaaatgtgaggtcggggacgggaggtggaagctcctgtgtcgcctgggctggggcctcccgcccagtcctcgcaggccaaagggtgacccatttcttttttccagtcaccaggagctcggatggtcactctgaggtgtgaatagatatgtttttccttcagttcacactgaattcaactcaaaccagcaaaggcctttgggctggggattctgtggttgcagaggtctagagggggtggacttttgcagccagtgtggagagag

SEQ ID NO: 165834 - DNA, 686 bp, Homo sapiens
cttcttttgagaagtgtctgttcatatccttgtgattttaatatagagaacagctaagcttacttggtttggttgtaaagagggcacagaacttgaaaaatgttttaacatacttttcgttttcatattgtacactagaatattttcagtgtatataaaattacatatactacttacagagaattcagaaaaagagaaaagtacaaaaataaaaattctctataatggtaccatcttatgactatgccataacttgttattttaagtttctttgtcatgtgtacttgtgaagctttttggttttatttttaaacaagtgttctgatcaaatttttgactttttttcttttaattttttaaaattatgcctcattttctaaaatttagatgctacttaattgtttctgctgtttgaattttttgtctttcttttttagatcccctattatcttttgttttctttctttcttaatttgttctctcctttttgtgtagcatattttttgatagtttcttgagaaaaagacaatttgggaaatatgtatttgagactttacgtgcctgaaaaacatgttgtagcttcttgcttaatagtttgacccaatttaaatttcataattgaaaatttttttttaagattttgtttctcgtttccaaagttgctgttgagaagtccagtgctaatt

SEQ ID NO: 165835 - DNA, 269 bp, Homo sapiens
ggaggggtgctagggacttcagatgtcatttcacaactttatacaaggaacaagatttttgtggcatcaatgcatattttctcattgtaaattttacttggaatacatagctattagtgttgataatttacaaataccctgttcaatttcaaaaatgatttttgaagttgttttcataaaagacaagttgatcataagtcctttgatgtttacacagcattttgaggccccttctctttttcagtggtatgttcttcccaaatcaattt

SEQ ID NO: 165836 - DNA, 398 bp, Homo sapiens
cacttgctccctaggagaagtggagcatttaaactaagacttgaaagtgtccaatttgtttgtggcactcctgagatgaaaacacattttcctcccgccaccaccgatggcttcacataccagaattcagctggaaacctagggaaaaaaactaaccggaagaagaaaaccatgaacgcttagaaatctggacccaaccacttgggatcctaaccactctgagagttggtcaccttttctttcactccaggataagcttgtccaccggttagttgatttgttgttgttgtttttataaaccatattcctacagactagttgatttttaaaaccaggatgcaaaaatataaggctcagtcaaaactttaaatcacaggacagagatgagatttaaaatt

SEQ ID NO: 165837 - DNA, 209 bp, Homo sapiens
agatacctctagaatggctaaaattcaaagactgagaatgtgaagcaactgtaactctcatatactgctaatgggaatgcagtggaacctcggaagataatttggcagtttcttaaaaagttaaatatacacctgctatgcagccactgttagatttttactcaagagaagtgaaatatatgtccacacaaagacttgtgcactgacat

SEQ ID NO: 165838 - DNA, 475 bp, Homo sapiens
tcagagaaggtgagaatgagagctatgtacagaatgatggagggaagcagtaatgaagacgaagggggaccctgggtgcagatgagcggtgagttgattggatgtgacgatgaagtgatgacatgttgttttctctgtttataaggtaacaaatttaaaatttgtttaaattatacagatgagaatgagagttgccaaactcctgtgtctaagtgtggtgacttttataatgatggcgtcagaggcagcttccctctgcaacccctcttcagccagaggacagtgacttatcagttgtggccccagtgagcctccctgtaacttggagatgaggggctacaccagaaaagctcaacccgagtgaccctggcccctgaaatgattggcaaaatagagtgcgtgtctgggcgtggcttttcttctgtgagaaaggagtgttcagttgtaactagaattttaaataggtgcagtaccc

SEQ ID NO: 165839 - DNA, 341 bp, Homo sapiens
ccactgaacccagcctgaacattatattttttttaatgaaggttataattactatactttttaagaaccctaccaaatggttgttcatattgagtgtatagtcaaacaaaaactttctgggctctttcattgaaaccattattaaaccagatctcttcaaccctgctagtaggctaattgagctgttgaaaccaagggcaggcatttacatttattctcattgatcttaattttcctggtttggtaccatcacttccggcttcttaagatatatttgaatcttattcgcaacatatatcccttctagccttctgttacttcgaaatatgataaccaaaaca

SEQ ID NO: 165840 - DNA, 386 bp, Homo sapiens
agccagggacactgagatacagagacactgagagacagagactctgagacacagagacactgagacatacacacagagagaaggcagcagggagaggagtgtagccatggttgtgaggagaacctgctgagatgagctttgtgagtgagcctgtgcttttggaggggagatgaaggcggcttgggttaggggatctcaaacccacctgggcaaagccagaccccccttggaatgggtttccattcacaagttgaggagggcaatgcctgcgccagtgaaagaggaactctcacggaggaaacaggcagatcctcatcacccttcagctcctcatgggcagctcctcatgggcagctcctcatgggcagctcctcatgggcagctcc

SEQ ID NO: 165841 - DNA, 124 bp, Homo sapiens
ctggctgagccccaagaagctgaagacggaaggcacgggcgacacacagacacagggaaaacatttgtcctggcttccccagcacaggggcagagggaggaccctatggaagccctcaggagca

SEQ ID NO: 165842 - DNA, 435 bp, Homo sapiens
tcaagtttacatgcagtgattgcttgtgtagtacaggcaggaggtacactgagtttacaagggagaggaatgagtgtgaattgacaaagagttgaggtcagctggtccggatggagaggaaataatatggggaaattgtaacaccaaggcgagagaagtaactgggttggacccagtttaaaatatgcaaaagtggctgggcgcgttggctcaagcctgtaatcccagcactttaggaggccgagtcgggtggatcatggggtcaggagttcaagaccagcctggccaagatggtgaaaccctgtctctactaaaaactacaaaaattagccaggcacggtgacaggctcctgtaatcccagctacttcagaagccaagggaggagaattgcttgagcctgggcggcagaggttgcagttagccaagatggcgcc

SEQ ID NO: 165843 - DNA, 215 bp, Homo sapiens
gcaagtgctgcagacatctccctaaagatgacaaccagaaacaaaatgcagacctctggctcaagtaaagccattcccaccaagatttcttatttggtggccacacccatgtcagaagagcatttcaggtctgtggcatccacacccgaaacattaattgctgtgccctgtgcagctgtacattcacaatctctaactagccagtggtaatggag

SEQ ID NO: 165844 - DNA, 594 bp, Homo sapiens
  misc_feature (576)..(576): n is a, c, g, or t
aagctacctctgaaagacatcatccattatctctccataccaccaccaaaaatttttgccaccccaacacttcactattttgttttatttttcttattaatataagaagacaggaatgtcaggcctctgagcccaagactgcaggtatacatccagatggcctgaggcagccgaaaagtacaaaagaagtgaaacagccagcccctgtcttaactgattgaccaaccttatgactttccattatgacttgttcctgccctgccccaactgatcgatcgaccttgagaaattcttctggacaatgagtcttatgatctccccacaatgcaccttgtgacgctctcctctgctgacaatagataaccacctttaactgtaactatccactgcttaccccaggcctataaaactgccccaccccatctccttttgctgacttctttttcagacccagtctgcctgcacccaggtgaaataaacagccttgttgctcacacaaagcctatttggtggtctcttcacacagacgagcatgacactgcagtctagttgaatgtctttcagaggtaagggatnctctagaatctcacctgc

SEQ ID NO: 165845 - DNA, 307 bp, Homo sapiens
agagaatcccatttcactaagtataaaagaggggattttagagaaggtctcagaagaaagagatgtgggggtttggtgaaactcaccagaggctgaaccctctccagcataacacagggattgggaggagcagggcagcattaggccagatgtatagcccagtgctgctctctctggacttgtttgctagctgagctcatccatttacataattttcagtgccatttctcagctaatgagtcctgaacttttgtcttgaggctagaattctccttcaaacagcagttttaacactcaacttctttct

SEQ ID NO: 165846 - DNA, 332 bp, Homo sapiens
ttttcacaaaaataggatgtaaaaaaattgagaaattgttagcaatgggtgacctgagttcatcaactccttggcatttgcagcctacctgtgcaatcataggagatggcctaaaggaaggacttgagaaactacatgatatgatcattaaaagaagaaaaatgttgcggcaacagaaaaagaaagatgaatatcaatacctattatatctgtgtggagtaggttttctctggtctgattttgacaaatagaagagtgtctacagcgtggtttgcctgcctgtctgccctcctggatgctattaaagctttgttttgttgaacaatcagatg

SEQ ID NO: 165847 - DNA, 212 bp, Homo sapiens
ggatcctccgatctcggcctttcaaagtgctgggataataggcctgagccactgcacccagcctcattcaatgttcccctcttatagttacatttcaaactgccttttactataccaaaaagtatagtcattaacatgtagtttatggaatactatcactgcagcactcatccaaaaatataatatggtatatggtatataataaaatataa

SEQ ID NO: 165848 - DNA, 355 bp, Homo sapiens
tgtttatggaatggaaaggaaagaaagaggataattggattccagggatttcccatgggtattcaccatacaagttacaaaagcccatggggactcttctacatcctgacatatagctccacagagaaagccagaagccttgtcaaacaggtaacagcccgaccatccagagctagatctgttgaacaaacaaagtgagccctcagaagcaattttcggcagagactattcccccagggcactgagggaccacagctgcctttgtggggagaacaaagggagtgacctgaccaccagagtcacaagaagtcacatctaggagtggatagcaacccttccaggcccgaggagagga

SEQ ID NO: 165849 - DNA, 391 bp, Homo sapiens
tgaatcaatcatctgttaccttaaataacttccaaagcaaaatacatatcaaaccataaggtgttgtttctttaattgtatgggtgccataagtctctttgagaaaactaatgataataatagtaatatttgtcatatacttgagtacttttaatttgccatgcacaactttaaattctttttttctatatgtctcagacagaatagatggagtgtgcaaggatagatggtgaatatgtattttggtaaatttgtagagaaaacgaagaaaacatataattcactaaataatgataatatccaatgtctgttgggggcaaagagcctagaatggacaaaagtagtatgtaaatttagaagggtgggagatcagatttaaggcatcctgagg

SEQ ID NO: 165850 - DNA, 236 bp, Homo sapiens
actgccaaagtgctgagattacaggcgtgagccactgtgcctgaccttccatgttttattcacttttttctttcatagggtttattttaggttctatgaccttgaaaaagtatctaaaaacatcattgagccttacctaagtattaaattgaaaaagtaaaaaatgcagtagcatttgactcttttctacaggagaaacttaggattcttgtctttttctctgccttgcctttgtt

SEQ ID NO: 165851 - DNA, 511 bp, Homo sapiens
acgtgtggggcaaggccaggaccctgccaggactggctgcttggctgctgctgcccacaaggctgcacaggtgcctcatgtcggtgaatctatctggtccagtgcttccctttatgcctggggacttagcctcctgcaatggcagcacatcaagaaggatccattgtataatgcagttcacaccaacaggtttataaaacctcaaggccagtgcattaatccataaagaatgatacaattgagagaaatacagatcaaacacttctgacagcaaatgtgcattttctctcccaagacagatccgtgtgggaagtcaaatcacaggaaacagatgttggttaggtcttaaaatgcattcccttgccagtccaggtgtggtggctcacacctgtaatccaacatttcgggagcctcaggtgggaggatcccttgagcctgggaggtgaaggctgcaatgagatgtgattgtgcctctgcactccggcctaggtgacagagcgagaccctgtct

SEQ ID NO: 165852 - DNA, 244 bp, Homo sapiens
agatggactgccctctgtgccaggaggtggctttgagatttaatcagcagggtttgtcaaatattcttttatccacacaagtgctttccctgagcagagtgcaggtcagtaaaaatgtcttcattgtaatacactgccagtgttgctttcgcgacaggcaaccttagccgttggtacaccctggtccaccttccatgtctgcttggttgcagagaacttgatctgaaccagctggtatcctaga

SEQ ID NO: 165853 - DNA, 203 bp, Homo sapiens
tctctccaccctgtgctgcctggggctggggagggggtaagctaggtaatgtaaaattgtccctcctatcctctttagtacatcttatttctgtggtacaccaaggtgctgtaatctctagaggttccttaactcttgcttcctgcttctgccatcgtggtcactgccagctaccgagatgggtgtcttcggcttcctgagtt

SEQ ID NO: 165854 - DNA, 186 bp, Homo sapiens
agtagtggaaaatctgacgttagtggcgtaaatattctgttttttataagacaggaattctgaaggtgggcagttgctaatatcaggttaatgacagtgatatcaatgttaagatatttgctgttctcttggctgctccttcaaggtggcagaatggctgctgtatcagccatcacatctgcattc

SEQ ID NO: 165855 - DNA, 850 bp, Homo sapiens
tcactgctacagctgctttttacccatgagggagacttcagtgcagcattatgatttgctgccaaatacataaaagcattacctttaataaaatccccaagacatttatgtggaccaggtgagggctaattctatcttttttgactctgatagctctttaagaattttaatatatggagggtattagatcatgtagtgttgattacatgtctttcattttatagacaggaaaactgagatctacagtagttaaaccccttggccaaggttacacagttcgcggccgatctcctgggtccttagtaaggctccttctacataccaccctagggaagaaagcgctgctagctgggacctggaactgtgtagcaaatgcaaatggctaatccccaaaggaggcagcaagctcaattctccggtcaggctttccccaaaggcactgcttcatcctcttggctgatgacaactacggtgaatttaatcatttgctactggcagtcaatataagtggtttaggcagcatctgatttaataaatcaaataaagaacgcagtaaaacttgatgtgatcatcagatctactgaataggacccagagaaacaactatgggctccagcacaaataccagaaaaaagaaaattctgtcttctctggcacctatctctggcttcctgaaatagtaaaacaggatttttaaatacttatctgtccatatttgttttacagagcattcttcctaatttatcttgtattcaatcagtacccttggagggggtattagttcaccttcctcactgcaaatgccagccattcatatttaataagcaataagaatcaggataatatgctt

SEQ ID NO: 165856 - DNA, 224 bp, Homo sapiens
caactcatgaaaagactggcagtcacctaatttcatattaatagcagatgagatgaatcatacaacacctatatgttggagtagatccaaccataggaaagagtggggtctctgatgtgaggacggtcgggctgtgacgcctgtcaccccactggtcaccagtgttgattcggctgatgtggctggctcagaggcaggtgtccccctccttccccactgttccc

SEQ ID NO: 165857 - DNA, 605 bp, Homo sapiens
cacagctcgtgtttattcagtcactgctccctgaaaaagtggtcctcaaagtgcactttctggctacaatggccacagaggcataaggtctgggttaagaaatatctaagactgcttcatctgtgttccaccctcatagactcatgagtcctttctcaagcaagcataaaatcaatgcaattgaatctttttgttgttgttgtttttacaaaacactttgtgcagaaggctgaattttaatctaagcaaattgtttctggtgattataggataactaaagtttactgttctagatcactctacaagtcaactttccttctctgattttagatctattcagagagcatctccactgtgaaaaacatttatgataatttgctgccactacacggacttccacaaactcaaccttccttaaccccagaaaccacaaactttcaaaaatgatgacaaggggaagagatgaaagatgctggagcaatgcagcataaatcccaacccactcctctgctctccacactgtatggatggaggtgctgaggaagttggtggggtgaggagaggcctgagaacactcactgatagcctccagtttggagtgacat

SEQ ID NO: 165858 - DNA, 471 bp, Homo sapiens
atttatttgtcagttttttatttggaaagaacttcaaaattatggaagaattataagaacataacaaagaacttatttgctttatcattctctctccccatttatatatgtgtatgtatatatggatgtcagaaatatagttagatatcagttttttctctgaacaatttgaaagaaagttgtagacatcatgtccttttatcctttgagaggaatcagcatgtattcctaagaacaagaatattctcttacataaccatataaagatcagattaaggaaatctaacactgatattaaaatgttctaatatacagtctgttttcaaattctgccaattgtctaaatagtgccttttatggcaataggccatttccctaaaatatccctctgagcccagttctggtcactgaaagtcacccataagaatattccttcaaacagaataaaagctatttgaagacggctatgca

SEQ ID NO: 165859 - DNA, 424 bp, Homo sapiens
acagaggtgttccgaaagtatggtaggataaaaatttatttttctttagactcacatagatgattcagacctcagaccagatgtgttctcagaaaagtcttccctgacattcaatttacagctacccttccaaatctcttttatcatatcatgaagtttttaagagtttcattgtcttcagaacacttatcgctatctgaagttacctatttatttcttccctgtttattgttcttattaaagtgtggaccccaagaaagtcaagatgttctttctcttagaggaaatagagtgtaatggtttggtgcactagggccagactgtctccacaactttccagtatgatattgacaaagctgtttcacctctttgtaccctgaaatggagctaataatagtcctaacaggcaacaatagttattgca

SEQ ID NO: 165860 - DNA, 348 bp, Homo sapiens
acctttcggctacctgatttggataaatggagaaaaaccggggcctctaactcataatgccctcccgcgttcaagatgccagttttggggcggagatttctaaattaaagcctacatcccgcgcgggaatatctgctggtaatttctcgcctgccagaaaactcctttgatctctggctgtggagactcgggacccctacccaagtatgggacactgcctccgttggggttatctcagatcaatggaatgggaacaagctatccggcctgggcgccgttcacgtctcacatctgagatcgtaacaccgactgtgcttaggacctcagcaataactttttgccgtctct

SEQ ID NO: 165861 - DNA, 269 bp, Homo sapiens
gagcccagatgcctgaaacaactgagaacaaaagaagggtgagtggcctcctacagatggcactgttctgcaagattgggaaaaggcttggaacctttccctttaggagggaaatgaagtgagccttgtctctaacctttcagtgtggtacccaaagggctcgtttccatctcaattcatgccacctactaaaggactggtggagcctggatgcctgtgacaactaggaataaagggaaatgagtgggtaccctctacagcaaacagta

SEQ ID NO: 165862 - DNA, 261 bp, Homo sapiens
tccaatccagagacctttgtcgggaattctggctgctgccatcaataaaatggaagagaaacagccaaggtaactgagttggagtcccaactctgccattaataagatgagtgtgcctccaaggttcagaacttgtgggtatttcaaacattgagtgggaacttctagaaggaaagagctgccataaagaagccccacgagggctgaagagctggcaggggtagagggcccaagtcccgtccgctggtcaggaggcttttc

SEQ ID NO: 165863 - DNA, 155 bp, Homo sapiens
atcttgagttgatttttttatatggtgtaaggaaggggttcagtttcaatcttctgcatatggctggacagatggaaatttcaagtaaccataatagcaatgtattaagagataatagcatatatgtcaataaaataaatgcatggcagtaatta

SEQ ID NO: 165864 - DNA, 477 bp, Homo sapiens
tcctcacgataagtctgtgaggtgcaggtgctattaagcgtctcaccttatcgaagcggaaagaggcccggaggtgacccagtgcacctgccagcaggtgcacgactgtgtagggagtgaggattcacaccaaggggggcagtccacctcgtttgcccacggcattcccgtgttgcagaggaggattccaaagcttgtggttttgttcatttgttttcatttgtctgtccttgcattcctctcctcccaacacatatttactaagcacctactgaatgctgtgcactgggcaaggaactggagattccaagatgagtaaggtgtggcgccccttaatctggtgagggaggtggatgggcaacagctgaagggtgggcggtgcctgatgcaggtggagggactccgaggaggcttcccaggggagtgtccaagccaagcagtggaaaaggcagagttaggtcaggaagcaggaggcat

SEQ ID NO: 165865 - DNA, 155 bp, Homo sapiens
gagaagtgaaaggaggtcatcaaagaacaagcgttagcctcaagctgcttgctgtcccccttaacagaggtggaacacggaaaggtggagatgaaagtttggttttacacacgtttgagtgttttttgcttgcctgtgatctctctcaggttgtg

SEQ ID NO: 165866 - DNA, 425 bp, Homo sapiens
tgccatccatccagaaatgccccaagtgtgcactaaacccaggaaagacctgagataggaataatctaggtagctttaaatgttcctgttctctaggatccaaacttagccatccccactaagatgctgggcaaacgttctcattggtacataagcatcacagaaggctggtgagaaggggaccagccttttctagtcattatcaaataatacagcagcactgtgctccagcctcacaggctgctatctgatgggacgggtgtgcattttggccactgatcaaaagaccttggttatcacaagaaccttatcagaaaagccccacagcattaaacctgagtgcagtattcaaggcaaggttctgatggatttgttcaatggctatgggattcagatggcagacactacatagttgcaaaagcttt

SEQ ID NO: 165867 - DNA, 330 bp, Homo sapiens
actcatggtaattagtgtttctaaacaactactgtaggcatcctagtaaaaactaagatcaaaacttactgtgttctgagagagtaaagacgtactctcactcttcttttttaaaattcaaaagaaaaagtaagcgagactccgactcaaaacaaacaaaaaccaaacctctccttacatttaatctatgctgaaaaccagcatgagtcctgattcacgggtcttctgctgaagcaaattctagcaatataaaacacagctgtgtcctggaccccttttctgtatttctttctttttttattttttttttttgccccgagacggagtctt

SEQ ID NO: 165868 - DNA, 249 bp, Homo sapiens
ctaacaagcctcccaagggaagtcctccataatgctgacacaaggtctggcacacaattggtgctgaataaatggatggtcagtaccacggtgaagaatggaatgaggacaggagcactggctcatgccagtagtcccagcattttgggaagtcgggggggcagatcacttgaggtcaggtattcaagaccagcctggccaacagggcaaaacccagctctactaaatacacaaaaattagctgggcgt

SEQ ID NO: 165869 - DNA, 238 bp, Homo sapiens
ctagggtcttaagccagctccataggaatcagctgtgtgctgtgccctctaacaacacaaccacagtgtctagaatctacattttaaaagataaccttatttttggtcctctgatctggttaggtaaatctgacattaacattttagttctgggtagaaacctggcattcatgcaaacaaagcaggacttggtgtctagaaaaagacgacatagctgggcgtgatggctcattgaggt

SEQ ID NO: 165870 - DNA, 440 bp, Homo sapiens
  misc_feature (103)..(103): n is a, c, g, or t
actgtctggcactccctagtgagatgaaccccgtacctcagatggaaatgcagaaatcaccgtcttctgcgtcgcccacgctggaagctgtagaccggaactnttcctattcggccatcttggctcctcctcgcagcaatccagcctgaaggacttagctcatagatgtcttctgaaatgtggaagaaatactttcgtttgtcataaaacctcagcaggagattggagtctggaagagggaggggagaagaggaggacctcagggagagattgttttgcttattggtgtttaattaaaaaccaaacaacttttcctattaacttgatgctacttattaattgaaatgaggagactgactctggatattgggaaaatttatgggcacatacagaggaaaagacatgtggggacataatgagaggacagccatctgcaagcc

SEQ ID NO: 165871 - DNA, 504 bp, Homo sapiens
atggagatgacggcgcttgtgagttaggtggaaagctaactgagaagctgagagaggaggaagaatggaaaaatcaccatttagtatgaaacatggagacggagatagcccgtgactttgaccgggccacctcagtcattgtgtaggacaaaagtcagattggaatgtaaagaggcagtggaaacgtcaatatgacaactctgttctctgacttctaaaattctcttttaattacctctgtcagtgaacatgattcagtaaaagtaattatgtggggattttgacggaaggggccaacaaaatgttagaaccaccataatgtggaggacaaagcactcagcattctggtttactctgaggactgtttaaaagtacaaaatgattggacttggtggtgaacacctgtagtgtcaactactctggagacagaagtgggaggattgcttgagcacaggagtatgcttctagcctggacaacatactcaggcactgtctccaaaaaaa

SEQ ID NO: 165872 - DNA, 177 bp, Homo sapiens
ccagaggaggacatggctgcccactggaggtcagccagtgactgcccagcacagtatcccccaaaaaaggctcagaacaggtcaaaaactcatagcaacccggtggactgctcaatgttgaaaaagcaaatttccaggaactgtccctaaagatctattcttccagatttttcttgg

SEQ ID NO: 165873 - DNA, 109 bp, Homo sapiens
ttaaactctcatgcaggccaggccaggagaaggacatgtttagagaccattgggagcaaggtggtacactgtgcagtgtctgcaactcagacacacacagcaaatttca

SEQ ID NO: 165874 - DNA, 287 bp, Homo sapiens
acttgatatgcataaaataagtaataatgacaaaccacagaaaaagattgataaaatgaatcgtgaaaatatgacaagaaaaatgcagttacagattcaaaaaccaagaaacaatacaaagaaatgtaattacatactacttgcctctgctgtgaaaaatattacatgatcataataatgtagaaactattcattaactttttttttttttttttcactctgtcacccaggctggagtgcaatggcaccatctcggctcactgcaacctccgcctccggggttcaag

SEQ ID NO: 165875 - DNA, 371 bp, Homo sapiens
tgctctttataaaaagttcaaaggaagatagcaataatatgaaaccaatagttacaaaaacagaaagaaaacccatcgtggtaggtatatctgtgaccagaatgactacatgttaagagtaaaggttaataattaaggcttatgacaaaccgatgaataaagattttagctgaacccaactgactctgagatattaaatgaatatatacgtaaaaataaaaaatataaaggtattgcacctattgtgcatggattttttccctcactttttcctcagaaagtaaatgacactttaaaatggatactagtagaagccacactgtggtatctatgatagaaaggaatatttcatacatgtggaagcccagaga

SEQ ID NO: 165876 - DNA, 354 bp, Homo sapiens
ggtgacaggggtgggcctggtacttctctaagctgccagtgggcctcctgagtagccatgctctggtgagtgctcgggcacacggaggctctcgaggatttggccaggcgtaatgagatatgtggcctgcaggcttgggtggcactggagtcacgtgtccctctgtatttttagctgttaattggagggatttttcagccttgttcaatcaggtgcctgaacatctaggcccttgggctcctgactcctgagtcaggccagattgttgcttgaggctctgcggtcaggcttgtagaaagcagctcagagccctgccactgctagcgtccctgtgctgggcggggtacctggtgc

SEQ ID NO: 165877 - DNA, 1150 bp, Homo sapiens
aaaaaaaaaaaaaaaaaaaaaaaaaaaaaaaaaaaaaaaaaaaaaaaaaaaaaaaaaaaaaaaaaaaaaaaaagaactgctgcatgatgctttcacttatggattgttggctagacttaagatacctggccccaaccatgtggcccccagctctgagaagtatggtttttgttttgggtggtcaggaatcccgctaaaaatcagatgtctctgactacagagaaagtattagggaacaaccagcagttcctagcagcatatttcagggaatgtgatttggcatataatctaaatacacattggtatctccccattaaatttaatctaggctgcatattttgtaccatcatctcattatggtgtcttgtaattctttccacttttctttccaaaggaaaagcggtgtctgatttggcaagaatacatttctgcattcaaagttgaaatgtgaagataaacctcacccacttggaataggataaaagaaaatcccctggatagagggaaatatgcaaacagttctattaccatgtgtatcttttcctgagctgggtctttatgcaacaaaggaactggaggtaatccatgccttaccgtggagtgttcctgactcagcaaccagatcccatcatcacagtaataccagaagaatggaaaaaggtgcaaagactggactttcagaggaatctgttgttgtttttttttttttttaattttaaagcttaggtctgaaatgggcgcgttttaaatatttcagcacagtgcctaagaggataggctgcaaagtcagctaggcccgagttgagaaatggcatttctacttacagctggctatttttgaacaaataatcactgatctcagtattatagttgcctagcttaaggtgacaacacacaaagtggatcctgggcacgttagagggaatccatttggcccaattgaaatttggacaacattgcctaacacccggaaagcaagatgcttgttttaatttgtcaccctcctaacaaagggtggcgtactaacagattcaggccatattttgagtagaaaagagggacatttatcttttcacagaaatctttagggatatcgggcactcactttgtgacacaatgacaactattgggtcaccctttcccaaaattg

SEQ ID NO: 165878 - DNA, 190 bp, Homo sapiens
gtcagtacctcagttagataatctaggcttctgcaatcatactgaagtgtaatatccatacaacaaattgcacaaatcacagcatgtaacttgctgaatttttacacagtgaatatgccccaaaaaccaatacccagttctagaaatagaacattagcagcccctcagaagcccctcaggaggctgcttt

SEQ ID NO: 165879 - DNA, 428 bp, Homo sapiens
gataaaacagtctgtgaaggagtattgaacatttatttatttatctatttatttttaatgtaggtaatgttttctaaagagacaggtctcactatgttgcccagtctggtctgaaactcctgagctcaagtgatcctcctgcctcatcctcccaaaatgttggaattacaagcatgagccaccatgcctggcctaaactctaaaagcctgggcaaaataattcagagagactgtaaataaatggcctccttcaataaaacaaattataaaatttctaagatgttagatgttgaagagctctagaaagaaaatctctgagtgagagcaattacatttaaagaagccctgagtctctcacttgagttttttctctagagctgcattgtttcctagtgtagccatttaagtcaaaattggccatttaagtc

SEQ ID NO: 165880 - DNA, 371 bp, Homo sapiens
tgtgggaatcagaatgtgtgccttactgtagcacgaggtggttgggaggcccatatgacataatgtgcatgaaaatgctttgaaaactttcaggccatttaaagtcactaattgaacttcgacaacttcttgctgctggaatattcctttcttccctttcttaataaattctgcccgtcattcaaaggcttctcttagctcttttttgatctcaaaggtttctttggagcccccagaggtccctctcagaaagaggaagtgagcgaattttgccacccgtgtccctcctgccccacccaccagatgacttcactattacactccatgttttcacacctccacgctctgcccagttctgtccctgtgctctg

SEQ ID NO: 165881 - DNA, 131 bp, Homo sapiens
gtgatccaccaacctcggcctcccaaagtgctgggatttgagccaccgtgcccggccctactcttgattaaatattttaaaggaaggggttagtcttttagaaggtaactaggggaggagtaatactctta

SEQ ID NO: 165882 - DNA, 844 bp, Homo sapiens
caatatccctgaggagcagcctgtggcttcaacccccaccacagtgtcagatggggaaaacaagaaggataaataagatcctcactttggcagtgcttcctctcctgtcaattccaggctctttccataaccacaagcctgaggctgcagccttttatttatgttttccctttggctgtgactgggtggggcagcatgcagcttctgattttaaagaggcatctagggaattgtcaggcaccctacaggaaggcctgccatgctgatggccaccctgtttctcctggagctggagctgcgcgtgttctcagcaactgtggtggctgtcctgttttgtttgcatcttataaacctttacctgattacattttcctcttcagtttagctgctagagaacttaaagtcagattggtggctcgccagtaatgagagtttagagtagaggtaaactttatgacatagtcttagactcttccgtttctcctcagccaacatgattcacatttactttattttgctgtactgtgagtgtctttgtgtttcctgaattccttctggaataaggcaggctggtagtaagcacaggtttctggtccatctcatagcctcaggcagtgggtggtgctgtccatgctccctttctgggttacctgtggtagctctgaagttgcagggctgcgatttgaagcctgatttagtacaccgtgtttctgtcatgttctgtggtggtttgctcctgacatgtgagcattcaccctgtggccctgtgtttttccaccacacctctgcctggtggcatcctactggatgtctcagccgagccactctgttctgaagatgccct

SEQ ID NO: 165883 - DNA, 160 bp, Homo sapiens
tcaacagtaagctattagtagttagcctactgttagtagaagttaaagtagcattatgaagtgagagggaacaaagattttacaaggaaaatgaaaacaggaatacctcttaaaaacgatcaaaatccctacaaacatttaaaacaactttaccttacag

SEQ ID NO: 165884 - DNA, 382 bp, Homo sapiens
catgacagattttcattatgacacagaatgtcaggtctcccagatgccagaaaatacatttacttaaagccgttgatacgtcttaaagcggtttccttacagtgtcattggaggacagtgtggagtgcagagagacatgctttgaaatgggattgatccagtgctccttccttcactaccacatgaatgctgggcagcccagggtcaacccaccgcaccctcaactcagacggttacctggcacgctggccacagtctacctcactcttatcagagtctgagctactggcagtgctttcagctgtgagttcaggcacctcaaaccttgtttttgtggtgaaggatcctaaagtgctgtggggagtgatcacatttttcacaa

SEQ ID NO: 165885 - DNA, 251 bp, Homo sapiens
aaaagtacagaagcatattgaatcatatcactactgtttaaaaaataccactgtaaataaactattatgaaaattaaatatagcttaattcatttctatctcatttaaatactctgttgtgcatatattttctaatatacaaaataggttagtacaagtagtggatgcatatgatttgtaaataaataaatatacacatatcgaggtgccagtcccctcaattttttagagcaaaggaataatcaaagagg

SEQ ID NO: 165886 - DNA, 303 bp, Homo sapiens
ccagagtatcccccgccatttacaactatctagacaaattatatcctgtcaaattgaagaaaatgagttgggccttattttaattgtaatattatactaattgtctaggttgtcgtaaagggtgatataatgaaaattgaatagaaaatatgacttgtattttgaaactttacatcttgaaaaaaaaggaacataggatgagtgataattttgggatggtgagttcagcctgggatcttttgaatatgtgctgttggcaaggcactgttgatggaaatactaagcagatagttgtaaatggcg

SEQ ID NO: 165887 - DNA, 381 bp, Homo sapiens
acactagaataaaaagtgatgttagaataagtaatagcaggtcacatttattagtttttgatttaagcaaaagggaaataattttagccaaagaaggaaaactatgagaagacaaattatatcctgtcaaattgaagaaaatgagttgggccttattttaattgtaatattatactaattgtctaggttgtcgtaaagggtgatataatgaaaattgaatagaaaatatgacttgtattttgaaactttacatcttgaaaaaaaaggaacataggatgagtgataattttgggatggtgagttcagcctgggatcttttgaatatgtgctgttggcaaggcactgttgatggaaatactaagcagatagttgtaaatggcg

SEQ ID NO: 165888 - DNA, 389 bp, Homo sapiens
agatctcacctctttctagctgctcccatgtttcctgccctgattgtcaaggtagcttcactcccagtttaagtatctcttttttcagtgaaatgttcagccctcacctacccagtgtgctcctagaacaacttctcctaggtctttctttttttttcttgagacggagtctttaaaagagcagattgcaaggcgtaaattccggccagacacagtggttcacacctgtaatcccagcactttgggaggccaaggcaggtggatcacttgaggttgggagtttgagaccagcctggctaacatggcgaaacccatctctactaaaaatacaaaattagccaggtgtggtggcatgcacctgtaatcgcagctactctggaggctgaggc

SEQ ID NO: 165889 - DNA, 268 bp, Homo sapiens
catggtatgtttaaatgtgggtgtttatcgactgagtgtacatatgtgggtgtccacatatggtgagtacaagtatatgtagctattatttactggtgatccagtttgtagagatgttctttttttttgaaatggaatctctgtcacccaggctggagtgcaatggcacgatctctgctcactgcaacctctgcctcccaggttcaagctatactcctgtctcagcctcctgagtagctgggattacaggcgcccgccaccacgcctg

SEQ ID NO: 165890 - DNA, 476 bp, Homo sapiens
cgataccaaattactcagtattagaacaattctcattcgataccaaattactcagtatttgaacaattctcattcgataccaaattactcagtattagaacaattctcattcgataccaaatcactcagtattagaacaattctcattcgacgagcttgtttctgactcatcgtagcaacacccagtcatgcgttcatctacgttagcgtttctacgcagatggcgctttccagtgttcactgcgttttcatctgataagctgtaatcttaaatttggaaatgtgttgctttcttacattcctttaacaagtaaaaaccaagatcaacccacagcctgcaattaaaatggataattaaaatacaacatatagatgattaaaatacaacatataaaggagttaaaatgctttggttgtgggcatgagttctgaagaatccaacttttcatatgaatattcagtctgtgtcttacgtc

SEQ ID NO: 165891 - DNA, 552 bp, Homo sapiens
  misc_feature (19)..(19): n is a, c, g, or t
tacatgatacgaatcgagncggtaccctcgcgaacgtgttatcccagctacttgggaggctgaggtaggaggactgcttgaccctgggaagtgaggctgccgtgtgccaagatcgcgccactggactccggcctgtgcaagagagcaagaccctgtctttataaaaaaatctaaaaacaattgtcttatttctaactctgaactactttctatgctttggtgacatctatggtgaaaattgaaaactagcattaacagctagaaagaagcaaaggatttttccacatgaattccatctttcttagctttgcttttatttcacagaaacagaaaataaagaaaacctaatcagttaaattactcctctctggtgtcacatcctaataaataactgttatccttatgtccttcaagaaagaaatgatactagtaggacataaggataacacgttcgcgagggataacacgttcgcgagggataacacgttcgcgagggataacacgttcgcgagggataacacgttcgcgagagataacaccttccgagcggat

SEQ ID NO: 165892 - DNA, 631 bp, Homo sapiens
gtgcaatggctcacgcctgtaatcctagaactttgggaggccaaggcatgtagatcacgtgaggccaggagttcaagaccagcctggccaacatggcgaaaccctgtctctactaaaaatacaaaaattagccaggtgtggtggcatacacctgtaatcccagctactcaggaggctgagacacgagaattgcctgaacccaggaggcagaggctgaagtgagctgagactgcaccactgcactccagtctggacaacagagactctgactcaaaaaaacaaacaaaaaagaaatgatgattcagctttggggagtgatgacaaatgaaacactgaagtcctaaaaaaatgacaaagtattactacaagtagacatatcagtacatacaattggagcacccaaaaaaatgaaatacatttctggaattttttaaatagagtaaatctgaaacaaaaggaaccaatttagaaaatatcatatgccaatatccttaaatcaatagatgggatgtttagaactcatctaccatagaaatgataatatttacattacagacagtgttttataatatttacacgtaatgctcacccactagtatttttatccctatttgtaaatgagactgaggtt

SEQ ID NO: 165893 - DNA, 760 bp, Homo sapiens
tgacagagtgagactccgtctcataactaaattaattaagtaaataaaatcaggccaggcgcagtggctcatgcctgtaatcctactactttgggaggccaaggtgggcagatcagttaaggtcaggagtttgaaaccagcctggccaacatggtgaaaccccatctctattaaaaatacaaaaaaatcagccaggcatggtggtgggtgcctgtaatcccagctactggggaggctgaggtaggagaattgtttgaacctgggaggcggaggttgcagtaagccaagattgcaccactgcactacagcctgggcaacagagcaagactctgcctcaaaaataaaaagataaaataaattcctatttgcatttggataacttaggagaacctgtcttccccggtttgctgacggaaagtcaattgtctgaagtactaagctgacattctcagtttttgctttaggtttgggtattcatttaaataataatctcacaaataatgaaatagtttctgggggaaaaattattataaccttatgcccatatctaaccccattcccttgagccctggtcagtgccaagtgccagtagcttggcacaaacattagtgccctgccaaaccccaattcctctcccactcttttctcacatagctcagctggccgcaccttcatggctaaacaacctgagctcttggagatgccctggctcccctctctctgctccttatcacacaaggttctaggcagctgatgaggc

SEQ ID NO: 165894 - DNA, 279 bp, Homo sapiens
aagtccttctgggctaaaaaactaggagcttaggaatatgggttccatctctagttcctgatagttcactgtgtgtctgctgaaagattctttctgtatttaaatgttttgattttatgacttaatgttttccccaaatataaaaattgtgttcctgtgtaacacatcacataaagacaacaaaaaatataagaaaatgtaaacaaaattcatgtgtaagatactccaccctcaaaaaccccactgggaacatcttttttttttttttttttgaggtgg

SEQ ID NO: 165895 - DNA, 104 bp, Homo sapiens
agaatttagcccagggcccagcagctataatcactcatgaaatattagcatttgctataattgcttaatctaactgccaattatacctttacttaatctgttct

SEQ ID NO: 165896 - DNA, 267 bp, Homo sapiens
cgaattctttttcttttcctcactaaataatgtatcttctttcaaatttccattaattaaaacctagcttgattttcattttggcatgatggcttgtgctcctaatctgaattactattcactttttctgggctccttccttttgttgttaattaagaaattcaatccacaagaatttattgagcatcgactatttgtaaaggctttttcttgttagcttctttatgtgattactctctgttctctatcattttacatgcagatgca

SEQ ID NO: 165897 - DNA, 376 bp, Homo sapiens
ttcaagaaaaactatggcttctccagtgggattcaggaactagaggagagaaacccagatggttaggacagacgactcatttgctgatagaagagacggagagatgaagatgaaaataatgagcattctcaaagatgtgtcattgaaacaccacaaagatcttctggacctacgttcatgatgtctgcactgaaatagctattagatgaatgagggaaaaatggcataattcttgatagcaactgaattagagagctgcaggattaagtaaaaggaaatacaacatgccgcaaagatggaaacacatgagtgaaaacgtaggtgacttaaagcacagatccaggaaatggaacatgcaaataataagccatccaga

SEQ ID NO: 165898 - DNA, 391 bp, Homo sapiens
agcaaccaggccccgcccgtcatcccggcacggctgtggaagcacagcacctgtcagaggagggcccggctcagcctgggcaggagacggtgccagccctgccccctctgaagggcctgctggccacccccgccccagtcctccgacaaacttcgctgcggggtcaggcttatccagaaatcgtgcacagttctgtttgtccaatccctgcccttcagatgtttttaaggtttgggggccgtaggtcttcctgagataggagccctgcagcctgccctgccatcctagaggtgggagctgcagtgcacctggcagccaggccctggccagtcgagggtggggctgtgaggcagcagggagaccttcgtgctcccagtgagcggagccgact

SEQ ID NO: 165899 - DNA, 300 bp, Homo sapiens
tgtgcccagcctgggcagcataacgaaatcctgcctctacaaaaaaaattaaaaagcagccaggtgcggtgcctgtagcccttacatccagtctgattgggctagcttcgatcatattccctctcaggacaaacaacagtcaccaaaggaatgctgtgctctgacgagctgagaatagttagagttcactgggagtctaggatgggatccggttttcccgggcctgccagggcctcatgtaactaaacaaaaccaggacttcactcagaggaaaaataagataatgggcacactatggag

SEQ ID NO: 165900 - DNA, 108 bp, Homo sapiens
atattttgttaattctattccagaaaacttttttgcaagttgttttatttacaatgccaacttttaaaaggtcactaaagttaactggacaataaactaggcagacat

SEQ ID NO: 165901 - DNA, 390 bp, Homo sapiens
ataatgccataccagctatctaagtatcctttaattcagtcagatggacacctaaaattagtcatgacaggtcctttgcctcttttaatcaggttgttttcttgcttttgagttgagtttattatatactttgaatataaattctttatcaaatatacggtttgctaatatatacatgtgattttttttttttctgtgcaaaagctttttcatttaatgcagtcccatttgccagtttttgtttttgttgcttgtgctttcaggtcatatccaaaaaaatattgcccagaccagtattgtggtgcttccccgccttgtttatagttttataatttcaggtcttatatttaagtctttaatgtattttgagctgatttttatatatggtat

SEQ ID NO: 165902 - DNA, 205 bp, Homo sapiens
aagcaccgttttgaattgtccctatcaggaagcccacaactatctgaatatgagtagattccagatcaccaaggcagaaaacagaataaggatgagggaggatggggagaaacaatgagagacatagcagtaaaatccttaagcagtgaggttggagattcctgttttcaattatataacccctccctgaataaattcacagtta

SEQ ID NO: 165903 - DNA, 306 bp, Homo sapiens
tttaagaagctttctgttgcttaaccagtctccttagcaaatctggactgctgccttaagtactctggcattaggcagttagattgctcggtgtgatatcagcttgtcacaagaagctcagctgcccacctttcagtttattgcagcctgataggctttatacttaacaaattaagctgaatttctgacattgaaaacaaaaccagtcacaatgcagtcattattagaaccaacacttggagcataaggtgacttgatttgtttaatttttttttccagttcttgccacacagcactaaatttaaa

SEQ ID NO: 165904 - DNA, 790 bp, Homo sapiens
  misc_feature (708)..(708): n is a, c, g, or t
  misc_feature (711)..(711): n is a, c, g, or t
  misc_feature (715)..(715): n is a, c, g, or t
gtttagtatttttctaaaaaaattaactcatgtttgtgtatttatttatttattcatttatttatttttgaggcggagtctcactctgtcgcccaggctggagtgcagtggcaggatcttggctcactgcaagctccgcctcccaggttcatgccattctcctgcctcagcctcccgagtagctgagactacaggtgcccgccaccacgcccagctaattttttgtatttttttagtagagacagggtttcaccatgttagccaggatggtctcgatctcctgacctggtgatctgcccgcctcggctcccaaagtgctgggattacaggtgtgagccaccgtgcctggctgtgtatttatttttgaaagataaaagcttgtaaagctattaatttgcctgtaagtgtaactttggctgtgttcatggacaaagttttggggaattggagagataatgattgatatttgttaagaattattcccttttattaggtgattttcacccattatttaatccccatgacaaccttgatttcttcttccctattctggatttgaagaaacaggtagtacatttttcccaaagtgatacaatatggaagtaccagaaatggaatttaaacttagtgctgtctgattccaaacatgttttctttagtcttgttagaaactcctgagtgttctcattgtcatatttctgaatttanagntgantcttgggccgaagtttttttgaagacttatctgggatggaaattcttttttaaccggggggggctccgggaatat

SEQ ID NO: 165905 - DNA, 505 bp, Homo sapiens
tctctctctgctggattgtctctcactctctctctcggtctccctcttactgtctctctcactgtctctcttgctgtctccctgtctctttctctcactctttctcgctatctctgtttctctcaacgtctctgtctctctcgctgtctctttctctctccatctctcgccatctctctctccctctctgtctctgacacactctctctatttctcccatcctcccctccatggggctttcctgtttcctttccatcctcaccttcactcgctctttcctctccgttttctccctcaccccacaagctctctcccctcgcctctagtcccccaagtccttcccagctccgcctctccatgcccgctccttcctttccagttcctctgccagtcattgtccttgacccttccctctcctcgtctctgctcccaccggctcgtctgagcctggcgctgacagccttctccgtcgacgcggccgcgaattcagtagtagtagtcgacc

SEQ ID NO: 165906 - DNA, 538 bp, Homo sapiens
aaggcaggaaataaaacaccacttcagacactataaaaagaaagagatttattataggtaattaggtgctagcccagaggagttgttaagagccagagcagcaggctctaggctgggcttccaaggaggcctccaatggaatggctgggttttaagcccagactgctatgtcccagtgcaaggatgggaagcccatggttgggatctggtgtgtactcggtccacttcagcagcgcccggtcaaactggattggaaccttggttgactgagtttggcctggcaggcttgaatcagcatctcccaggagggtgggggttgcaagcccggtcctgggcaagggctggtagttggatgtaacttggtttgttctcctttgcccttttattgtgctggtgaggggtgtgcacattactgcctgcagatacccagggtactggtgtccagcatgcatgcacctgggaatgggcccgggtatgggtggggtgtttgtacagcatgtgtgctcatgctccccgcttctgcatgccatagccactc

SEQ ID NO: 165907 - DNA, 149 bp, Homo sapiens
atatgttacagtacaggggatgtaaggatcctgcccctacaccccaggagtttctgatctgttctttgacgaccccaggggtgggactactaagaccctagtccaggtgttgccaatgtgaaggtgttgggaggtgatcgggccacaag

SEQ ID NO: 165908 - DNA, 249 bp, Homo sapiens
tttctcttctaatttccttctttctggggtaggtgaaggaaataatcatctcctcaagcttaaaagctgaagaaatactttaccttcttacccacaacttaagctgttactaacttcagtctcaaaatggctctttttcttccttttgcatttttgtggctaaagccctgatccacattactttcagaattagattaatagcaaattgcatgccagacactgcgtaaggggcttttgtatccagaaatg

SEQ ID NO: 165909 - DNA, 298 bp, Homo sapiens
agagcgggtaactaagggcaaggaggcgcaaagaacaaggaagttagactttgaagatggagaacaaagaagaagggagttgaacaagctgaacctttgaggaggaactcactcaacctggatatctaatatccgggacactgagagagggacggagttgctggacggcggctgaaggggagagtctacccgggcgtgtggtttccttggcaacggagagtgtggtggactctgggtgcccaatgggcagggctttggtatctgtaattgccaggaacagcctttttctccccagggg

SEQ ID NO: 165910 - DNA, 335 bp, Homo sapiens
cccagagccacccttgcggcaggcagggtcctggcccttccagtacgaagctgggaaaaggcagcaccaaagatgccaggggcgcctcacggatccccccgggggggcctccttgagggggagcaggaggaggggccaggctgagggctcaggctgtgtgaaagacaccctggttttgaaaagggagaggggctagagaggtggggcccgagggcctggtggggcttccagcaggggctggcttatgttttcaagcttactctggggtctggagaccactgccgaacatacgccctccaagcagtggccacaagaagaccatgaggagctcgggc

SEQ ID NO: 165911 - DNA, 237 bp, Homo sapiens
gtcagactgactgtgattttgacatcagtgcctttcacatggactgtggaccttgttatgtatcctgaagaaaagtctgagtaacagagctcaggccctgaagcagcccctagtttaactctgcagtcccttaatccagcacaagctgatgtgtgtccccccactgtcctccctcctgtcgacattgcgtgctcctttgtgaagatgatggggccaaactgctgtactgggtggcct

SEQ ID NO: 165912 - DNA, 383 bp, Homo sapiens
caggtcagggaggtgaggcagcccaaggtcacactgagagccagggcaaagctgagcagtgagccaccatctgcctgattccagcagaacagccctcggactcaatcacaacgcagctccagtgatgcactacaccttatcagagagtgaagaactgctctaaatcttaaaacaaacattttaggggcaagaagtgccaaccttgaaactccagactgggataaaagaaaaaatatttcaccataaccaagaagactaaacacagctcaagcaagtacagaaaacgctgcagggaccagccccacacttacctggccaaaggagcaaaactctgaataaaaaccttgatctttctacttaatgaaacatttttttttttatca

SEQ ID NO: 165913 - DNA, 280 bp, Homo sapiens
ctgatatttaaatgaaaaagcagtggtggtggggaaagatttatctaacctccaaatattttctggaacagtgcctgaaattcccttgttattggttaattattttagttaatatttggtctttccttttactcatcttcaaaatggaactgttctgtggtacataatacatgaagacataagcccattagtgggatggatttgtcaggtcacttttctctgtagcccgagtctgagctgatgtaggagggattctggaaggtggtatgatgaggggagg

SEQ ID NO: 165914 - DNA, 188 bp, Homo sapiens
cagggcagcggcctccagagaggagatagacaggaacgctggcctcccaggattgagagtggacagaggttcaggtgaaaagccctcagctagccctggagcacctgtggggccatgctctgtgctggacacgcgctgcatggtgaccctgtgagctatttgctgccggtggggaaacggaggcttat

SEQ ID NO: 165915 - DNA, 175 bp, Homo sapiens
cacacattctgctcattcaaatgtccatgcctaaaaccaacatcttaaaatatgctgcatccccagggatcctcctcccagcttgaggccaggcagtcggatggaggctgggcggcccctgaaggctggggctgttctcagctcctgccctgcctggctccaccccataggtgcc

SEQ ID NO: 165916 - DNA, 454 bp, Homo sapiens
agccttaggagctaccaggtaagtggattatagcaacagatcagacatagttattttgccttcaaaaattcatagaagctcatcaagcattatgctgctctatttattgtgtttggtgcaaaacgatgcaacccctttcattttagagggaatattcctttattccctatgtcaagcctctgaacttttacagcatttatctcctatcttctggcatgcatgtgtcttaccaccaaggtcaccagaaaacagaatgctatcagtgtaatggatcaaggcccctcttgactacattgtgatagagaacccgagagctacaaaacagtgactgctgtctctgtcatatgaagatatattgcttttgagtttctttgctgataggaattaaaaagaaagcatttgctaagtgaacaatttcatttgaggtcccatgggttgtgttgacttgttccag

SEQ ID NO: 165917 - DNA, 192 bp, Homo sapiens
acttgcttttttgttactatttttgagatacagtcgtgttgatgttatagctctggtgcattcatttgtaactgctgtctagtatcccactaaatatatccatggaacttacaacttatccattcacctcttgatgaatattttctccaggattttatgattacaaacaccatagggtttttaaatctggga

SEQ ID NO: 165918 - DNA, 617 bp, Homo sapiens
cccttcgctcattctctcctctcaggctcccatggcttggtttgattttggagatcaggttctcactgtgttgccaaggctggagtgtagtggcctacagcctcaacctcctgggctcaagctattcttctgcctcagcctcccaagtagctgggattacaggcatgcatcaccacgcccggctaattttttgtatttttagtagagatggggtttcaccgtgttagccaggatggtctcgatctcctgacctcgtgatccgcccgccttggcctcccaaagtgctgggattacaggcgtgagccaccactcccggcctcaagtgagtacttgttattttgaagttctgagatccatcagatgtgccattgcttccactagaacagatggtgataccatgctggtcttgtggctattagtggtttatctctacccgttttttgtttgggggtttctggggatacctagttttgctgtcaagttgtccaaggtttccaggtttcctatcatggctgctttgtggtgctttaacgggtaatttgagaaatagtaaaaccatgatttcagaatccctgccagttaattttttaatgcaggagcaggtaaaagttacaaga

SEQ ID NO: 165919 - DNA, 379 bp, Homo sapiens
cacaattcaagtcacaaaaattaagtttcagggtcaggacttgtgggtaaagcaagtttctggctgcactcgtagctcacttgatttttatttcataagctctccagggaatcatagcccaccagtgtgccgcgttcccagtgatgagtctggaagggaataagggacttcatccaggctatttaggacataaaatattctaggaaaactactccctgtcctctcctggaaatctctagccagcagttacacttacccttggggttgagcatattttgttggcttttgttgtatgtaaccaaatctttcctgcttctaattaaatttattcctttagtaaaatccttcccagaaaccatatggctattttccactaaaa

SEQ ID NO: 165920 - DNA, 395 bp, Homo sapiens
gactccgtctcaaaaaaaaatatgactccagatcaagattaaatagtatattcattactttagattgtattttgaatgggggacagagaatgacaattggaatagaaaacaaaagaaatctgagactgggcaagtctcaggcacagatttggagtgatcacatgaaaaaacctcccaatcctagattcctctgtccataaaactcatcttcctttccccaccaagacatttgagtggatcagagccaccctgaagattccaagcttcaacctgggtttcaaatcctactctaaagtaaactcacactcctggtgatttaagccaaatctaccatctcagaaagcctccaaattggggtgacctcaaggatggacacattgcccaaggttgtttct

SEQ ID NO: 165921 - DNA, 367 bp, Homo sapiens
ccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtcgggttcgaccacttggccgatgggaatggtctgtcacaatctgctccttttttttgtccgccacacgtaactgagatgctcctttaaataaagcgtttgtgtttcaagttaaaaa

SEQ ID NO: 165922 - DNA, 309 bp, Homo sapiens
ccgcgccgccatcatggacaccagccgtgtgcagcctatcaagctggccagggtcaccaaggtcctgggcaggaccggttctcagggacagtgcacgcaggtgcgcgtggaattcatggacgacacgagccgatccatcatccgcaatgtaaaaggccccgtgcgcgagggcgacgtgctcacccttttggagtcagagcgagaagcccggaggttgcgctgagcttggctgctcgctgggtcttggatgtccgccacacgtaactgagatgctcctttaaataaagcgtttgtgtttcaagttaaaaa

SEQ ID NO: 165923 - DNA, 545 bp, Homo sapiens
tccgtctcaaaaaaaaaagaaggaaattctgatacatgctataacacagttttaccttgaagacattgtgctaagagaaaaaaagccagttacaaaagaacaagtactgtatgattccgcttatataagctacctagaatagtcaaactcagagagacagaaagcagaatggtagtttccaggggttgggggagagagaaaccaggagttgtcatttaataggtacagaacttcaggttgggaaaatgaaaatttctggaggtggctggtggtaacggttgcatgacagtgtgaacgtacttaatgccatagggctgtacacttaaaattggttaaaaataagttttatatgtatttaatcacaatttttcaaatttaaagaaatggttagaataggactaggaatataaaagaaatgtatatgagagactattaagtacaaaggcgtagaaaacaaactgttaatgtattttagctctaaaagtatgtatgtaaggcctgaaaatgatatgaaaaataaaaattgtattagtatactaggatta

SEQ ID NO: 165924 - DNA, 310 bp, Homo sapiens
aggtgggagaatcacttgagcctgggaggttgaggctgcagtgagcatgatcacgtcacgtcactgcactgcactgcagcctaggtgacagaatgagagcctgtctcaaaaaaacaaacaaaaaaaacctccagaagttaccaaatgaccctggggcaaaactatcctaggtgagaaccagtgtcttagaaaccagagcagccccacagttacctatttattggggtctgggtaagattttatttgaacaaatacttttgcactttaggaaaaaataaaagtggatggagttttgtaaagaatgacaggt

SEQ ID NO: 165925 - DNA, 507 bp, Homo sapiens
aataaggaacttgcccaatggaaacccaaatgtccttagtcctaagactgagtcctaatactaaaaagccaaatgaatgttttgggaaaagcttgccaaaaaatctagcagaatactttatactcagtggacactatttctccatcacaccaacccctccaatctatgcctcctcaaattgccctgcctcatgagtgcaaaaaccattgtttttattttttcccccaggagaggttaggtcaaaaataagaaaataatctagtttctttctgccagatttctggcatagtgggactgggtaggaatgtacctactgtagaatcttcccacacccctgggttgttaagagtaactagcagaggcacgtcccatacactccccaaatatctgagctggcaacaacaacagatattcagagaccttagccctaggacaatagcttctgtcagtcaactacagttctcacgactctgtgtttctgttcttacttcaacctcctaccaaatg

SEQ ID NO: 165926 - DNA, 410 bp, Homo sapiens
  misc_feature (370)..(370): n is a, c, g, or t
aataaggaacttgcccaatggaaacccaaatgtccttagtcctaagactgagtcctaatactaaaaagccaaatgaatgttttgggaaaagcttgccaaaaaatctagcagaatactttatactcagtggacactatttctccatcacaccaacccctccaatctatgcctcctcaaattgccctgcctcatgagtgcaaaaaccattgtttttattttttcccccaggagaggttaggtcaaaaataagaaaataatctagtttctttctgccagatttctggcatagtgggactgggtaggaatgtacctactgtagaatcttcccacacccctgggttgttaagagtaactagcagaggcacggatngtgggcgagcacagattgcagtcgaggcacagattgcagt

SEQ ID NO: 165927 - DNA, 464 bp, Homo sapiens
agctctattatgtggtaatttttcttccatatcaattttaatcatagatattggatggatgatatactttgcttttaccactgaaaggtgtttagaaagtacagaggtttgtaggaagcctcagggactaatatatcgtttgttaaatagttgtaaatagaggatgggattggacattaaacttccctcagtgctgccatctcttctacgacctctagttctgtctcaggcacggaagccttagctttgtctacttgtatttcacccttcctgaaacttatttcttaaatatcttctgtatattagcttccacttcatgtttttttcaagctttagactgataaggttctaagttttatctataaacttttgcaccctttgtggaaacaaaattctaatgataaagtgatatgttgaataagtaataacaaattaagacattcataaatttcatagtaaaaaaa

SEQ ID NO: 165928 - DNA, 264 bp, Homo sapiens
tgtttgcctagttctgaaaactgtcttcgtctcctcggtcagaagctgtggaagggctgtcactgggccttggctccggtaccatcgctgggttagccccaagtggtgactgtttttctccttccgtgtcattgacttagaggcgtgttaattatgcactcccaaactgcaggcttcacaacaaggcctccacccagcaggaagcacgcagctcagtggaatctgacaggccctgcctgcctggtgcacgctggcatgtgcgat

SEQ ID NO: 165929 - DNA, 123 bp, Homo sapiens
tacggagcaactctactatactcctgtcttcatcccctatctccacattaaggaagatcaagaatcagaaagggtgtatacattcccttcaagcaattacctctatcttcaagcaagagtctg

SEQ ID NO: 165930 - DNA, 379 bp, Homo sapiens
ccttatccatgataccttccctgaccacctcacattagtagttaataccaacattaaaatttttgtggaaaggcaaaaaaataaaaagttaaccccaccctctatcttccttttccagctcacttatttccacaatgaccatctacaactttgtttccccaccagagcagatttcgttttgatcactactatgtgcccaaaagcttagaacacatatttggcattcaataggcatttgctgaattgttctttaaaataatcaaaaattctgacataactgaaagatgggatgaaaggagaatagtgggctcatctaccatcaaaaattggttaattctctgcagcagcagttatcttttttttttttttttgagacgga

SEQ ID NO: 165931 - DNA, 450 bp, Homo sapiens
ttcagcctcccaagtagctgggattacaagagcccaccaccatgcccagctaattttttctatttttaatagagacggggctttgccatgttggccaggctggtctcaaattcctgaccacagggtgattcacccacctcggccttccagagtgctgggattacaggcatgagccactgcacccagcaagttttagattcttatatgtagggtcttgtgattttttagaaaggttatcttttatagatgggagtgagggtagaagcaccatccttcatatattttgcaggctgccatatccagcttgtctcagccaccatttcattggaaaagaatcatctctttccacttctcaatggatcttggcaccattgtaaaataatgactaaagatatatagtttatttctggactcttaattctaatccattgaactgtatgtctattctta

SEQ ID NO: 165932 - DNA, 3692 bp, Homo sapiens
cttccttttttatcgctgaaaaatattccattgtatgaacatgtaagtgtttattcattcaccttttgaagaacatcttgattgcttcctttttttggcatttatgaatagatctgctataaacattcacatacagatttttattcccagttttgtttcactgatctatttgtttattctttcgtgagtaccacattgtcttaattgtcgcagcattatagtcaggtggtcaagtcatatagtgtcagtcctctgactttgttcttcaatgttgtgctggctatgctacgtattttgcctttccatagaaacttaatcatttgattgatagccacaaaataacttgctggggttttggttggaacaatgtgtcctctgttctgtttctctttgtatgttacatgaagagggttgagaacggtgaaatactatgtgcactactttgctaaatgagtttataaagcagtgcaaatggtaatctttgggtacctggctatatttttatcagtataaattctgatttttcaaatatttcgatgtagacagggaaatcattcaaaactgtggattccattccagcagatgtagctaaaatgggggggcaggagaaaactgtggaatagggaaggttttttctaaggcttcattattgtgccagtctcaagttgaaaagaggctacatgattgtacattcaagtcttatgttttcctatatttgaaaaataaaaacatttataaaatatatgcaatgtttactgggtgcttttcctcgtattagtgttttaaagcaattgaagaaaataaatatttcagtataaaaaggagcaaatgtatatgaataagtacttaagagaaaaaaattttagtgacagctttaatggttgataattcggtacccttcagttcacccatttaaagtatacaattcattgatttttattatagtcacaaatgtgtacaactgttaccaaagtgaatttgataattttttttttatcacctcataaagaaccctgtacccttggccaggcacatttgctcatgcctgtaatcccagcactttgggaggcccaggtgggcggatcacttgaggtcaggagttcgagaccagcctggccaacatggtgaaccttgtctctactaaaaataaaaaaatgagccgagtgtggtggtgggcgcctgtaatcccagctacttgggaggctaagacaggagaatcgcttgaacccgggaggcggaggttgcagtgagctgagactgtgccattgcactccagcctgggcaacaagagtgaaactctgtctcaaaaaacaaaaaacaaacaaaccctgtaccctttagttatcatcttccatcccctcatcttctctagcactaagcggctgataatctactttctatccttatatagagttgccttttctgaatattttatgtaaattggatcatataatatgtggtctttttaaattggctttttccatgcagcaaaatgttttcagggtttattgatgttgaatgtatcagtagttgataacttcttcgggctgaacaacattccattttatggctgtgtactacattttgcttttccatcagttgatgtctatttgtttttgcattttggcagttgcaaaaatgttgcagtgagcattagcatacaaatatctattggtgtttctgctttgaattcctttggtaatatacctaggatggaattgttgagttacatggattacctgacttttaaaattacaataatcttactgggtgtgagatggtatctcattgtggttttaatttgcatttctttgatgactaagtatgttaagcatattttcatgtgttcattgactattcacctatcctttccagagaaatatcttttcaaattctctgccccatgagtgggggctggctagaagaggggattgaatgtcaacttcttagccatgtgtaccttctaacttagcagcaggaggttgctgtggtaggatgggaaatgctgacatcctgcccctcaccccgctaggaaggcaggctttcagctctgtactaaggcatagctttccaacttggacctctgggagagggaggcctgtgttcttggctgtagccagctagagtggtttttctttctcattgagctgagggtggggaagaaaggagcagcatcttgattcacataccacagactcttgcttttcttactgagttttagtacattttcttgaataaacgtttcttcatttgctgcatactgttaggaccacttccagagattttagatagttgtgttcttttaaagagtatgtaccagtttcactggggatctgatctgcagggatcttccctctcatgctagcaagaaaaattgagttctcataaaccaagtaaaatattcaagctttcctactaattaaatgttttagaaccttacagtggaatattttgtatccatcaagttcttgaaagtagaaaccatctatcttgatattgggtagaaagaggaagttagacactatggagtatctagtttttataaaattcaacacatacctaaatatacaatatcatgtacttctcccctataagacatattttattaattaaattacatcaggtttttcttaagtattctgttctccacattttaaaattcaaaagctttaaggtggtatctaataaatagctgttttcctgcctctgtcctaccaataacagctcattagggataaactatagttatccctatagtactaatctaactaatagtactaatagttacagatagtactaaccagtgctactaatttcttatatttctttataggaaatctatgtataacaagtaaatataaatacatattagttcattgtcacactgctataaagaactgcctgagactgggtgaattataaaggaaagaggtttaattgacttatagttctgcagggctggggaggcctcaggagacttacaatcatggcagaaggggaagcaaacatgtccttcttcacatggcagcagcaaggaaaagtgcagagcaacgcagtgagagccccttataaaaccatcatatctcgtgagaactcactattatgaggacagcatggaggtaaccacccccatgattcagttacctcccactgggttcctcccatgacacatgagggttatgagaactacaatgcatgatgagttttgggtggagacacagccaaaccatatcacatagtctccctctttttatgtttttgttatttgtgttttgttttatgtttacccaaataatcatttattttttattaacatttatgggttatgtttaccatataacccatttttataccttactgtcctatccccaccccaaaatgtcattatagtacttgcgaatttgctccagtacagcataaagcatattctaattttttatggctacataatgggcatttagtaattaaaacagttgcatattaataaacataaataggttcttttttgagataaggtctcactctatgtcccaggctagagtgcagtggtgtaatcatgactaactgcagcttcccatgcccggctaattttttaaattttatacagacaggatcttgcccaggcttggagtacagtgagccgtgatcataccactacactccagcctgggtgtcagagtagaccctatctc

SEQ ID NO: 165933 - DNA, 365 bp, Homo sapiens
caggaccctcctcatggttatgagatcgtaaatgtaatgtcagaacacaatgcaattacgtggtaagcgccctattaaacgcttctcttattgtgtgttagtaatgtgtattagtttgctaggccagccatcacaaaatatcacagactgggtggtttaaacaacagatgtttattttttcacagttctggggctggaagtccaaaatcaaggtgctggcagggttggtttctcctgaagcctctctgcttggcttgcgggtggccaccttcttgctgggtcctcacatggattttcctctgggcacacacatcccccaagtctctctctccttttttttgttttgttttgttttgagacggagt

SEQ ID NO: 165934 - DNA, 559 bp, Homo sapiens
tgtgatctcatcagacatgtattctactctgtgagaataagcttatttgactacattgactccaaattaaaaacaactaaaagctttttcattttatattttaggattgactgctttatgtaggcaataatgccttttcccctaaaatacatcagccttcacatgtgtttactaatactggtatctcccatgggataggaaaggaaaacagttccttttctttaaggacctgtctgcagcagcctccaactttgggtatccctaattatgctaagtccttctgtctttttgtttatgaaagaggagattgtgaattaggactactaacatggtaaagtagttttataccagacccatgcttttagcctaaccctccactcaaaagggtaaagcatagatttctgcttgtgtgaagtatcagtggcggccaaactgctctgtgctaacttgacaggttccacatgcagataactctggttaattcttaatttaccacatgaagactcatgaaaagtttttattgtttgtactaccattaaactttgttaaaatcttaatc

SEQ ID NO: 165935 - DNA, 454 bp, Homo sapiens
gtatatgtgtgtgtgtgtgtgtgtgcacgcgcacgcatgcgagctatgtgtgtgactatgtgagcatgtaacacatgcgtgttcatttgctaggtcttgttcctccctcatctgtcaaatagcaatgatattacctgacccatctacttcacaggattgcctggtagatcaaaaaagaaattgatgtattagggtttgtattagtccattctcacactggtataaagaaccgcctgagactgggtaatttataaaggacagaggtttaattgactcacagttctgcatgactggggaggcctcaggaaacttacaatcatggaggagggcaaaggggaagcaagacaccttcttcacaaggccacaaggcagcaggaaggggaagtgcagagcaaagggggaagagccccttataagtaccatcagatcttgtgagaactctttcactatcgtg

SEQ ID NO: 165936 - DNA, 274 bp, Homo sapiens
taacaggtgaaacccaagcatctgcttctggctgccctagtaccatgatcatgtgaagttcagtatgctgccaagatctctgtagattcccatgggggttggggcaggcattacatctcagtcaccactcactcacctcttagagttatcctctttttccataacactttgtccccataccctttcttccacaaaagcaacaaacaaaactgttgtatacagtgaggacatgtagatgggtgatggcagcagttgaggaatgggatccgctaga

SEQ ID NO: 165937 - DNA, 144 bp, Homo sapiens
cagctgggctgggaggaggttgtcacttattgcctaggaagccagtgggtgactcctactagagcagcagcagcagtgcagagatgtggaccaagagaccactaggagggagaagcgacaggacctggtgattgactgaatgtg

SEQ ID NO: 165938 - DNA, 359 bp, Homo sapiens
tggccacgcgtagaatggaatggaggtgccctgtgagctaggagaggctcagggaactagaaggagatggaggaagtggaagttgaggaataattggtgtttaagggcctggcatttggagcttagactagtctggatgtaggagaactgagcctagactggaaaggaaccagaccagggcctcggtcttggcagggagggcccttgggcaggaggagctccagggtgtcagaatttgattggagttgagttccagaagtaagagggatgtaggggcagggagttcctaggcctcactgaggaatagagaatggggaagaatgctgagaccgcattctgggaaaagtccaatgcctgga

SEQ ID NO: 165939 - DNA, 436 bp, Homo sapiens
gcctcgaggtgtaagatgctttcagacccaacagaccactgattcccttttcttcatagtaaactgttagaggtagacagtattatctgttcttcctttcaacacctgccctcccccaaaccgaagcagtgcactgaagacggtagctctgcaacctcctcccacaggggcacccaccgaggggctcgcgcggctctgggcacctcccctccacctctgggggctttggttagcgcagcacaaccgccgaggtaatgatcccgaatcctcgaggaggctaagcaggaccacggggctgaggctccgggatgctcgggcgaggcccgaggcggggcggcccacgggcgccggtcgccgggctctggagctgtgcattgacctccgcccgccccgtccctgcctggctttctcgcccaaacggcccgtggcgcggccg

SEQ ID NO: 165940 - DNA, 554 bp, Homo sapiens
gacctcagggtggccagccccaagactcggcacttgttctcaaaagtcggttcctgggatcaggtctctcggggacggaagtccccatttaatgctgtccaccagcagtcacgcatcatggcccttagtgtcagcctcaccccttcctggctgaatgaccttagcaggtcatttctccgagcctcagtctcctcatctgtgaaacgtgcttcataaacccactttgcaaggttatcgtggggcttcaacaagtacaagtagaaagggccagaacaaggcccagggcacggcaagaactcaataaacaatgtcagctcttagctatgattgcttttgtcatctcaatgtattctcccagcaactgcccaggttgcccttctccaaggccagggcgtcatagaaggaatcggtgccctctctcctggcccaggctgcagctgtgaagtgggtggagtgagtcaggatggccgtgtgtgtctcgcgtcactcaggaactgcacacctgctccccggggcgagatgtggacaagacacagctgggacagagcaggaag

SEQ ID NO: 165941 - DNA, 418 bp, Homo sapiens
tcttgaggaccccatgccccctagcgggcaaaggccacactatcattctacagctgagtgttcagaaatcccagggagttgctcaatgtcacacaccacctgaaaaagccagttctaaagtctgaagacccagctccgaggtaacgtcccttccccatccgccttcataggatcacaggcttcacagccagacagacctgggtgcaaaaatcactgttatccactgcctgggaggttggaaaaatccatggtcactgagaatgcttctgcagctacaaaatgggaatgagaatgactctattttggactaacactttttcaataagaaagcagagtaacaaagagctacagaagtaaggagacaattttgcttggggtggagggaaatctcccccccgctaggggacatgggtatcct

SEQ ID NO: 165942 - DNA, 559 bp, Homo sapiens
ggatagttgtataatatctaggatctaactagcctttacctctcactttatatacaatttattataatacaatagagatggggtttcaccatgttggccaggatggtctcgatctcttgacctcgtgatccgcccacctcggcctcccaaagtgctgggattacaggcatgagccaccgcgcccggccgtccagtgcctttttaaccaaacagtgcactgtgtacatttctagacaagtcctggagctccctgcaggccggaaaaaggggcctccgggaatgtctgacgtgaaggggaagtttcagtcttgggttcagtgctttgaatggggccgtgtggcagaagtttgcttggagctgtttgctgaggctatctgtctgcattggtggtggtatcacttagtgtatattggggtgtccaatcttttggcttccctgggccacataggaagaagaagaattgtcttgagtcacacataaaatacactgacactaacaatagctgatgagctaaataaaaatcacaaaaaagtctcataatgttataagaaagtttatg

SEQ ID NO: 165943 - DNA, 281 bp, Homo sapiens
tcctcccaccttggcttcccaaagtgctgggattacaggcatgaaccaccatgctcggcttgtcagttcttatttcactgtttgatcatctgttttctgagttgtgatttttgtatttgtggtattatttaatatcttcaattgcttatttaattattcctaataagaccccctcccagatataaccagtattctgacctctagtgatcctcccaccttggcttcccaaagtgctgggattacaggcatgaaccaccatgctcggcttgtcagttcttatt

SEQ ID NO: 165944 - DNA, 741 bp, Homo sapiens
gatgagttgggatgctggcaagacaaagggcaaagtggttcacagtggaattcagagacaatagtgaaagaaacccagagcaggaggaggaggaagatggtgaactgctggaattgaggaactgggtgtctccataaggttgaagaacaaacactaagtgtgaagattaggaaggtaggtgatgtgacacaattgactatattagcctctcttagagacccacatatagtaatctgaacttcctgtcaggttttatggacaataatcaaacatttcagcaagtgacatctcaaaaaaggtcacattctaagttttagcttatctcttgcattgttagtaattaaataatttctattaaatgaaaacttctgatgaagttttatttgaatgtttttctctaacatcggccattaattggttcaataaggtagtttttaataatgaaggttaattgagggatgcaaatggtcaggttttatatgaaaatgaaacaccaaaaataaaaatctattgcttcggtaaactcaaatgaaacaggttgggtgcatttcctaagccattcattatctttggaggcctggtttgatccactctctattctctagttgtgtttcctggctgctacacattgaaataaataatacagtgtgttaaaatctttggtttaaatttagcacataaaatgccccatattgtgtgacactctcagctgaagtctagagagtgaagtttatgttttta

SEQ ID NO: 165945 - DNA, 667 bp, Homo sapiens
cctactcgctctttccactcgaaatagccatgccccctttccttaactttggagcccacaacacttaagattagctgacatttaatatgtgtgcctgctaggttccaggctctttttatatcctatctattctttatgtccatctgcttgggaagtaatcttattccctttttgcagctgggggaactgagcattggaaaggctggtctggccaatggacagctaaggtctttctgatgccaaagcccatttttggtacaccatatcatctgctactgagaaaaaaaggctagaagtggaaggaggtttgtttgtactttcaggagcatcccagagaatcgtagaattgggttcagtatattcttcatggcttcacctaaaattttcagctcggggcatttttataggtttaagaatgattatatgtaaaaacaggcaaaatttccagaaggcaacaaaagataaatgatagaaccctgtcttctgtccctttccccatagagatacctacacacatttaaactgggaaaggaaacaatgatccatcgtaaagcttacccgtaagacaaattgcctttggcaatataaaccttaaatgctcatgaaggcctcacatgagttaagtacagtttaacatgattctgccatttgagcacctactatgtgc

SEQ ID NO: 165946 - DNA, 364 bp, Homo sapiens
ctggccacatctacttagcatgtttttgagatttttttataggcaaaagatactccttcatatggatatagcacattttgtttatccattcataagtagacaaacatttgagttatttccaccttttggctattatgcgtaatgctacgaacatttgtgtacaagtttttgtgtggacatgtgcttttatatttcttggatttatttctaggagtgaaattgctgagttgtattctaattcttgatttaaccttttgaggaaatgccaagactgttttctggagctgctgtaccattttaggctcccaccagcaatcttgtgagagtcccaacttcttcacagcctcatgaacacttgttgtta

SEQ ID NO: 165947 - DNA, 419 bp, Homo sapiens
tatttagtaaatgatgtatttaacagttaagtatccctaagtgtatttaatttgtaattaggcggtaacccttcattaaaactgattaggatggtatgctactgcctctaacgaaatgctcaaagtgagcttatatgcacgttcttgatcaagaattattgggagagaagatgaaattcttctttcctgctaccttcaaccatacaggctgaaagaggacccccaagtggtaacactggctgttgtcccaaatgtgctccatggctaccacttacctgggaagactgtcaccaccagccacttagggcgggcctggcaccattaaactattgtgctgaaaaccgcacagatggaatcaagatcaagtggtgcttatacggtcaatgtaggaaaaaatggaaggtcattgaagattagtt

SEQ ID NO: 165948 - DNA, 539 bp, Homo sapiens
tatagtatttcatttactactttagtaatagtgatatctatataatatttaaaatcacttatttataataaataaatttagaaatactgttcttgctcactcttttgtttcagtaaaactactttattgcaattcttcacatataattcttgattcagtctaacgtctctttctcaagcagttgctatttaaaataaattagttgagaaagtaaccttcatgtgtgagaaagtcatgcccaaattgacagagtcttagcttaggaacggttttaaggtgtagatgccagtcttatataccagcatttacagtactgtggtttgagggctgatgaattgttgacctggctggtgagagtgggtggggtggctgggagctggttgctggaagctctgagaatgaagaggtgagagcaaaagagagaaggcagatgaagccaagctggtcccggtcagattgcactgacttttaatctattttttttttcattataaaagtaatacattgctgctggaaggcatttggacaacatcgaaaag

SEQ ID NO: 165949 - DNA, 519 bp, Homo sapiens
tagaaggtggaacacacccaggagcatgtcaacggggtgctgtgggacttcagagtaggcagatcgtcaccaagcttcaacggcaaagatgccactgggggaaagaaggaccaagcttggaagagagagtaagtctggaggcaagatcttgtctcaccagcaggggccaggtccatggtgaccccttccccaggcagtcacctctctgagcccactttatatcctaggcctggattcaaagacacttgagccctgctccagccttcctttgaggtgctatcttggtgcccttcctataatcactgctccagtcccatgtcatctggtccccagttaccacatcaagcttcccgaagctccacacagaccatgccacatctttaccaaaaaatcagcagtgggtcccctcacctccaggacaaagctccagctcttcgacctgcctgtcaatatttgcaatcactgcctgcacaaattagctgggtgttgtcatgaaaggatcacttgagcccaggagtt

SEQ ID NO: 165950 - DNA, 1316 bp, Homo sapiens
ccctcccaagtaaactagtcacccaaaccatatacacaacagtcagactcatttgctcacagctttaaagcaggttcttttccatttccactgctattacctattccaagtgccttgcacaactttgcctaaggagacactaagaattcttcattgaagagatgaagaaatgaatgaatacagggatgagttttcttcatttcattgcttctgtctagaccactggaaaaacgtatcttcctttattctgacctcttctaattcatgttctacaaagttatcaaaatgttattcttaaaatgcaaatcattcttaaaatgatatacaaacacacatcattccaggattcatttagtttagtgccaaggcctttcatgctaagttccctgcatctttctggtcttacctcccaccatgtctctttactgactttgttgcatcatcacgtggctgcatactccatttcctcccatgtgctgttcattctgcagaacatctcactgaagctttacctggagaactctactcactttgcctgtcggattcagatgtctttcctacttgttctcatagacatttatgtacagtctcgtgactcttttcatattaaactgttatcatgactgacttacttatctaggggctttctcttaatcaacacaggttctttattcctggatggtatccaacattccctgaataaccagtgattgtttattggctgtttgactgaatatagaatagaataagtctgtagcttatagtccattctaaccactcattcttttcataacttttattgagtgcttactatgtgccagcttttgtttaagagattggcaatactatagtgaacaaaatagtacctgcccaggcaattaaaaagtaagcaattagacatacaatgttgggtagcattatgtgtatattaatccagtttcactctgctgataaagacatacctgagactgggtagaaaaagaggtttaattggacttacagttctgcatggctcgggaggcctaagaaccatggtgggagatgaaaggcacttcttacatggcagtggcaagaggaaaaacgaggatgatgcaaaagtggaaacccctgataaacccatcagatctcgtgagacttattcactaccatgagaacagtatgggggaaactgccccaatggattcagattatctcccaccaggtccctcccacaacacatgggaattatgggagtacaattcaagatgagatttgggtggggatacagagctaaaccatatcacagtgttaggaagaaaataaagagggataaggaa

SEQ ID NO: 165951 - DNA, 310 bp, Homo sapiens
tgggattacaggcgtgagtcactgtgcctggccgagaatattagtgatcattcagttgattgccttgtatatctctagactcgagccgtaaagtttcccattcaactttctctatcagttgcagtgaagagaatcaatttttaataagagagtttcaaacttgttcttaatatattctttctgaaagaggaaaggctgtatcctttatttttggataatgcttttgaaatatttgataacttgtgcttgactattttagttgtctaacatgacccatcctattgctaagtctaagctcatttccacttgt

SEQ ID NO: 165952 - DNA, 477 bp, Homo sapiens
aaaagccaaggaacagtggcattagcatattatttagagatatggaagttactcccagaataaagagctaaaagagttagaagcagttgcctctggggagcaagactaggggtgggagggatgaggtaggggactgtaagctcttctgttctagtttatttttaaccatgtgcatgaattactttgatacaaaacattttaagtgtgtcacaagacagatgagaaggtggagggcagaccttttgtggccatagatgagttctgggggcctgattcaggtaggacaccagagtcatgaaatcccttgcaggtaggactgaaaaacaacctagatacttgaggacagtggagatgggaaaatgttccgatttttacaaggagacagaaggtatttctggaaattatagaccaaacggctcaatatagaatcctggcaacattctggcacagattattaaacagatggcttgggagtgc

SEQ ID NO: 165953 - DNA, 232 bp, Homo sapiens
cctcccatctggatgcttgctcccccgcctctgatgtaaaaagcttgagcagaagagctctttgcagtcacccgcccctcaaggaacagaaaaggaaagtatgcagcctcagtgggtgaagtcagcagatcagtggcaggcttagaggggaatgaggcggagggaagttgctttgtgattgagaagataatttctctgaattagggatagccttcaggtgtgttaggccaag

SEQ ID NO: 165954 - DNA, 406 bp, Homo sapiens
tctcaaaaacaaacaacaacaacaacaaaaaaaaacctgacagattatcacagcaagaaaacatgatggtggccatctctcaagatgaggaacagatgaggggaaattaaaaggttgtatttcctggaaaacaatgtttcccaaactcaaagcagggcctactggagattaagaaagattccaaatagagtttcaaagaccagggctgtaaagccctaaagacatgtgaaggaatttgatatgtagtcttatctctcaattatccctgactagcttagtttgagttttcctgtaactcttcccagtgctcatggattttcgtcttatggtttcaggtaagttatagtagcctctggggggagaaatggaaagtatagtgcctctattgttggtacccaacagtagt

SEQ ID NO: 165955 - DNA, 401 bp, Homo sapiens
tgattttctataagccacttttttctatctgtttcactgaggacaagtgtttgtgactgtacttagtgttccgggaagttgcatgtcatcactaatacacacccaagcgggaagaagtgaggtgaagttatttttcccttaccttggtcatggcagtactttttgttaaagaaataatctattcattacttatgaatatttcatggatattttgtatgtgtaaaataaaaattaaagctaaattgtccaccaagttatgaattgagaaagaaaatattttctgtggtcaactctcctatccatacaaaacgtgcttttgattttattgaacacaaataccaaacaacggtatttcagtagaaatacttgctttgaatatttagcgtttttaaaatgtgctt

SEQ ID NO: 165956 - DNA, 455 bp, Homo sapiens
tgctgggattacaggtgtgagccaccgtgcccggcctcccacaatttcttttcacactgatgcttttcacattgcttgcagacatcatgatccactttcattttctatctgctaacttgttttcaaattctagcttttcatcctgtaatgccagaagtcttttacaaccttcttccttggcatctggtgccttacatattaatatatgatctttttttactaagggcactttgtggtgttcaatagctggtctcagaatttcattgtctgacagtaaaccatccagttcactttgaatctttttcctttccctttctagctcactcttgctgcctctagtttcatggctgttatttctagtatgcttgaaagtttcgttctttgactttagtgctcagtgtatttctttctttctctttttttatttttatttttatttttttgagacggagtct

SEQ ID NO: 165957 - DNA, 346 bp, Homo sapiens
catctttctctgtaacccctaccctggcaattctccatggcctcagggagtccagccggaagctctgcgatgagtcctggggaactctcatctggaaaaaggcgctcatgacaggtggtgccaaccttccacggatgcttttcagcatctcttgggatgaggatacagaatttctctttcaccctgtaaacgtggtaaatgagggaatagaatttccagctttaatttttctgaataggattcaaaaatgaaattgtataaaaaggtatccagtgaaaaacacacacccatccccatctcccatccagttccctccgtaacccttttcttagtttcttatatgtcc

SEQ ID NO: 165958 - DNA, 235 bp, Homo sapiens
gccaaattattttctagaataatggaaccaatttttgctgccactaactgtgtaacagttttaccataccttcataagcagtgagtacctcataagcagtgagtacctcataagcagtgagtattttatatatttttggtaatttactgagcataaatcggtacctcagtacaattttactttacttttctttgactgtcaggactattaaagatcttaaagcaagtcccagaat

SEQ ID NO: 165959 - DNA, 541 bp, Homo sapiens
aggcccccacagggtcaggatcatcaatatcactatcttccaccttaacgtattaacccactggaaggtctccaaaggccagtaacacacatggagctgtcatctcctgtgataacaatgccttctcctagaacacctcctgaaggacctgcctaagcctgttttacagttaacatttttaagtcgaaggagaacactctaaaataatgataaaacatgtagtatagtaaatacaaaaaccactaacaatgtcctattatcattattattatgtactggacataattgtacatactatatagtacttttaaaacaactggcagcaaagtaggtttgtttgaactagcatcatcacaaagcagtgagtaatgtgttgtgctgtgatgctgcaaggttacgttcagctccactataatcttacgggagcagcaccacagctatctgagaagtttgtcttgaccaaaacgttgttatgtggcacatgactatattctaacacatgtgcattcaagaggagacataatgaatatcaagacggaaa

SEQ ID NO: 165960 - DNA, 551 bp, Homo sapiens
tacaaaaattagccaggcatggtggcaggcacctgtagtcccagctacaaaaaataaaaattaaaaaaaaaaagttggcatctattcattatctttgccttatcatattccattatatgagtccctcacaaatttatttatccattctattacagatggatatttgggttgttttcaggtttggctattatgaataatgctgcttcgaacatatcttggtgaacatgtctgcatttctattgggtgtatagctagaggctaaattgctgggtcataaggtttgtgaatgtttagctttaatagacactgctaaatgattttgcattgtggttgtatagttataccgaactatactttcaccagcattgtttgaaaaatgggttgcttaaaaaaaggaggggttgctcccatccttgctaatgcttggtattgtctgccttttccagttctagccattctgattttattctgcctttttttgtttctgttgattagtgaggtagagcaccttttcatatgctttttggtcatttgaatatctttcggtgaaa

SEQ ID NO: 165961 - DNA, 152 bp, Homo sapiens
aatattcaagtatatatgtgttcattagtcagtatttttcaatagattatgaaatgcatttagttggtcaggaccatttaaaagtaaatataggctgggcacggtggctcacgcctgtaatcccagcactttgggaggccaaggcaggcgat

SEQ ID NO: 165962 - DNA, 615 bp, Homo sapiens
agcccaaagtgaaaaagcaccatttcctcaacagttgtaaaagacagggatatctttcaattgaccaagcaggatttcatgaccatctttaaattacgtatcgaatacactgattggctaggcctaggacagtgcctggaacactgggagacccgagcctcaagtcctgctgcatccaggagttgaaattagtgtctcccagataacctggtctgagagttgaggattatttctcaaggctgaacagggtactgatttaaaaaaaacaaaaaattaaatggttgtgatcagcctcttagtgaaaattaagtttttgtaaatattgccctcagatttcttgagacagagacaaaggggtgaaaattggggaataaatcatacagttatttcagcttgatttaatttattcatgaagaccatcataaaatatgcaaagggaagtggagaagctgccccgtgtactataattaaacatccctactagcaagattaattatatttcctccatggtaagatttgcatcagggtgtggtcactagcgagctcttactggctacatttttgacctcagaggatctaaaggtagatttgtgtttaattgttttccattgggtt

SEQ ID NO: 165963 - DNA, 482 bp, Homo sapiens
ttcacttcattgtgtacataaaataccagccaggatacccgtaggaaggtatcttatctcattattctatcgctcctgaacacttgggatctgaatcagtatttcagcatgttattagcttcagtcttacactgcaacacattgctttagggactttttgcacacattttttgaacccccaaaacccgaagcaaagtgctaacacatggcgtttccactaacagttgacttgaatccattatcttccttgcaataatgtacaagaggaaactccctaatagttaaaaatcataacgtcccactggacatctcaggcattcatttctgtatctacagcctggaaacaggaaggtccagaagtcaacagctggacccaagagtgagcctggtcatccttcccttcacagcatcccaacaaacacagaatacatggttaaagttaacatgaattccactcttatcaaacataggcaaaggcttct

SEQ ID NO: 165964 - DNA, 465 bp, Homo sapiens
acatcttaacttaaacacactttgtataagaattaactcaaaatgaatcatctatctagatgtaaaacatattatattactataaaactttcagaagaaaacacagaaacaaatcttcacaaactggggataggcagagttcttagagatgattccaaaagcaggagccaaaagagaaaataaggaataaacttcttgtaagtctatctttatttccaaataaaaagtttaaaaataagcatatgaaaagagaataattataaccatcaaggaaatacaaattaaaccacaatgtgctaccactacacagccaccagaatggctaataccaaaaagactgacactattaagtattgctgagaagatatggaaacaaacttgcattcacttctgctgggagtataaattggtgcaatcactttgaaaaactattgaatctattaaaattgaacatatggttaccaa

SEQ ID NO: 165965 - DNA, 396 bp, Homo sapiens
tctgcctctttttccttctggcttaacaggaatctgtctaaattacatgtaaacccgatgagactatcacagctgaatgaaggccagagacaggctgaggcttgtctctatcaacaacacatcttagggcttggaaacagaagctcagggctgcatgagcctgtgggtcatgaattcactgctcctgctttaggcaggaattcccttccagcctccagaggagtgctcatgtgtcctccccttgaacacttcccctgactgggagctcactacctcaaagagaggttcatgctgtctttggatagctctgcctattagagagctcttcctccactgaactaaaacccattgcctcaggtccactcagcactcgtctgggtccttggggccatacag

SEQ ID NO: 165966 - DNA, 794 bp, Homo sapiens
cgctcacgcaaccgccactgtctggagcgggctcgcctctgcggcggcactcaccgcccgggctttactgaagcggagtctagcatgtgcggctgctccacagcggtgtgggtggcggcggctcctctgcagcagcctcggcagtaggggtcacggtggccaagcccaccgtggagctcatctgagagttgtaaggtacgggactgcctcggtctttgggacgccccgtctggtagcatcccagatccagcacgttccttccggccctgcaccccggcccggtgcctcacaccccgctaccccatgcatccagactctaaggcagcccctgcatctcagtcctgacatcgctgtccctggagcatcctccgctggagctggagcttgacagccaagacaatccaaagcaaaaagaacacagctggaggcatcacgctacctgacttcaaactactgcaaggctacagtaaccaagacagcatggtaatagtaccaaacagatatctagaccaatggaatggaacagaggctgcataaataacaccacacacctacaaccatcagatttttgacaaacctgacaaaaacaagcaatggggaaaggattccctattttataaatgatgttgggaaagctggctagccgtaggcagaaaactgaaactggaccccttccttacaccttatacaaaaaaactgaaactggaccccttccttacaccttatacaaaaattaactcaattttattatgttgtattaaattaagttgggtttaattaagatggattaaaga

SEQ ID NO: 165967 - DNA, 225 bp, Homo sapiens
cagaagccaagggtaaaagcgacatctcgcaacacgaaaggttaatatcaacatatacagctagtgagtgcaaagggcacctcagttggtggctcattatggcgggctgacccatagggaaagtgtcattctgcagagaggcctttctcaggatgtggcagcaaaagttacaaaagataaggacttgcctgtgaaacgcactcaactaatgagagctgaagattg

SEQ ID NO: 165968 - DNA, 577 bp, Homo sapiens
attagtggaacattggaatgtttagcaccaaaagagcagggtctttagtttttcctcactgaattactggtaccttgaacagtacattataattacaagtagacatttaccaactgcctgtaaaacaaatgactgtcagaatgaattaaggtttccaggagtgcattgcacattctgaggccaaccttatcctttttgggaggaaatttattggtgacttcattgagtttgctgcagatcaggcctgctcttgataagtaaccaagaaaaatagtgaatgcaatgaatgtcagactctggatcccgaagacttttgcctgagagagtgagagtcagaacacagcaagaggaaattgagtgggaatgcaagctaattcctcaatttgccccccgcaaactagctgctcaagtacagtcattgtaaattatacataggtttttttggtacaccagcagttcgaatgaggaataatgataaaaaaaaaaatggaaagcactttatgacagagcctgttgaaaatgactaggttgtcttagaaagtagtgactcctctgtaacttcaattgtttaagtcta

SEQ ID NO: 165969 - DNA, 463 bp, Homo sapiens
gaggcacaagaatcacttgaacctggcaggtggaggttgcagtgagctgagactgggccactgtactccagcctgggtaacaagagggagattctgtctcaaaacgaaacagaagcatataaaccagacccatactgtatgaacttgggtcataccattacacactgacaacagctggctaagtgtaaactgacaaaaattaaatttggaatcagacatttatttttcttctataaaattacttgagggcctgggaaactgaatattgttagaggtgatgtattctctgctgtcataattttacaaatgggcattttcattcatttttaaagtgctacaagtgacaaagtcactgcccagttcatatgttgttcattagttgttaaatgccttaagttactaccaagagagtgaaacattgggcagaatttcaattactgccatcacatacagccttcacatt

SEQ ID NO: 165970 - DNA, 299 bp, Homo sapiens
gattattatatgtaagaaaagtggcttcataggctcaggaatcagagttcctgggtgaatacttgttcctacactaactagctgagaccttgagcaggttactttgtctctttgtgcttcagttttctcatctataaaatggcagtaacaaggctgggtgtggtggctcacgcctgtaaacccagcactttgggaggccgaggtgggcagatcatgaggtcaggagaccatcctggccaatatgatgaaaccccatctctactaaaaatacaaaaattagctgggtgtggtgacactcg

SEQ ID NO: 165971 - DNA, 193 bp, Homo sapiens
tgagtgatttggtgtgaattattagacaatctctgacttggaataattctcaacccagcttgcagggaatagtgaattgagaggagttagtgagatgcttcaaaaaagtcttgtaatcctgtcttttgggaggggatatgacattttggtaaattagaaagtagaggttgctggtgcctttcagaagatgtga

SEQ ID NO: 165972 - DNA, 379 bp, Homo sapiens
ctttgcttcttgagcccttaattggccagctgggagggatccccttcttgcttctttcttcttcatgcatgcctgttgctctctaaggtcagggatttgagccagaggcctgggagtcaggtactttatggctcagcccctggcctggggcctcctattgtggggatcagcttggcccagggccttcctagtatgagaatggaatgagcttttgtggaagatggttagtggtctaagcttattatctattttttctgccagtgcctttgcataggaagggagtaggctgctatgtatgatcaattggtatgtgggccagttatctttggctaactttcagataaaacctttgctgtccatcttttttggaaagtagaat

SEQ ID NO: 165973 - DNA, 698 bp, Homo sapiens
atcttgctttcattcttttcctccataatctagagacaggaatattattatggaataagaaaaagatgaagccaggtgcagtggcgcatacctgtagtctcaactcccaaaggagtgatttcagctcctcgggaggctgaaatgggaggatctcttgagcccagagtttgaggccagcttgcacaacatagtgatacccagtctctaaaaaatttaaaacattttttaaaagctgtaccctgtttctgttctggattccctggctagctggttggctcttttgatggtgctcacctatttcctaaggactttgaccatttcaccttctgtccctgccttcctagttttaaggatccactttgagacaaattttcttaagtagaatgagagaaatgataaaagaaagtttcctttcatatttttaagagggaaaatattgaaactgttgtagcaaatgccatttaacaagatttctaggcactgcttatttcaagccatattcaagactacagaatttatgcataaggaagtaattaacttcgagtttatttttataggattttggatctggggtaaaggtcagttttcatgtttgtaaccacttaataaaatgaattgtgcttatgtatttataggcacatgtttaggtaaaaggaaattttagatccattctaaatagagttaaatccttttcacca

SEQ ID NO: 165974 - DNA, 125 bp, Homo sapiens
ctacatgccaaaagtacttaatcgtatgcagtaatgtcatttaattttcaaaacaactctccaaaggaagtgtcactctccttgtttgatttcttgcttcccaaatggaaggtcctttgtattaa

SEQ ID NO: 165975 - DNA, 480 bp, Homo sapiens
caaaacaatctacaaaagttgggataggatttcagaatgcttgtggtcttactgttggatagacctgtctactggaagctgcaaagtaaataaaataaggttaaaaagcaaatgactccacaatgctcccttctgaatgtaggaggggagttaatttttaaaacctgcttctctcctaaatttttttccaaatgaaagcccagggcttctgtcacaccagtgcagtccttgacggtgctgaagtgacatggctaagggtatcagaggacctgcacccacctcagttcctcccattcccctcctcaaactcagttcatgggagggtcactcaatacaggtggctccaagtgatacgttcctctggttactgccctaagcatacgtgaagtctacaataaagtatgcacttaatactaacagaaggttctgtaacaaaaaaacagttgaccagcctggccaatagtgaaacccagtctctac

SEQ ID NO: 165976 - DNA, 128 bp, Homo sapiens
ccgtacgtctaggactgacacattgtcattatcatggacgctaatcacaaggtgtcgtgtgcagtggcgtgcaggtggtgtgcacgcagatctgcgaacagcccacctgcacgcaccagcatacagat

SEQ ID NO: 165977 - DNA, 367 bp, Homo sapiens
catctaggatgatgcatgaaaacaggacagggatttctgcagtttgtaaaaatattttatttggtttcttctgtctccacccctgtagtatattactgtgtcgtctttgcacagcaagaacttagcatcatcctcttgtattttggattttgtttcctatttcctcagtttaatcttctcaggtgagtttgaaagacaaaagttctttacctgttaatggatgaggagttttaagaatctttagaactattttcctggactcttgtttcttgaatgggggtaggaaaagtgtatgttaatactgcttaagcttttttttgataagtcaaattctggaagtagaaaatagagaacaagaagatgagtc

SEQ ID NO: 165978 - DNA, 691 bp, Homo sapiens
atgccctgggccaggtgcccacatgaataatgcgggccacaggcaggcatttattttctcacagatatggaggctacaagtccaaggtggaggggtcggcggggttgtttgctctgaggccgctcctcctggatggcagggatcccttctggctgtgtcctctgtggcctttcctctatgaacctgtactgtacctctggggtctctctgcttccaaatatcttttttttttttttcagacagttttgctcttgttttctaggctggagtgcaatggcacaatctcagctcactgcaacctctgccttccgagttcaagcgattctcgtgcctcagcctcctgagtagctgggactacaggcgtgtgccaccacgcctggctaattttgtagttttagtagagacggggtttctccatgttgctcaggctggtcttgaactcatgagctcaggcgatccactctcctcagcctcccaaagtgctgggattacagatataagccaccatacacaacttttttttttttttgagatggagtttcactctgttgcccaggctggagtgctaaatagcagaatcactgctcactgcaacctctgcctgctgggttcaagcaattctcccacctcagcctcctgagtagctgggattacagatgcccagaaccaatctctgctaatttttctattt

SEQ ID NO: 165979 - DNA, 377 bp, Homo sapiens
aaagtgttaggattacatgcatgagtcactgtgcctggtccagcctagaattctatacccagctaaaacgatcaagtatcagggcagaacaaagttactttctggtatacagtcttaattattttaaccttggtttgaaccacatgaagagagaaacccaaaatgaagcacagaggtattaggaaacgggggacctaacaggacagagggtgaacgtaaagggggtcacagcatcacagcgcagcctctgcccagagagctgccagtcctggctggaacaggaggctgcacagcaagcggcactctctatggaaaacaccagaaccagtggggtctctgatccacttcacccttgtagaaaactatggagatgctgt

SEQ ID NO: 165980 - DNA, 1342 bp, Homo sapiens
  misc_feature (1300)..(1301): n is a, c, g, or t
  misc_feature (1303)..(1303): n is a, c, g, or t
  misc_feature (1313)..(1313): n is a, c, g, or t
  misc_feature (1319)..(1319): n is a, c, g, or t
  misc_feature (1321)..(1321): n is a, c, g, or t
  misc_feature (1329)..(1330): n is a, c, g, or t
  misc_feature (1337)..(1338): n is a, c, g, or t
agtggtggctcacgcctgtaatcccagcactttgggaggctgaggcgggtggatcacttgaattcaggagtttgagaccagcctgaggaacatggcaaaactctgtctctaccaaaaatataaaaattagcagggtgtggtggtgtgtacctgtaatcccagctactcgggaggctgaggcagaagaatcacttgaacccgggagccagatgttgccgtgaaccaagatggcactacggcactccagccagggcaacagagcaatactctggctcaaaaaacaaacaaacaaaaaaaccaaaaacgggccgggtgctgtggtggttcaccggcaaggtgggtggatcacctgagatcaggagtttaagacccgcccgaccaacatggcaaaaccccatctctactaaaaatacacacacacacacacacaaatgttgtgcttcaaagggcaccatcaagaaagtgaaaagacaactcaaggaatgggaatggtagaaaatttttgtaaatcatgtaactgataaggacttgtatctggaatatataaagaaccattgaaattcaacaataaaaagagaaataacccagttaaaaatgagcaaagaatctcagacagttctccaaagaacatatgcatatgagcaataagcacatggaaatatgctgaacgatatcagtaacaaggaaacacaaataaaaaacacgacaaaatacttcagacccacctgagtggctataataaaaaaataataacaaatgttgccaaggatgcagagaagctggaacttttataacctgctggcagggctgtaaatggtgcagccattttggaaaagaaaaccagttcttcaaatggttaagcacagagttgattctgtaattcttttcctatataccgaagagaaacaaaaacatatttccacacaaaaacctgtacaaatatgctcatagcagcattatctggaacaacagccaaaaggtgaaaataacccaaatgccttatcaaccaacgaatgaatacattactctacacaataaaataatattcagcagccaggcgtgttggctcacgcctgtaatcccagcactttgggagactgaggcgggtggatcacctgaggtcagtagttcaagaccagcctggccaacatggtgaaaccctgtctctactaaaaaataataataatacaaaaattagtcgggcgtggtggtgggcgcctgtaatctcagctactcgggaagctgagacacaagaatcgcttgaacccgggaggcggaggttgcagtgagccgagatcanncnactgcactcnagcctngngacagagnnagactcnntctc

SEQ ID NO: 165981 - DNA, 521 bp, Homo sapiens
tcaatgtgccgcagcgggcacggaggtaacgtggacctggacggtgcctgtgagtgatgctgggggacaagacgccacacctgagatgatcagcaacagagcaggcagaagaaaaggcgaggacccaggaggaggcctggtcttggggccacaggtgcttgcagaggaggtgggactttcagctcagatggcattgagattagcagagtagggggagaaggtaccccattggaaggaagttttcctgcctcttggtactccttcctttcagtttgccccttaaatttcagggtatcttatataattcgatctcaggctctgctcaggctacaccctctccctggatgacagcatcactctggtggttctgtctccctcagacctgtagatgcctcagctgtcccaaccagaaacgtggattccccatccttgcccctgtcccccataatgaaaaaaaacaaattccctccatcctgtttcacccgatcaataattataaaatgcaaatatctctctcagag

SEQ ID NO: 165982 - DNA, 490 bp, Homo sapiens
tccagcgcaggtagaagattctgaggccctgggcgggaactagtaagccacaatctggaagagtcttttaccaccatgtggaggagaactagagcactcatgttgaactattaccgagaaaagtaatcaacttcttttgtgttaagtcactgaaaggcaagtgttgatttgttgcagtaattggtgctcccttaacacacctgtcagccgggccaaactctatcacagcataaataatcttttccttaaataaatacaggtaaaagaataaagtagacctaaatgcattaatatgaatataggctcaaagcaaaatgttgggctataaatgttcagagtgataattttttaagttgatgtgtaatttagtacagtaaaatagataaaacctaaatgttcagttcaatgaatttttacatgttcatgcccctgtataatcacctcccagaacaacatagaaaatacttcatataaatggaatcatacagtg

SEQ ID NO: 165983 - DNA, 390 bp, Homo sapiens
cacacacacacacacagaggagagaggggataaagggagagagaataaatgataaagcaaatggtgagatttgctttaccaatggtaagactgtgtggacaaaagtacacaggaactgtactatctgcataatatttctgtaagtcagaaattatgtcaaagatttaaaaacgtgtgagccaccgcgtctggtccctcagtaggttttaaggagcctccagccttccttctccccttctgggcctgaccagctatactgctctgtctcccccagccacatgccccaccaagtactgtagagagtcccctacccagggtccctgcaccatgagataaggtgaaataccaactgtggaccaaatgcaataaaacctctgtttttaagaagaa

SEQ ID NO: 165984 - DNA, 251 bp, Homo sapiens
gccactgcttctggccacaacatggtgttttgatataagtaaaccttgtgtcatgagtcttacaatcaagctaattaatgtatttgttacctgacatagttaccttttttgtgtgatgacacttaagatcgcctttaggcaaatttcaactgtaaaatactgtatgttattaactgtggttactatgctatagcttagatcactagtacttattcatcttataactggaaacttgtatacattgatcaaca

SEQ ID NO: 165985 - DNA, 458 bp, Homo sapiens
ttttgacagctgactattggaatggggtgaaggtctcgaatgaggataaacatgtgtgctgatatccatcaagatacagatttctctgttgtcattaattatgaagggataaggacaccattgttgtcaaattgtttttctgtagggccttatccatgtaaaatgtaaacctgttacatctgcatgaattgaaaggcttgtgataaaggcttagccagtcatgaaaggtaattttagcagatggtaatggctcaaaaattacctcttattagtcacatgaagatatatacatattaagttcaaagcatttttcttcttctttccctcctttccctgagtttctcttctttaagaccatactatgtgacctctggtgttttaggcagcaaacaccagctcaattattttccttttgcagtggctttaaaataaagttcttctgacagtttataaaccta

SEQ ID NO: 165986 - DNA, 421 bp, Homo sapiens
ttgaagcttgtgggacgtgcctggtgaggatattccgttcaatgacacatctgtcatctttacatgttgaccagccaacaagaacttgctgagtacaggacggacaaggttggcattccgctggctctacaggggatcaacgggaaggatggagagaacagcttgtgtgccaggtggggagacggacatggaccaatactgaataacctacaacacaatggtttagaaagagaattcaaggtatgtggactggacttaagccatggctaagctcacaaaagacttcctggaagaagatgtacagcctatggtgaggcacaacctccctgtctgtactgcgagttcttgggtcaagacacaactcacctctacctatctgtacactgacagcaaagtccttttaatatcaaacagaaatgaa

SEQ ID NO: 165987 - DNA, 344 bp, Homo sapiens
tcccaaaggtctcaagcctcaacatcctggtaaccaagtgcacccagagggctggcagggtcacatggaggcaggggacccttggccccagggtggtcgtcttcccaggaggtccgcctgtcaggtcagagggcagcaggaggccaccccacctccccgggttccctcgagcattcctttgtcaggagcagctcccccaggatccaggcatccctggcccccctttgcccccgccctgctctcaggagccccctgccaggtgctctgaccacaggaaacaggagccctcagggccactgccagaggacggattctgctgccaaccagaggtcctggggctggcg

SEQ ID NO: 165988 - DNA, 122 bp, Homo sapiens
ctttgtgtcaaaaataaaacatgctccaaaagatgagacaatcaagcagcctggacttctctaacaaattcttatttgtcatttccctgtgccttttcgagcacactgtttaacaggataat

SEQ ID NO: 165989 - DNA, 332 bp, Homo sapiens
atggcagaggcaggaggctggggacatggggatgatgatgccattcaaattgcaaagtgttactgatgctggttctgttgaacactgctggaatattgaatatctgggctatgagcatttttcactagtaattattcacacctcattaagatcagacatcagttaatgtctttctaggtagagcaaaaagtgaaatatttattggtcagtgagtaaagtcctggcatctaggtcagttaagaagatgaacctctcttggcaacttgggcttttggtgatagacagtatggttggctgtgtaacattcttaagactagtaacagtcagaacaa

SEQ ID NO: 165990 - DNA, 365 bp, Homo sapiens
cagcggtttcaacactgcttagatggcctactgtcttttccctagttaacttttcctactatttttaacagttatttcaacttttcccccctcttcaaaccccaaacttaccccttctcttttatgcttagcaagtgggttttcttcctaatttacagagacgatagaaaccgttggaagacagcttcaatattgtccacttcatctgtgttgaagactcttccagagtctcagtagcagttgttcctgtctaaaggtggatcttttcacctcagctttggattatatctcatcccctcctgcttcttagggaacaaaacaattattttatgttcttttcgtatttcctggacattctgttctta

SEQ ID NO: 165991 - DNA, 495 bp, Homo sapiens
tcgagactccaaagataggcccggccagtgcccccaccctccccagccaagcccctggcctgggagcctgataagcagtgacacatgggcccttcctcctcagggaagctgaggcacctataaacagaggccccaatttccagggagctccagctctgccaaggagggaagccaggatctggctctggccccaaagagccaggaatagattccactggaaacacatggaagagaaacagggcaggatcactcatcaggcccagtataagtggactgggggtcacatatgcgttgctgagagaagggaacacatctgtttgggcaacaggatctccagtacttatcccagtgcttaataaatgtctgtgactgaatgtcctggctgaagggaagcctgtcctctaagctcaagctgttccttgtctgttcagtgggtggtcatttacttaccgctgcttgaaattagatgatagagccatttgtttactagcccat

SEQ ID NO: 165992 - DNA, 321 bp, Homo sapiens
acaacagcttttcctgaccatgctatgtctctcacctggagcactgcaggtgtgctgagcctctccagcaagcccggggacagccgcatcctggccctgacctcgtgcccgtcgccccggcccacctgctgctccccacacccttcgcctgctctgtcctggcccaggcactccaagccagaatcctcctactagaacctggggccccatcatgcagcacagatctcaattcaggaccccctgccatggacaccctgcctgagggccggctcttgtggcctcccaccacatggcctcatcacctgaaaggtgcctgagaga

SEQ ID NO: 165993 - DNA, 255 bp, Homo sapiens
tctgacctcaaatgatccacctgcctcggcctcccaaagtgctggtgtgagccacagcaccaggccttggggcttggaattttatattaacactatctcttgatttctcttatcttctttctctccagatttttccccagattgcctgttctcaccagttcttctatcaatgctaagaacttggctttagtgtaaagtatttaagcagccaaagataagaaccttctaacttttcatttatacttgcattagcct

SEQ ID NO: 165994 - DNA, 488 bp, Homo sapiens
ttcttgagaaacttagtatttgtgaatgcttcctctatttaatatgtatgcaaatgtttttaaagacctaggaatgcttttcttgaggacctggaagccatttctttaaaatgtaaacatcaaggaagatagggccccagtctccttgtcactttgggagtttaacctaggtgcgttattcctaattgtaaacacctgtttcgttatggagctgtgcattacttaggaggaaagccgttagctaacacaggtggttaccccaattaccagatgaattaaagaggaaatataaaagaatgtatagaacactatgttaagccctcttacatgaggacacgttaccagtttccttgagaatgtgtaatggattgtgtctccttggctgtataaaagagggatttccttctctctttgtaacctcattagcagattagccgtgatgtgcatcaaagtctagttgaatgcctaataaaattgttgtctttctg

SEQ ID NO: 165995 - DNA, 357 bp, Homo sapiens
tcagcgtcagagcccagcctcacagctgccccgcaagtggcactccctctccctgcctggagagaggagagtggctaggaggctggggaagcagaagtgagaacatccctgtagaagggccacaggctgagcggaaaccgggggctgagcctgacgccaacaatgtgtttccgcccacacaggctggggggcgcctggcagcccctcggaggcttgaatcagctctcacttccctcctttgcccctattttaggccctggaaaaatgctgacgctgcagaggcaacgggccttcttcccggacagcctgataggggtttcaagttctcttttctccttcaagaaaattttccttaaa

SEQ ID NO: 165996 - DNA, 646 bp, Homo sapiens
gtttttttgtcactgtgaaaaacctgaaataattacaacttcagaatgtgttgtacttctcaattgctttatgttttcaatttagcaaactcattctcaaatttcccacaagctttgcaaatcagtgtgtgtgattaaaagggtatggtgggtgggtttataaaattataatgtacttaaagatctaaagaactcgtataaaagatgaaatatcttattatatccttacttgcttgtttaaaagaatatgaacctgacagcaaatattctaaaattgtctagtatctttcccccaaataagttaaaatcacattacaaagtttatatttatcagaaacaaattagaaacatatcaaatttgaaattatccactattcatcttatacaacataacccctaaagaaatcacttgtattagctttacagcttggatattacacaggaataaatatcaaccaacattgctattttattgctacctgatctactacagattactttcatatgtaactacattagaatgaaaatactggggctactttagaaaaaggactgactgtgaaggtcagtttcctagaaacaagaatgacaaacttctatgactacatgcactttttctaattattcataattaatctttcagaaa

SEQ ID NO: 165997 - DNA, 407 bp, Homo sapiens
gctgggattacaggcatgagccaccgtgcccggccagaggagccctcatttatagcaagaataaaaacattttgtcaggaaatttaataataagcccagactgagtgcttgctatgtgccagacactgttctaaatgctttacatgcatttcttcatttaatcctcacagtgtcctgaattaggtgctttattttattatttccactttgccagtgaagaagcagaggtagtgagagggtaagcaacttgcctgaagttaaaagctagtcagttgtggacttagggtttgtagccaggcagttgtggtcttcagggaggggacataacatcattcccctcctgaaactccatattcctttgtaaatcttattctgtgttacatattttcctgtccttcatttagtta

SEQ ID NO: 165998 - DNA, 338 bp, Homo sapiens
gggcactatgtgacaaaggtctagtgcgattggttggagagaaattttacagtacctcgtaaaacttatagaggtcttatgctttattctaagggtgacaggaagcccctccaattttctctacaaacatcacaaggaaaagtgaggaagaattgtcttacagtgtcacttgatactttgcttttaaataaaggcagctaaaaaaaaactgagatagaattttgacccatttataaagctattctacccttcctccccccattcttctcatttcctccttccactttctctcccttccctttcttttcttttcttttcttttctcttttcttttcttt

SEQ ID NO: 165999 - DNA, 471 bp, Homo sapiens
actcatgcgcatctcctggcttcagccctgtgctgttacgaccacagtgcccactgccccagtggcttctgttgacagacctgtgctcacaatcaaaaagacgccccataaaaacccactgggcagtgatcagcaactcgccttctctaggtagagagaggacccaggtaatgccagagaggcaggccttcaacagtcatggtggcctccgcgcctggcttctgaaaaccatagctagaggctagtcgggtttccagcatcaggaaaagagcctggggaatgcatggggagggaaagccagactccacctgcaaggaacacactcactgaaagcagagcaggacataattaagcctaattgtgtaaaccctgccatgccttcgagtgagagggatgccaaggtctcgtgtttccttccgttctatgcagcctgtgcatccctacctgaaggtcaccctcattaacgttgcc

SEQ ID NO: 166000 - DNA, 314 bp, Homo sapiens
agcctggacaacatggcaaaacatcatctctagaaaaaaatacaaaaatcagctgggtgtggtggcgcatgcctgtaatcccagctactcgagaggctgagacatgagaattgcttgaacctgaaaggccgaggttgcagtgagccgggttggtgccactgcactccagcctgggagacaaagcaagactccatctcaaaaaaataaataaataacgtatcactttaacccttttgaagacttgaactgttaattttttagacattaaaaattgtatccacaagtatccaagatatctgaggtattatgttaat

SEQ ID NO: 166001 - DNA, 463 bp, Homo sapiens
actttgggaggtgtctgcatgtctgtagtggggacgcctgtattggaagatttaaaaacctagcatcctgttctcaccctctaagctgcattgagaaatgactcgtctctgtatttgtattaagccttaacacttttcttaagtgcattcggtgccaacattttttagagctgtaccaaaacaaaaagcctgtactcacaccacgacacagtaccacgacacagtgcaccacgacacagcactgtgtttgtgctggatatccctttatgagttttaagaactctgaaatgtgaaaagtacaaataagtaatctcttgcattcctattttagtcaaaagatcaggctccaaattgctttattcatctttgagtagtattgcagaaaattttaactgaaaattatattcaaaatactgttttcaatttcctaatggaactgtaaccaattagtcaaccacaatta

SEQ ID NO: 166002 - DNA, 345 bp, Homo sapiens
ggacccaccctcagggcagaactgtgggagaaaagaaaataatacagggattctcttggtatttttggccacttgaacctcattcctggttcttcctgccagaaagataggagttttagctgctggctctgccactgctgctaactccatgactgaaggttccagttttgacttccttccacaatctgcctgcttattttacttttcattcttcaggtagttgcttattcagtgttgtccagagtttctagttgtaatcagtggagttgattatccatctttaacatattgaatctttgcctaaattgactgactaataaatgttgactaatttctttattcaat

SEQ ID NO: 166003 - DNA, 560 bp, Homo sapiens
tcccgagtagctgggattacagatgcacgccaccacgcccagctaatttttgtatttttagtagagatggggtttcaccatgttggccaggctggtctcaaactcctgacctcaaacgatccacctgccctggcctcccaaagtgagccactgcacccaggcttaattcctttatattcttgaagacggtcaagggctcaagacaatgaaattagaattttaaaaaaattttcttatttttgagatggggtctcactttcttgcccagacaatggtgtgaacatggctcactgcagccttgaccttctggtctcaagtgatcctcctgcctcatcctcccatgtagctgggccacaggtgcatgccaccatgtctggctaattttttgtagagatagggtctcactattataagctcaggctggtcttgaactcctgggctcaagcagtgtttctgccttggcctccgaaagggctgggattacaggtgtaagccatcatgcctggctgaaattggtttttggatgtttcttatataaattttatacgtggtgatctgtt

SEQ ID NO: 166004 - DNA, 482 bp, Homo sapiens
cacttagaaaaggcctgtgctttgcaggatcattggctcagggagacttaggaacttgtttttcttcttcctgcagtgctctcatctgagtcgttgaaagcggggaaaagaagttttagtaaagccaggtctgaaaacaatttcctctgtctccgcaggactcgagctgaagtgcagatgaccacattcaaggaagaaccttctgccccagctttgcaggatgaaaagctttcccacttggctgttattcttccacaagagctttgtcaggactaggttgttactggttcagcaactctgcagaaaatgtcctcccttgtggcttccgcagctcctgttcttggcctgaagccccacagctttgatggcagcgcctcatcttcaacttttgtgcttctctttacctaaactttcctgcctcccctgcatctgtactccccttgtgccacaaacacattgcattattaaatgtttctcaaaca

SEQ ID NO: 166005 - DNA, 342 bp, Homo sapiens
cctctgtgtcccttcgttgtgacattaagtcttttaggctcagaatctggtttgagttttggccgacacaagggcttcccgcgttgctctaaatttagtcaacttagcaagttttctttttctccctcttacattttgaccttaatatctcaataacagtgttttcctaagacctgagagtgattttgtctaccctgcttagagaatcttaatctaattttctaaagaagaaagagaggtagaggaagaggagaaaagggagagtgggcagaggaggagaagagaacgatgacagaggggtctattgtgacatctgaacggaggagaggagaggggtgaaga

SEQ ID NO: 166006 - DNA, 363 bp, Homo sapiens
atgaagcaaaacacaaaaactttcaaacctgaactgatcctcattctctcctaagtccttatttccttgtctagttatgcctagggaacaatctgttggattcacttcaggaagatatcaggagaagacaagagcagagccatttgcttttctctttctcccacttcacgcaaatgaaaactgatggcagaaggttgcagaaagagaagcccaaagcattctgaggcacaaagtgagttttcattttgggaagaggagtgtgcccaaggccttgggcagctgaagtcaatggtgtttatctttgtgcaattctgaacttaaacccaataaatgaagtacatgaaaagcaccataggaattaaa

SEQ ID NO: 166007 - DNA, 366 bp, Homo sapiens
ttatgttcatcttgagtgatgctctttgcagaaaacctaacttaatttaagaagaggcccttctgagggcttttggggaactgcacaggatttatcctattagggagaaagaggcactaggctgtccgaatctgtggttaccgaatactgcatcatgtaacaggctccctttcctgatttcagactcattaggaagtctccccatcagaatttgttttcccaagtggattttcacagggagaaagcctctggtcaaagtccccgaaggtggcctccttggggtgatttttaaattccaaatcagtaggttagcatatgtccttctgcatgtcctggggacagcagtgttccagtcccactaaccct

SEQ ID NO: 166008 - DNA, 289 bp, Homo sapiens
aatggtactaaataatataaggttaattatgtttatttcaatattaatactttactgacagctgctacagggatgaccgaaaggataagctgtacaaagaaaacatttctaagagcatagttaccaaaattttaattgatgtaagcttcttagtaaattcacccaaatgcacacatattttaaagaaacagcaacagaactggaaaaactctacaggtttgtgtaccacgccctctttggcatccacttccccattccttcagtgccaaagctctggttcgagtgctgg

SEQ ID NO: 166009 - DNA, 536 bp, Homo sapiens
cccagctctactcccacctccctgcaaggcacatacactttcttcttgaggatgattctccaagagaacctcccttgggaacagatctttggagaggatggaagcctcctaagaagatgcctcgtcttccgaatcttccttacctccctccctctgagactcccttaggggtcccactgcttactctgcccttccagtttcactgcacactggccttctcattcagtaagtcattttgaagatatctattgagtctctactgtatgccacgttctgtgctgggccctagggatgcagcaaagaagacaccatggtcgcctgccattatggagtttaccatcctaggaacaggcaggtttgcttgagccatcacctgcactctctccttgttactctgtagtccagaccaggcaaagctgaggcgtcttgtcaatgttaaggtcataaggagtgaccaggggtcctgaagctctggtcaccattgtggggtcacaatgttaaggaaacagagttaggctggcaaaacaagggaaaag

SEQ ID NO: 166010 - DNA, 354 bp, Homo sapiens
tctaatctttgaaaactatgttcaagttaaacatgcatactatccacgctgataaagtcattaacatactttacaaaaatgttaagcagaaacattaccggtaaaaggaaaagggagcaggcaccagcagccatggagcacatactccagagcgaggtacttctcattatctcgcttcctcacaataaccccgtagagttagaagcaaaacgatgagctccacattaagaatcctggtctgccacttttccttaatgtctcacttaaatcttccattagcaaacactaatacactctctttgaacgatttaaggaacacatacatattgttcaaattcatttccagattctaac

SEQ ID NO: 166011 - DNA, 191 bp, Homo sapiens
gcaagattagcacaaagcatactaatgttttttgaaatacacccattgttaacattttgtaccatttgctttatcatttgcactctgtgtgttgggggtctgtgtgtgcagtatgcaataggtttttcttaaaccatgttagagtaagttgcatatatcaaagaaataccttttcccacaaataaacttaa

SEQ ID NO: 166012 - DNA, 289 bp, Homo sapiens
acttagctctaacagaggctcatatgattatgtctgttagaggaagtgtcaaaacaagagtgcctaccatgtgatagacagcaggtagccagtgaatgaaggaaagatgaggtaagaggtataatctttgtgtaaaaattgggggcttaactgggatgcaagagatcttttcctcataagtatgtaagtgtaataagatgtcggccgggcgcggtcgtcacgcctgtaatcccagcactttgggaggccgaggcgggtggatcatgaggtcaggagatcgagaccatcc

SEQ ID NO: 166013 - DNA, 666 bp, Homo sapiens
atcagcagtcacctgaggagttgcgcctccccccacccccttttaaaatagagatttccagtatttatcagcaggtctttctttttttgtccagcaaaaccctcccttcttctcccctgtgtttttgtctccctaggtgcatgaggcaacatgtttcagacccactcttttgacttgtagaatctagccactgttattgtatatgaaacatacgctcattttgatgactagccccggaaacacattttattcctctttagcagaatattgaaatacactacaaagtaagactatataaacttctgtctgatcactatgtaatttgctccattatattccattttaaataactccattgtggatttggagaagcttgcatatttagagatttgacatgttttatttgttgaaattgtaatttttctcacagaatagtcctatgacagcattttattaaacaatagtgggtttatgtccatcacaccaatatacaaagattcaacttaagccataaatgaaaggaatagttatctaattaaaaactgctgttactaaaccagaggcaaaaaaaaattagataacatttatgtaagacttactgtcctacttgaatatgtaatgtttcaatgtttcagcccaataccagtgtttgacctgagagaggta

SEQ ID NO: 166014 - DNA, 455 bp, Homo sapiens
cgagaccactgaggccacgacgtacatgcaccaaccacagccacgggagtggcctggagcccggggccctctggcccgctgaatggtgaggataaatggctggtgctgccttggccccaaagctgtgaggagctctgtgaggatggcgagagcacccccgcactgccgtcccctcaggggcatctactgcctaagtcatgtgtcacaactgtctatggcggcccagggcactggcccctgcggaacacctagagctgcatgcccacttgccataaagtgggacaacactggtttcgacaccggttttggggtgagcccagtggatggtacaccctgaggtctccacaagcaagcagtggcacgagacagactcagtctccctccccagaattccccactcaggggctggggtggggtccagacatggtgcgcccagtgaccacctggagccaggc

SEQ ID NO: 166015 - DNA, 659 bp, Homo sapiens
gccagacttaaccagtataaatttgaaaggtgtatctctggcttttatccttctgaatataaatgatcttcagaaaatttataccatgatctgtaatgttttcatatctctgtttcatctttgtttcattttcttcatctatgaaatcaatgtgttatatttgtaatcccatagttggtctgtactcctctatgtgtagtcatctgggatatgctagcatcacagttacctggagtcatcttgaatatggagatgacagggactgattttgcagattcgttgagttggtgggatatgtaaatatgtttttcaccaacaaatcagatatttctgttgggcagccaagtgtaataaccattgctgtaaatgatctctgtcctctccaaatcacatgattaattaaattatgtgaatgcctagttgactgctagggaatgcttgtactttggaaatattttaaccaaggacactctagaaattctcttgctctcccacctcatcagtgcaacttgaggtttcttagtgcagttgtatgggtctcagaacttcttctgttggtatttggtgaagagataagagattaaaactgtgttgcattttatacctttactcttgcctccatattataattttactgttttaagtttattgcaagtgtt

SEQ ID NO: 166016 - DNA, 487 bp, Homo sapiens
tttatattttgacatttaaggaaatatactttgacattgtccattgcccagaataaattaaaaactttttcagatgataaaggtatttcatcagcactgagattattgcttatagcttcttgtttagtggtatgccatactttgattttggttttataaaattttctgtaaagagcattgagaagcctttcctcatgttgttgctgcattgtgtttaggctgtgtcttgagagaatggcatttcagattgacagctttcttcaggctgtgaggtatacagactttaggacttcataaagctgaagtatagatttttggggaagatattggggattccttgaactccaagagcaaatggtggctgctgcattctgagttcttgctcttttgtaattatacaagagtttctggatttggtgttttataaaaccataaatcttattttttcagctcacttgataacatagcaactttgtagaaactctag

SEQ ID NO: 166017 - DNA, 153 bp, Homo sapiens
aaactgtcattaattgtttatatattgctgatgagagtgttttgaagtatgagaaaaaagagtatagagaatatattactacaaccgctaggaagggcaatttgtaatagtgatcaaaattaaaaagtcccatagcctttgaatcaacaattc

SEQ ID NO: 166018 - DNA, 551 bp, Homo sapiens
aaagctccatgagagggttatctataatttctgtctctaaaatccctgttcctactctctctttttaaaaaaataaatttcattgtgtatgtttatgatatatagcatgatattataagacacacatgcatattaaaatggttactaaaatgtaacagatgaacgtatacatcatctcacatagttaccctctgcccgatgcccttggcaagaacagctataatctactcatttagcaaaattcctgaatataatacaggattattaattatagttttcaggttgtattttaaatctttccacttgttcgtcttacatatttgctattttttttgcaatggataatgtacttctaaaatttatatacatttatggggtacaagcgcaattttgttacatgcatcgtggtcaattcaagactttcagggtatccatcacctgaataatgtacagtgtactcattaagtattttttcctcattccctctcctctcaccccattactcgttcaagtttccattgtctatcattccactctctataccaatggtg

SEQ ID NO: 166019 - DNA, 514 bp, Homo sapiens
cccagcagcagagccttaagatacaggaaagaaaaactgacaaaattgaagggaaaaatcaacaattcagcaataatttggagactttgatacgccacttttaataatggatagaacagcttaagactataaaccaatgaggcctaacagacatctatagaacctcatcagaatacgcattcatctcaagtgcaagtgcagcattccaggatagaacatatgctagaccgtataacaagcttccataaacttcaaaggattgaaatcataaaaggtatgttctgtgaccccaatggaggaaaattagaaattaacaaggaaatttgggaatttcacaaatacatagaaatgaaataacacacttctaaataatcagtgggtcaaagaagaaatcaaaaaggaaatcagaaaacattttgaagtgaattaaaagaaagataaaacatactaaaacttacaggatgcagccaaagcggtggtttagagggaaatttatacttgtaaatgcctgcgt

SEQ ID NO: 166020 - DNA, 182 bp, Homo sapiens
tgctggaattacaggcttgagccaccgcacccagcctcctgacccttcttataagggcactaattccctcgtgacttaattacctcccaaaggtctcacttccaaataccatcgtactggggaggcttcaacatatgaattttagggggacacaaacattgaacctatagcactaccatttc

SEQ ID NO: 166021 - DNA, 248 bp, Homo sapiens
gagttttgaaggttcaaaatcagcccaggataaccatggagctttggttgaaagtgtaagcactcacagggcattatggctccagggtcagggcatgcattgggttggaaaagatagaagttcctttcctgaagcagttcaacactagccacttcctgagtgggggagaggtgtgcagccatttatacctctctggagttccttggtggctgtggtttttagttacctcagtggcaaaacatgctggt

SEQ ID NO: 166022 - DNA, 433 bp, Homo sapiens
ttgtctgctgctgtgacctgtagctcctcgtacttggtctggtaccaggactcagcctcagcccggcttctctgagcaatctcctcatattgggccttgacctcagcgatgatgctgtccaggtccagattgcggtgtttgcaaacacccaatcttacatggatgcttcccacgtgcctgctggaagcacctcagccacataaagtattcatcatctgtatcatgctttggaatccagtagggccttccacagcaccaacttggctaagcctcactgcagtcccataagggttgtcattccccatcttactgatgtggaaagctcagagagccaagagactttactgagtcccaggagaggacagaccagaactgacccaggtcttctgacaccagggtctgggctcattctataagccaacagaatttacct

SEQ ID NO: 166023 - DNA, 410 bp, Homo sapiens
attaatagatctaaaaggagatataggctgcagtataattcaacagtctactttcagcaacggacagacagaaattcaacaaacaaacactggagttaaactaccctctgaaccaaacagacctaactgacatttattgaacatttcatccaacagcttcagaatacacattttttttcatcagcacatggaacattcttcagaacagaccgtatgttaggccacaaagcaggtatcaacaaatttttaaaaataaaatcatatcaagtacattttctgaccacaatggaataaagctagaaatcaataaaagaggaactttgaaaactacaaatatcatggaaattaagcaacacggttctgaacaaccaacgggtcgatacagattttaagaagaaaattttaaaatt

SEQ ID NO: 166024 - DNA, 506 bp, Homo sapiens
gacgccaaggggttaaggtcagcgtgggtgcctcgcagccagagacgggtgagcgttttctgaggctggaagctgattgagccgagtggaaacgggttcccttgggctttgcggtggtggagagctgctcttgcactatcagcagccccatcacgggcttgaatgttgcggaaacagagcgccttgttcttagaggactcggcttgctggatttattgcctggcccaggcttgcttcccgcactgggcgaggacgcgagaactgccagacggtagttgccctgaatgtaccggtagaaacttatttttaagcgttccatgcactacccaggtataaccactttcttccctggggtgtggagaaggggagctttgctaggtctttgtcttagctgtgtagtcctaggcaagttacttcgcttacctatgcctcagttttctcatctgtaaagtggggatgataacagtacaaaccttaaagagttgtatagggataaagtgcttaaa

SEQ ID NO: 166025 - DNA, 240 bp, Homo sapiens
ttcattccttccttccttcctgcctgcctgccttcctgcctgcctgccttccttccttctttccttccttccttcctttttccttcttttctttccttccttttttttcttcctttttggtctcactctgtcatccaggctggagggcagtggcgcaatcacagctcactgcaacctctgcccccccgccccagggttcaagtgattctcctgcctcaacctcctgagtagctgggatta

SEQ ID NO: 166026 - DNA, 238 bp, Homo sapiens
ttaaaaacatcatgccgagagaaaagcttaaaaccaaaaaaaaaagagatagttattgaaagatcatttacatatacgaagacatatgagcacaaaaatacattttgctgggagtcctgacaaaatattgaaaattggatatacgtgaacagtggtctgtatcagaaaagggaagggagatctatagggataaaagggaatgaatgaatgaatgaatgaagaggaaggcataaggcct

SEQ ID NO: 166027 - DNA, 471 bp, Homo sapiens
agccaagctatgtatccagaaagaagaaaaaacaagtgtggtaaagagctatcagtctatgcctcagcttttcaaaatccagtcttacggcgcacagatctagagagaatatgtagaccttatattatgtaaaggcattcacagaactatttttgttgttgttaacatacttgagcttccctacggcaatgttcttgtaggtttcccagactaatagccttcaaaatggaggtgaatatatacatacaagaaaaaaataagtaacttaagtcttctaataagatatgttttataaaaatatgaagaagatatagtaacagctccttacagcagtgtaagacctttctttcatccatctcctcacctatggttactatcctcacaatcccatttccctctatgtacattttactttataacattatgttctcatacacaaaaaatacaataaaaaattttccattatccaac

SEQ ID NO: 166028 - DNA, 319 bp, Homo sapiens
gtacattgtaacagtattaaaaggtgggaccattaagaggtgattaggccaggaaaactgtcctcatgaatagattaatgatgttattgtgagagtgaattttttattacaggaatgactgggttccttataaaaggatgaatttagccccctatttctctctcttgccctctctttgcccttctgccatggaatgatgcagcaagaagaccctcacaagattggtctttcaatcttggacttctcagcctccagaattacgatccaacagatttctgttcattataaatttcctagtctgtggtattctgttatagca

SEQ ID NO: 166029 - DNA, 561 bp, Homo sapiens
gctgggaatattgtgaatgtatgtttctcccaggaatggaggtgggcatggactgtgccttcttgcttggtccaaggaccaaggcaaggcaactggtccttgggggaagggagccagctaccttgtcttcactcttacccaactctgggcccagcctctccctaagtaggggaacaggatgttcagcaggattgctggggccacagagggccaggctcagagcttgcatgtgtgtgtgtgcctaacgctgcctcttttggcagaggagacttctgttgggaagcttaaagattacagagcaaaataagagccccagccaccagctaaggacattttctagcttggacctctagaggagggagggctgagagtcttgcttcctggggtgaaggtggctgatggaacaggccctgagaagttgctctgtccaggtgccaaggtagtgtgtggaatcgatgtgctgacttggagttagaagggagatcaagtcctaattccacctctgccaagatcagtgatggtggcagctgactaaaccaaagtctcaatcttctacttctt

SEQ ID NO: 166030 - DNA, 400 bp, Homo sapiens
ttaagtagcgtgttccaagtaagcatgtgccaccacgcctggctaatttatttgtatttttagtagagacggggtttcaccatgttagccaggctggtctcgaactcctgacctcaagtgatccgcctgcctcccctcccaaagtgctgggattacaggcatgagccaccgcgcccggcccctattgtgtagtttttacttatcttccaatacctctttttcactccttgtgtctctaagattcatccatgtaattgtagatcattgattttaccctgttacatattattccacagtgtgaaccttccattgtataaaacaattccattctcttgttgatggatatttggggtttttccccatagcgatgctgctatgaacctccttgggcacatctgca

SEQ ID NO: 166031 - DNA, 459 bp, Homo sapiens
tgagaatagcctaaatgttcatcaacactagaatggatataggattcatgatttatacataatggaattccatagtggaatgaaaatgaccgaaaagaagctcctctaaaaaatgagtgaatcctgtgcaaaagaagtcaaacaaaagaatgtatgattttattcatatgtacttcaaacagaagataaactagactctagtatttaaagttgcatgcttaggcaacaaactataaacaaaaacaaagaatgaatgttattaaagtcaggaaaacatttacatcttggagaaatagaaggggtttgtgatgggaaggcaggcacgaggtttttagcagtgctggtaacgtgcaatttttcttttaaaccaggattgcaactatatggcgtttgttagacaacattttaagctgtacatctgttctttgtactttttgaatgtgttctatgtttcaccac

SEQ ID NO: 166032 - DNA, 286 bp, Homo sapiens
gattgatttatgaaaactcaactcttccttgtttgtgtccttgaaccctcaagattttttgacatcttcgaatatggcctcctatatctcgttttcctcaccaaccacattactgaattcatctccaaaaagtgacgataatatcctattagtgaaaacacagtagctttttttactctaatttgttttgcctccattgaatttactgttttattttatttattttttgagactgagtcttgctttgtcacccagactggagtgcagtggcacgatctgggtaccg

SEQ ID NO: 166033 - DNA, 823 bp, Homo sapiens
tgcacccgggcttcagcgcctcgctcccgcccctggtaaacttcctgttgtcgggaggcagataccagctttgtgaccaattcaggaaaatgcctaactgatttctggttaggaattgggcggtcggagcgttctggagttcaatggaaccaccccaagcgcagactgcgtgcaggcgccgtagtcggcccgcaccggagggattcaaaggtgaagcgggccccggtcccctcccccgaggagcttaggctctggtgtgagagataagacgagaacacaaataactgcgataccgggaaggaggtgataagtcctgtgaaagaacgacggagtgctagaacggcacccggaaaaaccgaaccgatcacttctgcctcgcagaaacctggaaggcttcctgggcgggggatgctgagcagagtcttgaaggcctgatgggatttaggagaggaggattgcagaagaggtgtgtggaaggggtagcaaaagcgagaagacaaagcctagaaatcatggataattccgtttgttggcatggtgcagggggcggggggtattgggctaaagaggtattttggggccagatccttgaatgctgtagaggagctatttgagcagcattctaagagaaacttagagctcatttctcagtgactcatgagcccggaaatgtaggctagggggatattaaaggcgctcttgtgaaaggagagaggaggaggcccagtcaggagttgacattctgtgccttgaatgtaatgcagtttcagatcgattttgacagcttcccagataatcaagtaaatccatgcccaggctaagc

SEQ ID NO: 166034 - DNA, 238 bp, Homo sapiens
tttcactcagtgttttaacatgcggaatgttaacccaaacacgagccttagcaaaaaagtatcttctcagttgtgcagcctaccactgttaatggcaaataggcacatgagtgaatcacaaaataacagttaactgagggattcagctgacaacttttcatacccaggatttgatctttcctgattcagatggcagaagcttgtgttgtgattacataaacaataagaagtctggatt

SEQ ID NO: 166035 - DNA, 535 bp, Homo sapiens
aagtgtttcttgcccttagccttgggtactttcagtgtcttgctgaatccgtaagggaaccccccaccgatctctataggtttttttttctctctctctcccttccttccccgtcagctgcagctctcttgtctcctttccagtattctgtcctgtaaactctagctgcattcaccttcctagactctcagttccagctcctcaactcacagtctttaggggtgcccctgaggtccccactccctgtgctgtcacaatgagctgggatgattctagggctcacttcatttgtgtcttttctctctctgttctttgttccctaatggccagtgtcttggaaaccattgtttcatgtattttgtctgttttattgttttatgttgtttgttccaggcggagggtaaatctatccttgttactccgtcttgactggaagcagaagcctcattcattctgaatgttttgataagattttgtttcaccaacatacacgttatgtaagaagtctcatggccaggatgaatacacgatctag

SEQ ID NO: 166036 - DNA, 213 bp, Homo sapiens
ttaagttggtgtaaaatcaccaaggacagaacacagtagatgtaagaggggatcagtgatctcctgagcaccagttgacccccttggtcctcagggaatgggagagcagctttgaacctggctctgagaagagctgaaaaggaatctgtcctgcagcatttcccgggggagggaaatgatgcttgattgacttgcccagggttacagagctga

SEQ ID NO: 166037 - DNA, 383 bp, Homo sapiens
cctctcaacagcttctctttacagccaaggtccttgaaagaaccgcttgcatttactgtctcaacccaccttcaactttcaatacaatgtgaccaactttccacctgcgttcctccatggaaactcgtgtggcaaagctcacaaccagtgagcttctaagtgtcaaaaacactggatacttttcaggtctcttcttctggagttttctgtggcttttgagactttggatcaaaccctcagttctgaaactgtttcctcctttaacttctgaaactgctagcagaaccatttctctaacaagccaatctgatcatgtcactttcttgcttaaaacaggagaatgaggaaagaaaatggatgactgaccaaaaaaaaaaaaaaaa

SEQ ID NO: 166038 - DNA, 358 bp, Homo sapiens
cacacacacacacacacacacacacacacacacacacacgcacacacatgctttcactcagcctggtgcctggtgttggcttaattgtccatccttttctctatgaacaaattgcttcacttccacatttctgctgtgttggtttggagcttgtctgtccttcctgggatgtccttggccacatttcccattacccctcccaagccaccgcatttgctctttctctgaactacagactctggtccacttaggcccagtgactttctttatgttagaatcatcaaggtcattgaaattggattactcagtcatgtgtagacttggctaacttccctgtatgcagtgtgtatatatacat

SEQ ID NO: 166039 - DNA, 415 bp, Homo sapiens
accgcacgctatccggttcaatgcacacacacacacacacacacactcatatactcacacacacacacacgcgcacacacagggtttctctctgtctgacactgagtctctcccagagcctggtgcctggtgttggcttaattgtccatccttttctctatgaacaaattgcttcacttccacatttctgctgtgttggtttggagcttgtctgtccttcctgggatgtccttggccacatttcccattacccctcccaagccaccgcatttgctctttctctgaactacagactctggtccacttaggcccagtgactttctttatgttagaatcatcaaggtcattgaaattggattactcagtcatgtgtagacttggctaacttccctgtatgcagtgtgtatatatacat

SEQ ID NO: 166040 - DNA, 298 bp, Homo sapiens
tcaaacttctgtactcttacatctgcaattcacatagttttcatctgggttgtgtatctcaaagggaagaagccaggcaataaatttgaggttagtctgttgatactaatttaggtcacagaattccgtggaagaaattggtaaaggtgattgccgtaggaggactactcaagtcacagggaatgaagagagttctggctgagggaatagtgccacctactgaattgtgtttgtgttttctacaggttctaatttatgcaggcttatgcctggaagtgttactttcctttattgatct

SEQ ID NO: 166041 - DNA, 397 bp, Homo sapiens
cagagaagagagtgggagggaaggaagcagggagtgggttgggagcagaagtttaacaaaggatcactttaacagaaactactgagtaatcgctctgtcctgcgccaagaataacatcagctcaatgtctgcaattagaatcaggtcagtcaggcctcacagccggtgcagccctcctcacagaccccagcatggagagctactcatgctgatgtcaccagtagtcactgttacccaagaaagtccccgactcagctgaaagaaaagttttcttttgccttctccttcaggggcaggaagacagcaggagaagaaagacagaattagaagacatgcattgggctgtatcaatatataacagatttgtttgatcattcctaactcttgagattcagta

SEQ ID NO: 166042 - DNA, 154 bp, Homo sapiens
aaatattgtacaactactgtttaggatgtgatgagggaagagcagaaacctactttagagaaggtggttggagaggggcacctttgtaccagtttcctttaacttaagtcttgacggatgaggagccagcctcatgaggcccctgggggagaga

SEQ ID NO: 166043 - DNA, 318 bp, Homo sapiens
tttttttttagagacaggatctcaccatgttgcccaggatggttttgaactcctgggctcaagtgaccctcctaccgctgcctcctaaagtgctgggattacaggcatgagccaccattcccagcccacagactgtttttcattctgcctgcctggaccgcctgtcaataaatttacagaaaaaatatctaccctttaaaagctatttcatgcaagttttctccatctccaaacaatgtgatttcacactctactatctatggtaattattttttgctcttgttttacccacccccaccttttttttttttttttttt

SEQ ID NO: 166044 - DNA, 165 bp, Homo sapiens
atttcatctgacctctcaccagctcctgttccattcctatttcatctgacatctcaccagctcctgttctattcctgtctatttcatctatttcatctgatgtgtcaccagctcctgttccattcccgtctatttcatctgatgtctcaccagctcctgttccat

SEQ ID NO: 166045 - DNA, 114 bp, Homo sapiens
gtacatttcaaattttaatagggactcccacattatcctctttcctaaactgcacgttaacagtttcaatatgaataaaaggggacggggaggggagatttagagagaatagtg

SEQ ID NO: 166046 - DNA, 378 bp, Homo sapiens
gtgtggtgggctgggtagtcagcctccccaacatgtcaagaattgacatcaggaagaacaattccattttgtgtgtgtgtgcagcccagagagtgggatgaggcccaggagagtgaagggacagcacagcagatgtccagaaatggactgagggctgcacatatccacagagagacttccacaaagtcatcaaacccagtaacgccccaaacgctcaccaacaggaggttgcgtgaacaaatcaatggtatattcatacaatggaacacgactcactaatttaaaaaggaaacaacagctgcgtacacaacacaggtgaatctattaggcacatggcgtggaagaagccagacacatcctctccatgattccacttat

SEQ ID NO: 166047 - DNA, 536 bp, Homo sapiens
gtaagcaaaggcataatagatgtaagcaattaattgttgataaatacaactggtattgaaaataatctggcctcatttgtaattaaatgaaattcaaattttaaaaaattccaatcttgtatcttatattagcaaatctatcctggttcctgtatcataatgacaggtaagtcaatgatgttcactcattcccttttctgccaataatgatagttattagattctgtcctgagcaaatgcaaataaaaatgtatgtgtcaagatatttggaatagaattaattataagatatagaacgtaattatcattaatgtcttatattagaaaataaattgcagcattcatccttatgttgaaatgttgtctaccaattaaactattttttagaaagaattgttaatgataatgaaaataggagtgaaaataccaagatgtgaaattattggctatgtattcttaactatgaatcattaagtcattcacagacaaaagcctaaaaagaaatatgggtatgattatgattattatattcttca

SEQ ID NO: 166048 - DNA, 407 bp, Homo sapiens
gaacgttaaagtctgatttcttcacacttgtaaacaattgtattatatatgcatactgtatattttgtagttataagaagaaaaataccagaatttaaaatgcagtcacaatgtgttatgttttcagatgacttacgtatgtttttgttcatcagtattttaaaaaataatcacctgtttgtgaaaataatggttttgaaaacagcattatgatgagagggaacttcgtaatttcatgagaatgtagatggtgactgtttaagtgggagctcacataggcattaacatcaccctccttttgcacagtccttttaagtctcctgttaaacatcttttattgtgtgtatttaaaggcacacagatgctttttcctgtattcatcttacaaatttacctacatattcagc

SEQ ID NO: 166049 - DNA, 472 bp, Homo sapiens
tacctcatacagacaggagtggcaaattggattggaaattgctttggatcatttggcaagaactgtatttttggggttgtgggaggaggagaggcctgtctaaaagctctatttcttctttactcagaataccttcctgttgactcattggaaatcataacaaaaagcagaaggaatattggagaggcagctgccagcctagggcttggcttctgttggggcagctgtttggggatttagacacactgggctctaagaactgtgaggtttctgcagcagaaggaaatagtattactctgataggtatttattcataaggttaaaaagtgtcagactattgcttgggattattgatgagcaacataagaaactaaaaatattttctcaaatagaattaactggtgatcctaaaaacagaatgaattgaggaatacaagagggagtgggggcaaaattagaaaaggaaaagttg

SEQ ID NO: 166050 - DNA, 294 bp, Homo sapiens
tgtggtttcctgcacaatggccgttccctcttctttcttgttattcttccttgtctacctgacaaggagactgaaaagggaagctactttcctagcctcccttgaagctaagcagtggtttagtgacccagttctggccaatgcaatgtaagcaggactctgctgggggcttttggggatgtatttttcctcctgatggaaggatgtgggggcatatgagtgaagtctttctcaccatcctgaatgccccttatttcctgcatttggaagtggttgggtaaggatgtgatgtct

SEQ ID NO: 166051 - DNA, 490 bp, Homo sapiens
gtaaaattctagttcttccatgaatttaaagcttcactaaaaatatttgcttgtgtcagaatttttaaagttgaaaaatcaagctaaattaataaaaatctaaattatagatgtaaaaggcaatatagcattacatttttaagctttcataaaaagttttactaaatgtctaggtaagaataaatatataatgatttgaatagctaattaactgttctaaacagataagcaactttgggaggctgaggtgggcgggttgcctgcggttgggagctcgagaccagcctgaccagcatggagaaaccccatctctactaaaagtaaaaaactagtcgggcatggtggtgcatgcctgtaatcccagcaactggggaggctgagacaggagaagcacttgaacccgggaggcagaggttatggtgagccaagatcacaccattgctactccatcctgggcaacaagaacgagatttcatctcaaaaaaaaaaa

SEQ ID NO: 166052 - DNA, 346 bp, Homo sapiens
cttcgacacgtcagtacatacagattacctctttcctttatttaataactgtatagtattcctctacatggattctgtgataataataccactgagcacttattctaagccaggcgctgttctaagtgctgagcatgtattaatttatatacttcccacaacaaccctatgaggttgttatgcactattgttatcccattttacagataaggaaattgaggcacacagaacatttaaaaacttgactagccactaagggtcagagacaagattatgctataatttatttaaatatattcctaatacatacttgtttcccatatttctctgaacatccattacatgt

SEQ ID NO: 166053 - DNA, 179 bp, Homo sapiens
agggtggcattggaggtctaacctcattaacagcagatgcttttggaggactagactgtcaccaatcattaaccctcactctctgggaagatcacattctgtcaatattgctgctagttggtatacttcttccatatgtgtcagaattaaagttggaagccttgaaacaaaccattgag

SEQ ID NO: 166054 - DNA, 268 bp, Homo sapiens
agcttgctggactcttagattctgtccaccagaatattagaaccaataggtagagccttgggtcagggattccaggtgagtgggaagaagaaggggaatgggctgggagtacagggcgcctggggtgctgaccctggcatgctttcccagatgtgtgtgggctatgttggttctgatataggcaggaagaggcttatctgcccagagcactgtgtggtcccacaagtacacgtaacagatccccttatggggagaatgacaataggta

SEQ ID NO: 166055 - DNA, 301 bp, Homo sapiens
gagaagtccaaagactgctaatttcagtatcttcagtgacaggagcatggataagagaaagaaaagatatttatgtctttgaagtgatcagttctaggtgacgacaaggtccaagaagcgtctaggtgtacaagatgctaaagtagaataaagataaaagaatgccagagtgcagatagaataaactgtaaggctaaggtgttgggtagttcaacaatatgaatacatagtcaccaagaatgatggtaagagaaacagaaaacagaaaaaagttgagccagatatcaaagtcctcagcgac

SEQ ID NO: 166056 - DNA, 1843 bp, Homo sapiens
  misc_feature (2)..(2): n is a, c, g, or t
  misc_feature (4)..(4): n is a, c, g, or t
  misc_feature (8)..(9): n is a, c, g, or t
  misc_feature (70)..(70): n is a, c, g, or t
  misc_feature (104)..(104): n is a, c, g, or t
cnangcgnngcttttaaaaaattattatcttttatttaaaaaattttaacttacatttaaaaaaatgganatgggctctcactgtgttgtccaggttggtctcnagcttctggcctcaggtgatcctcccaccttggcctctcaatgtgccgggattataggcgtgagccaccactgcacctacacctggccatgctagggcttttacatggattatctcatttaattcttccctggtttccataaggtaggaacttatcctcattttgcagatggggagactgtgcagggattcaaacttgggtgctccagctcctgactctgtggccttggagacgccctgcactccaggacttgtgtttcctcacttggcggtgagtggttgggctggtccttgaggcctccaccctcaccagtggctgagcattcattcaatgggcagagagaacgttgggctgcagcagaatgggatctcccgtacagcagttggcaacccacagcggggttgccaggtcagcattgatgccttggctactgacttcacctttaaccccactggccatttttcaaatgaatgtggttggtcctaagggagagcaggtggaaagaccctggccccagcgtgaatccaggcactgctgtgcctgtctgagtagtgccctctggggaaccagctagccaggcaacctgccatcatgttgcctagtgagctcttgacatcagccatcttgaaaccattgggttcctttcgtccttcatctgtccacccatcagattcatagtcattcagcagtgactcctactaggaggaactgattctaggtataaggcactggctgggtgctaggaatatggagggaaaagaaacataggcccttgtttctgggagctgatggtctcccaccagataccgatgctggaaacccagggagaaggcaggggggagtctgagaaggcttcctggaggaggcagccttcgagattgtaaagtagagacatggtgtggcaagtccagggagcaggggtgggacctcgttcagttgcccagacgcaggcagagctttgttcaggggtgattcaggttggtgaaggccctgtgagtcacctggggctggtgaaacgtttcctctcctccttaggccacgacccagcctctgcataggccaagacggcccgtgaaggcttgtttccttgccccatttcccaggaaatgtgggagtgcaggattccactcccaggtcactcaccttgggggtggatgctgggaacgcggcctgcgccctctggttgtgtggccagcatgtttttctagccaaaggacttgggatgagatttttcatggaatattgagagagacgtaattgttattagaatcagttctgtttttatttattattattatttgaaacagagtctcactctgtcgcccaggctggagtgtactgtcacaatcttggctcactgcaacctccgcctcccaggttcaagcaatcctcctgcctcagcctcccgagtagccgggattacaggcgcgtgccgccatgcccggctaatttttgtatttttagtagagatggggttttgtcatgttggccaggctggtctcaaaaactcctgacctcaggtgatccgcccaccttggcctcccaaagtgctgggattacatgcttgagctaccatacctggctaatttttgtatttttagtagagatggggttttgccatgttggctgggctggtcttgaactcctgatttcaggtgatccacttgcctcgacctcccaaagtgctagaattacaggtgtgagccaccgcgcccagccagttcttctgtttttaaagt

SEQ ID NO: 166057 - DNA, 1767 bp, Homo sapiens
ggaaggtgggcatggaagggaggaagagctgctctctgggtcccatcacagtctcgttattaattataattattaaagtttactggcgtgagccaccactgcacctacacctggccatgctagggcttttacatggattatctcatttaattcttccctggtttccataaggtaggaacttatcctcattttgcagatggggagactgtgcagggattcaaacttgggtgctccagctcctgactctgtggccttggagacgccctgcactccaggacttgtgtttcctcacttggcggtgagtggttgggctggtccttgaggcctccaccctcaccagtggctgagcattcattcaatgggcagagagaacgttgggctgcagcagaatgggatctcccgtacagcagttggcaacccacagcggggttgccaggtcagcattgatgccttggctactgacttcacctttaaccccactggccatttttcaaatgaatgtggttggtcctaagggagagcaggtggaaagaccctggccccagcgtgaatccaggcactgctgtgcctgtctgagtagtgccctctggggaaccagctagccaggcaacctgccatcatgttgcctagtgagctcttgacatcagccatcttgaaaccattgggttcctttcgtccttcatctgtccacccatcagattcatagtcattcagcagtgactcctactaggaggaactgattctaggtataaggcactggctgggtgctaggaatatggagggaaaagaaacataggcccttgtttctgggagctgatggtctcccaccagataccgatgctggaaacccagggagaaggcaggggggagtctgagaaggcttcctggaggaggcagccttcgagattgtaaagtagagacatggtgtggcaagtccagggagcaggggtgggacctcgttcagttgcccagacgcaggcagagctttgttcaggggtgattcaggttggtgaaggccctgtgagtcacctggggctggtgaaacgtttcctctcctccttaggccacgacccagcctctgcataggccaagacggcccgtgaaggcttgtttccttgccccatttcccaggaaatgtgggagtgcaggattccactcccaggtcactcaccttgggggtggatgctgggaacgcggcctgcgccctctggttgtgtggccagcatgtttttctagccaaaggacttgggatgagatttttcatggaatattgagagagacgtaattgttattagaatcagttctgtttttatttattattattatttgaaacagagtctcactctgtcgcccaggctggagtgtactgtcacaatcttggctcactgcaacctccgcctcccaggttcaagcaatcctcctgcctcagcctcccgagtagccgggattacaggcgcgtgccgccatgcccggctaatttttgtatttttagtagagatggggttttgtcatgttggccaggctggtctcaaaaactcctgacctcaggtgatccgcccaccttggcctcccaaagtgctgggattacatgcttgagctaccatacctggctaatttttgtatttttagtagagatggggttttgccatgttggctgggctggtcttgaactcctgatttcaggtgatccacttgcctcgacctcccaaagtgctagaattacaggtgtgagccaccgcgcccagccagttcttctgtttttaaagt

SEQ ID NO: 166058 - DNA, 208 bp, Homo sapiens
ccccccctctcattttgaggtcttgtatagttaacaggatgaggtacagtgtggaaggatgattagggtaaacggctcatgccagtcaggaatgaaactcattcaatgcaactaagcatctctagaatatctccacccccaccccactccccaaagtgttaatgacatcacatcagttaactgttaaccacatttcattactcaattt

SEQ ID NO: 166059 - DNA, 1410 bp, Homo sapiens
  misc_feature (8)..(8): n is a, c, g, or t
  misc_feature (30)..(30): n is a, c, g, or t
  misc_feature (33)..(33): n is a, c, g, or t
ctcgtgcnctcgtgccgaattcggcagagnagnaacctccaggagacccactctgctgtcttgtagctggagaagatggcgcacccatcccccaccaggataaagcagagcctgctgcctgctgaggggacacttggggaaatagcagactcagaatggacactctacaaccctgggttggatccagtggttaggttttagaaaggaacactgaacaaagttcaaaagtagaaataccaaaatagagcagaaaccaagctaagagtgtgtttctgtgtttgaggaccaatatctgttcgtgttcaggagatgaggtgcagactccacactggggtcttagaggcaccagtgggaaagcaggactggggagagatccaggactgagccagcctcaggccagggcgggaaagcaggctgtccaggctgggcttggtggtcaggaacaggggcagctcacggtggctctggagtacgtttcctctgtcagatgcttcaaggtttttttttttttttttatttggctgaggcagtttttgctccacaggcctttggggttacagattgaggccctcggggcttggacgtgcttttggcagaaaacgggtgggctcagccctttgaaaagctcctgaaatataaggtgtgagtcactattccaagctttaaccgtggagtgtgcagataaacctaggaacctttcccacaatgtgtgtttttggggttgggtttgaaatgcaaagctctaaagtgtgcaggtgggtgcaagcctcagtttacgtgataaccctcgtggccctccgtggaattcaagtgtgtttagatagcgtggggattacaaagagcttgtgtgccccaaggcccagtataagtagggaattttcgagtaaacactggggctttccacccagtgttttgccccaggcgtgtgtcatatggaccctcccagatctcaaagagaactgacatgaccccgaaactccccaaaggtggcggggaattacagggtgttaacacacgggtacacaaggcgtgttatagatcaacgattgtataaaacaacgggggtattatcccccgtgttggccccagagatatagttcgacgaacgcgacgacaagagagagtgttgtccacaggtgtctccagagagggggtggaacactgaggggtacaccaaggttgcgcgcgtagtgagggggttagaacattcgacgcacgatccgggggcagagaacttctttttttgtcttatcgtttttcttcacaatacgggaatccaaacaagcatatataatagtcaaaaaacaacgacagaatatattgataaaacgcaaaacttgtgcgaataaaaacttgtatctgtccctcttctatttctcttcctctatcttctcatgaatggaggagaga

SEQ ID NO: 166060 - DNA, 247 bp, Homo sapiens
agttcctagtccagtgagggtgagtggacaagtacattaaaatctacaaggttgaaggtgagtggtgttctaagaggtacaatggaggtggaggggtcttggcagtaagacacagaatgaaaagacctcctgagggtgcctcaaggggagggtgcctatgtgaagaaacagatggacaagaagagatggatatgtgtgttcaaagaagcagcaatttaaagaagcaccaaaggctggtagtgggctg

SEQ ID NO: 166061 - DNA, 316 bp, Homo sapiens
ttatcaagaggtgccagagacaaacaaagacttttgcttcgggcctcgtcctggtcagacaatgccctgcctataatcttgtctttcctacatatcccttttgatatcagcacttatataccacattcaagtgctggaaaacagtcccgaagtctctggggcctgggaatccaagcctgctggatagtcaaatcatgtggacaaggttaactaaaaaggaatctcagcctcctctttggacacgatttagtattaccacggcaacagcatctggactatcttgtttcctatactccccactcctcttcagacgcgc

SEQ ID NO: 166062 - DNA, 109 bp, Homo sapiens
tagggagtggtatattaatactatacataaacattgattgagctcgggggggactttctgtatatacattaaaaaatatgtttttttaatagagacggggtctctatta

SEQ ID NO: 166063 - DNA, 361 bp, Homo sapiens
actgggtggaaaggatcattctgcacagagacagtttctacctgtgatcctgaacatgaccctccacaccactgtagcagaggagcaacctgcatttcattacctcatggatacacctgtttctgtcctctaggaaccactggaatctactgtgaacaagctttatccataaggcatccactttcagaaggaattgggtttcctggaggctttggctccctcaaggtggaaaaaggcaaattcaattccggtcaagcctctcgctccagaggaccctttttaatgctgcacacattaaaacccaatcaggagttttttagccccagggaaatggtcctcactcgcacaccttgcgcagtct

SEQ ID NO: 166064 - DNA, 677 bp, Homo sapiens
gttgcacctataaaacactggatgcatgaacaaagtagaatgcaggtttcctgtgggcagttaagtctcatggatgatagagcgagattccatctcaaaacaaaacaaaacgaaacagttcttctaatagagttttgttttgggggtcaataaccttgagtctttgataggcttgtgatctaaatacacgcaatcctgtatacaatatcaggaagtccatagacctactaaaactctgctagacgtctggttaagttttgcttaatatatatacgtaagtggacatttatcactttgagttttaactctttaacaatgtttatgcattcttaattcattacttgctataacaaacgaccttagactgggtaatttataaacaacagaaatttattactcatagttctagagactgagaagtccaagatcaaggtgttagcagattcagtgtccgatgagggcttgctgtctcctttaaaactagtgccttcttgctgcgtcttcacatgcagaaagggtaaggcagtcccttcaacttcctttataaggacagtcatctcattcatgagtgtggagcctcctaaagccctacttcttaatagtactgcattgggagttaggttccaacatatgaatgttggggacataccaacattcagaccatatcatacattaaa

SEQ ID NO: 166065 - DNA, 602 bp, Homo sapiens
ccacagataaaggactctcgttgtttgagtgaagttaccaactgtaacaattgcataggtttccttgtttctttcttttctccaaaaaactcatttcctcttggcaggtgttactataattcacaggtgtaatgaaaatgtaatttgggatttgaaaaagcatatcagactgcttcccagagtaccagttcttttcagctggtccatttcaacttaagaggtccatctatgcatttttgaagcttcatatttaataaatataatatttcactgctgtgtttgactattccgtttcccacactttctccttccctaccccactcttctggatcctgtgtttccccacaggctttgtgaatgccggtccactgatggctgaactgcaggtctctccccagtggaaagccccagagatgagccagatctgcctcagctgtggccatccgtcagcgtaaggttgctctggtggtcgtcttcagtttgtccagctcttccccttatcccccatcctccctcatgtgtggctgaagcttgccctggaatcccacctttgtagcatgtcactcggtagtagtagaattttattattgttgctttttttc

SEQ ID NO: 166066 - DNA, 251 bp, Homo sapiens
aactcctggcctcaaacaattctcctgcctcaccctatcaaatagttgaaattataggcatgagccagcacacctggccagatcattttaagtaaatgtttggaagaatcaccactaaaactacatagatcttgcattttttttgagggaaagttttaaaattgtgggatcagtttctttagcagttacaggattaattcagattttgtttcttcttgttactttgggttcattgtttttcaaagaatata

SEQ ID NO: 166067 - DNA, 213 bp, Homo sapiens
aaaaagacaaaagtgcaagttcagtaaattcataagataaatacaacagacctttagcacatgaaagtactcatgagaaatgacaaaacagggtgggaggagggtgaggatcgaaaaactacttgtcaggtactatgcttattaccttggcgacaatctgtataccaaaccccatgacccgcaatttatccatataacaaacctgcacgtgta

SEQ ID NO: 166068 - DNA, 321 bp, Homo sapiens
cctattctggatatttcacataaatagaatcaagacttcacataaatggaatcaatatcatacaatatcatacatatacatctaaacataaaaatatttgagacgaacagaccttaatggataagcaccataggagccagtgctagatgagaaaattaactaccctcatgattatcttgtagaaccaactgataaaccaccataaatagggcaggaaaaaaatacaggagtctgtactgatgctttctgtcagcagcttttcttctacagttctctgcagaagacattttaaccagatgcagcccacccagtgtgagagag

SEQ ID NO: 166069 - DNA, 126 bp, Homo sapiens
attttaaaaacaccatagttctgctcagataacccaaattcactaatgttttactgttcgatataaaataaaaatgaaactatgtcatgctgataatgtttaccaagttatacttgaaataagtgt

SEQ ID NO: 166070 - DNA, 386 bp, Homo sapiens
agcgatgaaccctccaaaacatttcctcactgcctctttggggtggttttgagctaggcagtgacactgctgggccagctggtgagccaagcagaggctcccaacgtgggggcagctaggagcaggcaggttgccactggatgtgtgaacgcctgccctacctgtggtagttgtgtgtggagcagagccggtgtgtcatacctggaggctctgggcatctgagccttcctcagctccctcccccagctaggatcaagtccactttaacccttagcaacccttaggctgctagctcctaccctcgcgtcactcggggtgggggagcggatggatatctcaggccctttgtcaagccgcctcttccgctcctccgattcattctcctg

SEQ ID NO: 166071 - DNA, 479 bp, Homo sapiens
tcagacttcagatcttaatttgaaatgggcacagaaattttctggtgtttcagaagtatggtgtaaacagcattttgatccgtgtgcagtctgtgggcagggacacctgcctgtcagcctgctattatgatgaggctcttgaagaaactaccctctttctaagaactggaagaactcaaataatgaagagacaatagaggtttgggcagtaatggaaagaagaaaagacagtgcctagccaagcagatgaatgaggtagaacagtcttgttcatacattgccattatatctagtgcagttgaatgaacattttctgtgtctgggcttaggtgcaggcaaatagttatctgtgttgtattcagataaggggttagaagaatctttatttttctgtgtcggtcatctctttcttgctgtaaaatgaaattgtttaaagcttacattatgacattagtgttgaatttctgtgcccatttcaa

SEQ ID NO: 166072 - DNA, 262 bp, Homo sapiens
ttcctattcttcccaaatctcttcatctcttccaatcaaaaacaaaccttgccctggacgctcacctgactttattcatccttcaaggtcacccccattcaacctcccttgactaccaatgccaagagtgagtcttccaataatctttcttttttttttctttttttaaagacagggatgcactttgtcactcaggctggagtccaatggcgcaatctcggctcactgcaacctccacctcttgggttcaagccattctcct

SEQ ID NO: 166073 - DNA, 285 bp, Homo sapiens
aggttgagtctgcagtgagccgtggttgcggtagtacactccagcctgggtgacagagcaagactctgtctcttaaataagaaaggatacctgctgatctatttttgcctgcttcacaactattagtgttaattcttctagcttgctttccatgcatatgccaacacacacacacacactcacttaaaaataggaattataccatatatacaacatgacaaattgcttttttgatttaatatgaaacaggtatccttcctcatcattgcatttagatcaacctca

SEQ ID NO: 166074 - DNA, 258 bp, Homo sapiens
ataaattaaactgtgataggtgtgtatgtataagaaaaagtatatataaggtttggtactattggagatttcaggcatctcctgggggtcttagaaagtatcacttggggttaagggggtgtgcaactgtaacaaagttatgtttgtttgtttgtttgtttgtttgttttttgagacggagtctcactgtgtcactgaggctggagtgctgtggtgtgatctcagctcatgcaacctctacttcccgggttcaagcga

SEQ ID NO: 166075 - DNA, 456 bp, Homo sapiens
acacatagtaaggtgagatttgcacaacagaatatagtaaagatttgtgcctgattctttttgcattctctttgaatcatttttagcctttattctaagtccccagttacggttatccttctcccaacaagattgtttctcttcaccacggatattctgatgaggctctctgcttaaccatctagacctcctgaacactctgtttgtcctgataacctgatttatgctcaaatgatgctcttccacagcagggcttcctgctttgcccaaagaacattcaatttctgaagccatttagggctgtttcctcacccagtatctatgtgaaaccttagagggaagcctattctttccaagaagagaaccctgctgggttctaccctcaatctgtaaatccactggggtaactgggattagctcagattagcaactggggttagctcagctactccagag

SEQ ID NO: 166076 - DNA, 591 bp, Homo sapiens
ctccatccttacctcaccagtcctgcttcacttctcttttcctctttgtggccagcgccgttgaatgagttgccagtacatgctgtcctcgattcctctatctttctatcatgctttcaccccctccacttcactgaagctgctcttgccaaagttagcagcagccaccacttccccaaccctcccctcacctgacttagcaacatttgacttagcaaaaatctgagtcaaatttttgctgaaaatctgacttcagattttcctcatcacttgcccctggaaactcctcctcactgggctcctaggaaagtacgctttcctcctgcgtccctggccattccacctcaggttctatgccagtcacttattctcttagtgatcctgggactcatcccttggttgtcatcttttctctctccttggtctgttgatgatctcctggagtctgctggctctaaataccatctgtatgctaaaaggaccttaaaatggctgtttgcagagcacccctctcctgaactccacccatgaatccaacggcctacctgacctttctgcttggatccctaatagatgtctcacatctgctgc

SEQ ID NO: 166077 - DNA, 352 bp, Homo sapiens
agtgctggcattacagtcgtgagccactgcacccagccttcatgttcattttaaaggttaaattataatcagtacaaacatacgtaactcatctaatttcattttaaatgatatttggttcctactcagattataagctaaagttttttaagcaattatgtctttattggttatataaatttacagtcttttaaagctgtgtaaatattgccacttaatatagtttcactttttatttgcataacaataataacaatattaaaagctaacacaaagtgctgggcgctttgccaaatatttaacatgttataatttatgtaatccatataatattcttttgaggtatgtacta

SEQ ID NO: 166078 - DNA, 202 bp, Homo sapiens
acatagccggaccaacagcgaacggactgatcagtgatagggcatggtgtggatattattacattagtattggaagcgatggtgtggactagatcagtgatagggcatggtgtggatattattacattagtattggaagcgatggtgtggattagatcagtgatagggcatggtgtggatattattacattagtattggaag

SEQ ID NO: 166079 - DNA, 460 bp, Homo sapiens
aagaagatggggaaaaatggaccaaagaaaaggggatgatttgcaggaaacctcagggcccaactatgcttggagactagttggccagtttgcacaagctatggttttcttctgtgattcttagcaacctagtaggtatgggatgagaaaagacagcttgagaattaagggcttttttgctgagctagtagagcaagagctgggaggaagggggagagtatgtaaagaaatcaggaatcaggaagagcagtttaagtcatcaaccactacatctgggaaggcagtcagggtaggaaggatgcaaggctaaatcaggatagggaaaatggaaagtttgacatgccaaagaactttgtgatataatggttacagtggacatacgtcccaagagagctgaaaagatggaaggttggggtcagagaatgggatgcttaaaattctgaagtggatttattccaag

SEQ ID NO: 166080 - DNA, 440 bp, Homo sapiens
ggagagagtctcactccattgcccaggctggagaacagtagcacaatcatggctcactgcaacctctgcttcctgggttccagcaattctcctgcctcagctgccagagtagctgggattacaggtgtgcaccacctcacccggctaatttttgtatttttagtagagacggggtttcgccatgttggccagactggtctcaaactcctggcctcaagtgacccgcccacctcagcctcctaaagtgctgggattataggcatgagccaccatgcctggctgatctccctaactctaaatctttacccctctgtctctaaagtctggccacctttttaattcttttagagacagagtcttgctctcacccaggcttcagtacagtgagccgtgattacaccactacactctagagtgggcgacgcagtgagaccgtctca

SEQ ID NO: 166081 - DNA, 379 bp, Homo sapiens
cggcaagtcctcatgtccccggggattgccgaaaagttcgtatttccttgactgaaaggaaacgcttttgaccactatccctattcaaacacgcggccttctctggcctgcccgcccgccagcccttctttgacttggttgactttgcgatttgctagctgagggtccctgctccttcctgggccacacaccccctggccgggacaccatgctttttgtgggagccggaactgatacaatttcgggagtcttttaaggaaaaggatttaacaagtctcaacagatgattgccaggacccctcccaaggccttggcagcgccttcagcttcagcttcccttagcttcttgtgctcctgcccctggccttctgtgtgcaaa

SEQ ID NO: 166082 - DNA, 548 bp, Homo sapiens
ttatagaaaaatctaggctctaccagaaaactcttagaactgataaacaaattcaataaaattgcaggatacaaaattaatatacaaaaatcagtagtgtttctgtatatgaacaacaaactagctgaaaagaaattaataagtttatcccacgtacaatcgctaccaaaaacaatagaataccaagaaataagtttaaccaaggaggtaaaggacctctataaggaaaactacaaaacaatgatgagagaaattgggctgggcacgatggctcatgcctgtaatcccagcactttgggaggctgaggcaggtgaatcacttgaggtcaggaatttgagaccaggctggccaacatggtgaaaccccatctctgctaaaaatagaaaaagttagccatgcatggtggcacacacctgtaatcccagctactggggaggctgaggcaggagaatcgcttgaacccaggaggcagagattgaagtgagctgagatcatgccactgcactccagcctgggtgacagagtgagactctgtctcaaaaagaaa

SEQ ID NO: 166083 - DNA, 218 bp, Homo sapiens
ccgcagttacaaaagcacaccaatcagaactctttctagatccttatcactcacacatagatgaaaataagctttcctgcctgggacgtaacaggcaatctggaccagctgaatttgctccaaaagagaagttgctgataaagactgagctaacatgcttgaggacgagcaagtgtgaaactcttttccaaatcacagagtaagttcgaagagtctca

SEQ ID NO: 166084 - DNA, 548 bp, Homo sapiens
tttatacagataccctaagccgtcttgaattttccccctgaaaatcagcttttctttttgacgacttggccaggctgcagattttgcaaactttaggtctccacttctcattgaaatagaagttccaacttgaaatcatttcttaggtcacacataagaacacaggctgtgcaatgcaggcaggacacctcttgtgctttgctgcctagatattcattccaccagatacatcctaaatcatcacccccaagttcatagtttcacagatctccagggcagggtcaccgtgcagccacgttctttgctaaggccaatcaaatgtaaccttggctcctgttcacaggaaattcctaattttcatctgagaccttttaagtctggacttcagtgtttatccttctgtcagccttctgatcgcaagtatttaacaatcctctacagtggtcaaattttcctcatcttgctgtcttccaagctttcccaattctcctgacctctgtcttttacccacttctgaacctgcttctacactgtcagctatctttatc

SEQ ID NO: 166085 - DNA, 365 bp, Homo sapiens
tatttcccaaaccctactgagggtgttatatatggcacatatgccatattgccttcctaaaattcaataagtcttatcctgaaacataactggccccagaggttttgaacaacatattgtggacctgtatctagtagaattaaacatgtgcatatcctagagaaatctatccacatgtgcacaaggagacatgtacaagaatgtttattacagcactgtttataatgatgaataattagaaataacctaaatgttcatcagtgggaaaatagatattctattaatctaatagaatactacacagcagttaaaatgaactatacctacatgggtcaacatgaataaacattttttaaagttattga

SEQ ID NO: 166086 - DNA, 204 bp, Homo sapiens
gcatttcaaatgtggcaagtgtggcttttaaatttaatttaaactaatttaagttttaattatttaaatagccacctgtggctagtagctaccatactagatctcataagtaaagtagaaatctatctgaactgtcaagggcatcactgtacacccttttcactactcggcccagctttctagctttttttctgcttttttgag

SEQ ID NO: 166087 - DNA, 558 bp, Homo sapiens
ggactacaatagcagggttcattcaaatgcacttagtaaaacctggcagcaaaacctccttccccattcctcattgagaaggctttggggccttttttccccctcttatcctgggaaacttacttttccctctctcttcctagactagactactcttccacatctcaagtgattttcactacactactatacagctgggaataatgggaaatggggaaagggaagcacaccggtcagaaaatgagtgaaaaaccctgatcttgagaattcaattccaagtacttgggaaatgcaagtatttatatttttagtggccatagtacttaacactttaaaaggatattataaaattgtaaatactgcacatcaaaaagctgtaacagtttccatgatttcccaatttaggaagaacatcaccattgggaaatacaccattccaacagtatgcatatattatttttttaaggacttttcaaagatttaacttgtcaaatctagcccataatggggcaacttgattattgatttcctggcctagtgtaaaaatttagcaaggca

SEQ ID NO: 166088 - DNA, 143 bp, Homo sapiens
tgtccccaggagagtctgtgcataccacatgtgacttggacaataaaagcaagcctccctcattgacaccgtacaaggttctgcccattcttttggattttgtcccagaaataagcctcagcccaaactgaatggcagattgt

SEQ ID NO: 166089 - DNA, 595 bp, Homo sapiens
cagcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaacaaacaaaaaaa

SEQ ID NO: 166090 - DNA, 782 bp, Homo sapiens
cagcccggaccctgcagccgcagagatgttgatgcctaagaagaaccggattgccatttatgaactcctttttaaggagggagtcatggtggccaagaaggatgtccacatgcctaagcacccggagctggcagacaagaatgtgcccaaccttcatgtcatgaaggccatgcagtctctcaagtcccgaggctacgtgaaggaacagtttgcctggagacatttctactggtaccttaccaatgagggtatccagtatctccgtgattaccttcatctgcccccggagattgtgcctgccaccctacgccgtagccgtccagagactggcaggcctcggcctaaaggtctggagggtgagcgacctgcgagactcacaagaggggaagctgacagagatacctacagacggagtgctgtgccacctggtgccgacaagaaagccgaggctggggctgggtcagcaaccgaattccagtttagaggcggatttggtcgtggacgtggtcagccacctcagtaaaattggagaggattcttttgcattgaataaacttacagccaaaaaaccttaaaaaaaaaacaaacaaaaaaaaagacaaacaaaaaaaaaccgcgggggcactataattgggggggggaaaaaaagggttatagaaaggggcccggtggccaatacgggttccgggaccccagttttttgtccacagggggtagacatcggcgggggcccccataagggggggcggaaaaaattcagaaagcccggggaaccgcggcta

SEQ ID NO: 166091 - DNA, 186 bp, Homo sapiens
acatgtcgctgctgcagagggaaccagccactttccttcctgggctagtgtgaggacctaggggtgaccatcaagttggtgggagctcaactgcctcgcaatctttgtttcatcttccttctctaccacaagtattctctgtggagtcatgtgatgggaagaaacatggggaccaaggcatagggt

SEQ ID NO: 166092 - DNA, 465 bp, Homo sapiens
cctgcctcagccttctgactagctgagactataggtgcatgccaccacaccaagctaatattttttaaccaataggatttagggtgttttgttgtgtggcaatggatatctgaaacagaaatcaatatgttacaccccttcccacaaatataatgacactccgtatcctccttaacttgctgtatttttctcttgttgcatttaccacctggcttactgtgtatctacctatttgttattgtctccctatccccgctggaacacaaactctgggaaggcagagactttgtcttattcattactgtatctgagcgcctggaatagtgtctaagataggccctcaatacatatttgttaaatgaaggcatatatttaatttaacttgataagtttgctttttgtagacatagcaagtccataaaaagaaaagacaaattaatttaaattgcccatgccgacagcctt

SEQ ID NO: 166093 - DNA, 173 bp, Homo sapiens
tacaaaggatgtttattaggataatactggtatcaacacctgtgggaaggaagaaatgggaacagagaagtgagtagagggagaagttgagtgtgatgcagtctcttttttttttttttttttttttttttggggcccccccccttttggcccccaggggggagggggggggg

SEQ ID NO: 166094 - DNA, 336 bp, Homo sapiens
taggaaacccatgccccctagcgggaaggtaacaaataaaatacaatatacattttcaaggaaataattgagatacatcaatagtatttgcagataattttttttactctggaaatacttaaatataactaattaataccataaatatgagccctctatagtacttatgtgtcaatttgtgttttcattgaatcctggacacagcccactttgaggcaggtagtgtcatccccttctccagatgaggaggctgaggcttggtgcctttatttcctggcctgtggtcacatgatggatggtgacagctttgctcttgctggctgatgcccgcagata

SEQ ID NO: 166095 - DNA, 419 bp, Homo sapiens
tgtgtgagtgaaaataactgattttttaagtttaaaaaacctggtagttcccaggcaaatagtttaacttggaatctttgaaatctaatattaaagaaaggtcttcattttattccaaattttagaggatttaaagagctggcaaggaacaaaaggagctggtccattttaaactcagcagaaaataaatgttcaaccttggctgaagctcctgtgtaatcttacagctaacagtgtttccaatgactaaaggcaaacagaaatagcagacggttcaatatccccatgctactgcaagtattttgctccaagtgaaaaaaaaatcatatacttagatattttgtataagacatgcgtatatactagatacacacatttactaagtgaatatatagtactccaatactttaatcatttta

SEQ ID NO: 166096 - DNA, 274 bp, Homo sapiens
caaactcctggcctcaggtgatcctcccaggattataggtgtaagccactgtgcctaacctgattcactatttttaaatccctgaattaagctggtgaactgtaatacccaggggtagggaatgtgtttttgttcaaaactaaatgacttttaaattttgaactcaaagatatcttacctaccattttaaaatacctgtcatttggaaaggaaacacttctgtttgttcagtaactatcattggatagtaccattctgagagtatatgtttaat

SEQ ID NO: 166097 - DNA, 743 bp, Homo sapiens
ggatagaatgattcaacactacaaacaaatcagttctctctaagttacttaataagtttaacacaatttcaataaaaataccaataagctttattttatggagttagatacttatgggaaaacaaacatataagactagccaggaaaacactgaaaaaggaaacctagccctaccagacattaagatatagttaaagcctctataattacaatattgtggtattggcacatgaatagacagatatatcagtagaataaaacacaaagtccagaaagagaccagagtatatataaaaacattcaataaaggcaacatcacaaataactgaggcaagagatggagttttttaatgatgctggaacaactgcatagccatttggtgaaaggaaaaatttgatcagtgtttctcaacctcagcactgttgacattttgggccaaacaattttttgttgtggggaccatcttgtgcattgtgcaatgtttgccagcatccttagcccctcccctcacttgtgacaactcaaaatgtctccagacactgcactatgttccctgaggggataaaatcacctctagttaaaaatcatttaatgggatgcatactaccatacacaacagtaaactccaaatggatcagggacctaaacctaaaaaatgaaaccacacaagtactagaagaaaatatgcatgaactattctttgacctcagtccagggaaacactttctaactttggctaaaa

SEQ ID NO: 166098 - DNA, 415 bp, Homo sapiens
taagtctctatgtgcaatgtgaatacagccacctttgtacagtgcacaacctgcttaaccatacgtgtcagctctggccccacacctgctttgtccatcacaccctgttggcctgcatccctcagaggtccattttgctccatgagcactgagccgctcagagcagaatgacctctccccacatgctgcctgcttctgtgggaagtgtggcccagagcctgagagcctctgcagcagctgtgcatcgtggttgctgcctatcagtatccacaaacccccccggcctagtcccttcctgtacctactgaaatgcagggccttcagatccaggtgccagagcccacacctattaggtctttcttagtcacaggtgcccatccctcccagccagggattccaacgcaaacggcagggt

SEQ ID NO: 166099 - DNA, 527 bp, Homo sapiens
tctgcctgcctcaggctcccaaagtgctgggattacaggcgtgagccaccacgcccagcctaaatgtattaatttaattaaaccttaatccttaaggaaaaggcttttcaacattctgtctgataaagtgggaagtatgcataagacattttgcataccaaagtatgatggttttctggaggaaataacttaggccattctttgagttgtgagctgaactagctgctcttttatggaatgccacgtttactcaaaagaatggccgacaaactgtggttatcagatttaggtagctggcagaacttttctaaaaaggaacaaagtgagtctgtcacttcagggaaaaatctgacagtgtttgttgccaatgatataattcaagctttcaagtgaaaaatcgaattttggaacacttgtatttgctacatgagcttcacagcttcccaaaatttaaaacttaaagactttactgttctccagtataatactatgaagaaaaacaaagactttactgttgaaacctaaaa

SEQ ID NO: 166100 - DNA, 586 bp, Homo sapiens
cattatacagcacttcacatttcaacggaacttttgaaaatattaacaggttatttcgcttcctgataatctatgaaagacacagagaggataaaactagagtgtgtggttaagatgagagtgtgccacagtaagactccaggatggggacattttcggctctgtggcctcagtcatggtcaagtcatttgttccttttgggtctgattcttaatttttaaaatgagaatttgatacttgggaggctgaggtgagagcattacttgagcccagggaggtggacgttgcagtgagattgtgccaccgcactccagcctgggtgacagagccagattctatctcaaaaaaaaaaagagaatctgggccgggcgcagtggttcacgcctgtaatcctaacactttgggagaccaaggcaggaggatcactggagcccaggagttcaaggtcagcctgggcaacatagggagacccaatctctattgtaaaaataaattgtaaatcacgtgagaggaaaaggcagttagaaccagatttagacaactatccaaagttccgttgaagccgtcgggtaccgaggctcgaaat

SEQ ID NO: 166101 - DNA, 333 bp, Homo sapiens
gaatgcagaattttcactgtctatgagcctccaaagtccctgggacctgggaattggaggaggagagctgggtttgagaaacaatggcttaagtgtatttctgtgtccagtgaaaattaaacaatatggcatcaggaaatgtagacattgattttaataatggataatggagatccaagcaggaatagaaatactatttaaagttcattcggttacaaaaagtaaataacacagtcacctatgttaaactcttattcatatgtcactgtcatgcggaatcatgatatcctgaaatatatgctcaattgtttaaaattttgaaaaatgtatttc

SEQ ID NO: 166102 - DNA, 370 bp, Homo sapiens
attattagaaaccatgatacctcaagagccagaaaaagtgtccatgtaataaaaagtcagctgagtatcttaagatgttttttctttaataaaaagttaagaggtagagttaaactaccaaatattcgtttgttcactcagcaaacatgtatttatcttctgacatttgccagggatagaactaggcattggagatagaaagctgaataagtcatgaatggtccctgccaagaaagtgcttgtcattttagtagaagcaggcaaatgtgaaaaaaaatgaacactataaagtctgtgttcaaagagatgtcttctttacctgccatcctctgctcagcccgttgtttccaccacacccgtgaggttatac

SEQ ID NO: 166103 - DNA, 432 bp, Homo sapiens
acatcaagctgaaaagctcagtacagcaaaggaaaaaaaaatataaagtgaaaggcaacctacggaatgggagaaaatattagcaaaccacatatctagtaaggagttaatatctaaaatatataatgaactcctacaactcaacagcaaacaaacaagccaaacaacaacaacaacaacaacaacaacaacaacagaacttgatttaaaatgggcaaagacatttttaaatgaatagacttttttttttttcgagacaaggtctcacccaggctgaagtgtagtggtgcaatctcagcttattgcaacctccgcctcccagattcaagcgttctcgtgccccagcctcccgagtagctgggatcacaggtttgcaccaccatgcccagctaatttttgtatttttagtagagatggggttttgctatgttg

SEQ ID NO: 166104 - DNA, 463 bp, Homo sapiens
gaggatccacctccgtaatgtgagcccacactatattcttagactctttcttattcttgcttttgtgtgttttttctgagacagtctcactctgtctcccaggctgaagtgcagtggcgcgatctcggcccactgcaagctccgcttcctgggttcacaccattctcctgcctcagcctcccgagtagctgggactacaggcacccgccacaccacgcccggctaattttttgtatttttagtagagatggggtttcactgtgttagccaggatggtctccatctcctgacctcgtgatccgcctgcctctgcctcccaaagtcgcattttttaataatgctcatatatctagggcaaagacacaaatttacgttcaaagagaggatttttttaaacaaaaactaagtatacatatgccagtttaaaccgataaaaatggtgagcagatttttcagattttta

SEQ ID NO: 166105 - DNA, 630 bp, Homo sapiens
ttggtgtcccccgatcaggtgggacttctttgaagcaacatgttgccttttaaaagagaattgtgcatgtgagaacttgaatctgtaaaactcatcagcagtccaccattgtttatcttttaagtaactgagatagctaactttaagtaaaacattgcaattaaaaatcgttttctgaattattttttttccaaagagaatagccttattactttttgtcttaaaaatacagaaatgagggaaaaatcacctttaagaattgaagatacagcagcccagttgaactaagaccatagagcacattctttgataactcctttttgctggtctgaactgttgattcttacttcatatttatacttgcagataaatgcctataataggagcaaaacagggtggttgggcatatatctgaattctagagattaagattttctacttgatattgatggatgtggaagcattgctcatctttttgattgagtggtacggttagcaatggagtcggcatcattcttggtctactgctaggaaaagttgagcatcagagagctttttcctccttgggggaaaatagaagagacaggcatggagtcagagggacaagaaaaatgctgaaatattttcctt

SEQ ID NO: 166106 - DNA, 275 bp, Homo sapiens
tcaggctctttagcttaacattctttttaccttttgaaacccagtccctaattcatttatattttaaatgtttatatttgaagcaataacaatttgttaggcagccaaaggtagaaggaaaagaatggaacatgccaaagatctggcttcactctttcaagatgacttctaatctatattgcattcacgttaccttaaattctactccattatcttatatggaatctgtttttgttcaataagcttcttccctactcctagactaaattgagaag

SEQ ID NO: 166107 - DNA, 316 bp, Homo sapiens
aatgactatttccgaaccttggacatgcctaagaataacaaaaccattcttctggagagaacagggagtgactgtaaatgagcatgagggcaacaactctgtatgtttactaaaaaatcattgaatggtacacacaagatgagcacattttatgtgtataaagtatatcccaataaagctgttaaaaaacaacactccactgctgcatccattgctgcatccctatagagttcaccctgcagaagttgggtcactggctctggagagaaagtgctgatcttgctactcccattccctatccctacacccccatgct

SEQ ID NO: 166108 - DNA, 243 bp, Homo sapiens
gttagtaaaaatatactgcatgccaagacattaaaaattgttttaatgtgggaaaattttaatggactaaaaatactgacaagttgttcttatttttgttttaataacagagaaaatggctaaaggaatagcaaaatagttttaattgggatttaatattgcatttttaaataaaagactgttagtcatcaaaatgctttaatctgtgtttatataaatttaatctgaatataatcaaatatt

SEQ ID NO: 166109 - DNA, 290 bp, Homo sapiens
cccatggagatgggcgactactggtcactcctgtcgggcaaggtgaggccgggctggccgctccacgcttctcctctgttcaggaaggaaagtgagcgcctcactctgagggcggtttgcttggtggcccttcctctggttcaggagcagccaccctgtgagagccagttaggcactgggagggttggagttgctggctggagagcccctcaggtgctgggagggctggagttgctggatggattgctattgaaacttctaaaactaggcttcccgctcacatgcgtgtc

SEQ ID NO: 166110 - DNA, 188 bp, Homo sapiens
ctctagcaaaaaggaacaacaaaggggtggtaaatggacctataagattgtaacatttctgcatttgatctgacatggtacaatattaatgctaagttgatataaaaggtaaggatgtacattgtaatccctaggataaccactaaacacataaggcaaaagatacagttcaaaagccaatagataaa

SEQ ID NO: 166111 - DNA, 436 bp, Homo sapiens
ttaagtttcaaggctctcctatagggagaaacatggccaaaaagacaggaagaactgtggcttgtaactcaatgatgctataactccagcactggatcttaagtattctggaatataccagattggtagaactaccagacttgggtatttctcagttaacacacatgcaaggaggaagagagtttttttgaacaaaatgactggctttgacaaaactatcttgctctttttaaatgtcacttgatactagaatgcgatttaaaagcatgtaatgcctcaggagtccggcatatacaaccaaattatcatgctcaggatcttcagaattctaaaggcacatgttagaatgcagagtcctgatgacctgtcaataaacttttttttactaatgaactgtacatttaaataaaagtttatttttgggataattgtgagc

SEQ ID NO: 166112 - DNA, 279 bp, Homo sapiens
ttgctaggtgactgctgcgtgcttatccgacaatggtttggtcaacaagattgctgacaggcctgtttttgaaaatccgagtcacgttatgcttacaaatgtttgctgctagagatctggcacgacagtgacgggtcagctgagtcggagacggaaaacctgttggtctgcgcaccgtttttgcagctgcccggcagactggaggcctctccccaaccctgctcaccctgaaggaggttctcggtcccttttgacctcacactgggcagtggaagggga

SEQ ID NO: 166113 - DNA, 453 bp, Homo sapiens
ggggacacaattcagcccatgacaggtgggttggggttatatttcagagtgttaaagccattgtttaatttgttaaactttccttttagaccaaaggggagtcattaatgctttttatgcaaggaagtaacacaaacagttctgattgtgatgtgaaaaggtgccctctaaagttgagggcaaatagtagatttgaagactatttctattgttaaaatataatatcagctgtcactaattgaataacttactctgtgctttgtacttatactatgctaagaactttgtgcatataaagtcatgggactttaaaggacagaaatattaaaatctcttttttaaatatgaagaaaccaagatttaaagaacacagaatggggaaacagggacagatgtagataatttgtgccatttagacatgttaagcttgaagtgttgactgagtattcctgt

SEQ ID NO: 166114 - DNA, 122 bp, Homo sapiens
caaaaaaataaatgcaatcatatattgcattttgaaagtcttaaccacttcaggggtaggagaggacaataaactcaagaaaaaattctcctggacagatcattcctagggctcttctatcg

SEQ ID NO: 166115 - DNA, 174 bp, Homo sapiens
cacaaggacagagattgataggacaatggagaggcagacacggggcagcaacaaccacccattgcagggataagaagaaaacagggaacaatattttgaaaatcaaaataagttaaacattttttacagtattaatgaaaaaaccaaatgatctttaagcaaggaagttttatc

SEQ ID NO: 166116 - DNA, 288 bp, Homo sapiens
gagtagttgggactacaggcacctgccaccacacccagctaatttttgtatttttggtagagatgtggttttgccattttggccaggttggtctcaaactcctgacctcaggtgatccaccaaccttgggatcccaaagtgctgggattacaggtatgagtcgccgtacccggccacactttctatttgaaccagcacttgcattcaacacagaatgaaggaaatagtgttctaagaaacacgaatggccaagggacactattagattctaacctactctggaaagtg

SEQ ID NO: 166117 - DNA, 105 bp, Homo sapiens
ttaagacccagctcaggcctagttcagggtaggcactcaatacacgtgcacggcaagccaactatgagataagttaatgcatttcaacaaagaagatgctgggcc

SEQ ID NO: 166118 - DNA, 413 bp, Homo sapiens
ccgaaacagccccagaccaagcagctgtcacaggctgggccacgtattggccagtcctgcccttcatccctcccagcttcctgacagtgcgcatacaccctagacggagctaggagggtgagagcctttgttcctcccaggaaaggtcacccctgccctccagcccctcccacatcagccagcagagtctgaatctcagaggtgcccaaaggttgtgtcctcctaaccagcccaggtctccagcgagtggaggatgcctgtggcagggatggctccaaggctaggagggagaagaggggatttactccccagagcctggccctgcccctgctggcctagagagttctcccaaagtggggtgtttcttaggagtcaggctggcggcagaacagcccctccagagccctctaccc

SEQ ID NO: 166119 - DNA, 610 bp, Homo sapiens
cagcaaaggggcactggaacttttgctgatgaaggaaatgttctacatttcagttagagcaatggctaaatgacaatatacatttgcctaaattcatctaactatacactttcaaaggatgtattacatgtgagtaagttatacatcaataaaaagggcacatacaaaaagcgacaagccattggatataaggaaactatagaaaaaccagttgtatttttgtgtacaagcaactaataaaaattgacattttagaataaaacatcgtgtaccactgcatcaaaaatatcagagaataactctttaaaaagatgtgtgagaccttcacactgaaaattgcaaaacattactgacaaaaatcaaagacaaaaaaggggacaaaccatattcatgaattggaagactcaaatactatacagatatcaactatctcaaaattgatctataaattcaatgtaatcccaatttaaaaacttatatggaaatacaaaaggcctagaaaaaacaagtcaacctcaataaacaaaactggaagaactatattaccagacagcaagacctattataaattactcataaagtacttaagacacacattatttatcctgct

SEQ ID NO: 166120 - DNA, 116 bp, Homo sapiens
ctgagtaatatgaactgttcatgaagggaagaaacctttgcctatttgatccttgactgctggctatgaagagaaaaacagaactttctgggagatgaggactctccagtccttct

SEQ ID NO: 166121 - DNA, 887 bp, Homo sapiens
cgtgttgccatgatatctcgtgtggttgtaattttgatttcctgattctgaaagtgggcaggcaactttgcataggatcttaccttcagagaaaggaagagacggggatgagtgttttttctttcaatccgtctttgcatatcatagtgttgtgagttggggtggcaagtaggcagtttagatttttacccagtactcatgaattccaaatggtttaacaaaatatacaaacacttcagcattttttctttgataaactgtctgattaaaaaagataggtgtctcaataaaaatttcaatgaaaaagtggccaaaagatttggacagacatttcatccatttcatatgaatgagagtaagcacacaaaaagatgttccacattagtagtcgttaggaaatgtaaattacaaccacacgagatatcattgcaaccctattagaatggctgatgttaaaaaccaaaaagaaggtgacagtgccacatgacaagaatgtgagacagttagtactctcctgctttgctggtggaagtgcaaaatgttatgattgctaaagaaatcagtttggcactttcttatgaagttgaacatagacttgtcacccaacccagcagtcctacttctaaatatttactcaagagaaatgaaaacattttcttacaatgacctctatgtgaacatttatagcagctttattcgtaatcactggagacagctcaaatatccatcagttggtaaatggataaacagattttggtacacctatacaatggaatcctatacagcaataaaaaggaactaactgctgacgcacctaacaaaatgggcagatcttcaaagcagtctactaagtgaaaacactaaactccatataactgtgatttcat

SEQ ID NO: 166122 - DNA, 332 bp, Homo sapiens
ccgttgtgtgttggtgtttggatgtgctaagtaagatgatcatgatgagcaatatacctagacacatccaaacaccaagacacaactaggaagacatccacacaccagagcctaacttctgaaaaccacgttaagctctggggcaggcgcacatcagctatggcaccagaaatcacatcagtggtcacctgaatctaggggattgactggaaaggggcatggaattttggggagatggtaatgttttggatcttgatgaggggctatacatttgtcaaaatgtatcaaagtatacactaagtctgtgcatttgattgcatagaaataataat

SEQ ID NO: 166123 - DNA, 279 bp, Homo sapiens
aaaaaatctagaaagaaggcctctatagtttgtagtcttattaaagacagagaccgtaaaatacacatgtacgtgtatagagagagaccagtggcttggactctatgaaggatattttagaggtggaggctcccaactgcttctttcctgttacagattagagagttcgtagaagtaggttaggagagattacggctgccttgtgtgatgttaggcctcttctggccagaccttagttcagcattaagagaaagttgctctttagcttcaaagcaaggg

SEQ ID NO: 166124 - DNA, 894 bp, Homo sapiens
taagagattatgtcagctggtggcttcttatctataaattaattgcattaagaaattatctattactagttttaaaaggatttcatttaaatgattctatttggagaaaaaaacaaaatggatatggagtttgttagatgccttttagccttttcctttaacctatgttctgtggaatgcagttgtgggagatcattcgtaagtgttcaaagaaaataaaagggttccatagtcaagtaactttgggatatgctgtgttccataacctcctcatgacgatttacagtactcccagatcaaagagtttacaacctaaagtctgttgtcatactcctaaattacaagttacaacatcaaaaacactcaataaatagtcattgcatgactgaaagactggaagaacaaatagaactgtaagaaactgatttgattctagtgaaattcccctccctttctttcaccctcctcccaaaacagcatggaaggtggagtggagcaacttacaggtaatggcagtgggtagacagcagtgtgctttcaagcacatctcagccctgaggagtataaatcccatccatagctggaaaaatagcctgagatacgaaaagttttacccagcaaattccagtttattggttcaatgacctaatgtccattcccttagtaggcacagcagtttcaaaggtgacatcatctgaacaaacagtcctggtgataacatgtcaatgatttaactaaaggaaaaatgaaaataaaacttagttttcacatttaaaatgtaagtgaggctggcgcggtggctcacacctctaatcccagcattttggaaggctgaggcgggcagatcacctgaggtcaggagtttgagaccagcctggacaacatggtaaaacc

SEQ ID NO: 166125 - DNA, 306 bp, Homo sapiens
tactactactaaattcgcggccgcgtcgacctcctggctgctggattgtctcgtcataaattcatttcccctggctgctgcactgtgatgtcatacattcatttcccctggctgctgtgccgtgacatcataaattcatttcccctggctgctgcaccgtgacgtcataaattcatttcccctggctgctgcaccgtgatgtcataaattcgtttcccctggttgctgtgccgtgacatcataaattcatttcccctggctgctgtgccgtcgacgcggccgcgaatttagtagtagtagtcgacc

SEQ ID NO: 166126 - DNA, 745 bp, Homo sapiens
aaatagccctggcttcaattttagctgaaacttcagctctgactttggttcggacttcaaggaaatggaaggaaccaggatctctaagcagacccccttctgctcccttagggctgttgattttagagctaatgatgggattcggttggggcgagggggtctccacatctttttgcccaaccctttgctaagtcaaggaaccccagtctgggctgggcatggtggctcatgcctgtaatcccagcactttgggaggccaaggttagcggatcactggaggccaggagttcgagaccagcctggccaacatattgaaaccctgtctcagcctcccgagtagctgggaccacaggcttgcgccacgatgccagccagtgtttgtatttttagtagagggtttcaccaaccctctactaaagaccagcctctagttggtcaggctggtctcgaactcctgacctcaagtgatccatccgcctcagccccccaaagtgctaggattacaggcatgagccaccacgcccggtaattttgccatcttttatcaggctttctgtgtcgaggacgctacccacatagagtagaagctaaagggaagggatgtgaagtgacctcaccctcagcttctagctcatggtgtcaaggcttgtgtgatcttagacacgtctgcctcttctgagcctgtttcttcatctgtaaaacagggatgggaggttgtggtaaagattccacagcaacactgcac

SEQ ID NO: 166127 - DNA, 334 bp, Homo sapiens
taacgcgctgatagcctcctaacgcgctgatagcctcctaacgcgctgatagcctcctaacgcgctgatagccccccaaagtgctaggattacaggcatgagccaccacgcccggtaattttgccatcttttatcaggctttctgtgtcgaggacgctacccacatagagtagaagctaaagggaagggatgtgaagtgacctcaccctcagcttctagctcatggtgtcaaggcttgtgtgatcttagacacgtctgcctcttctgagcctgtttcttcatctgtaaaacagggatgggaggttgtggtaaagattccacagcaacactgcac

SEQ ID NO: 166128 - DNA, 260 bp, Homo sapiens
tgatattgagtctgtttcctttcaaggggaaacaggctacccaaggactggggctgctgccttcatttctgtgtcgaggacgctacccacatagagtagaagctaaagggaagggatgtgaagtgacctcaccctcagcttctagctcatggtgtcaaggcttgtgtgatcttagacacgtctgcctcttctgagcctgtttcttcatctgtaaaacagggatgggaggttgtggtaaagattccacagcaacactgcac

SEQ ID NO: 166129 - DNA, 702 bp, Homo sapiens
cactgggctctttttctcccccttcttcatcctgttcctcaaacatacaaggcatgatccagctcagagctttgtgtctcctgattcttctgcctaaaatgctcttctcttcaatatctaaaaggtccctccattgactccttcaaatcttggctcaattcttgccttctcattgaaaggtaccctagtactctatttactactacaaccaccccattcccaaactctcaatcctccttacactgctttatctttttttctccatagcacttaacaccttctaactactacataatttgcttactatgtttattgttaactgtctccccctcagccccacttgagtacaaaaccctcagggcatagctctttttccactttgtccacttacgttcccccaatacttgaaacagcgactatgtaatacgtattcaagaagtcttttttcaaactctctcctttgtaaagccctatctctctctttctaaagtatatgacccctcatgtcatcaattattctcataccaattacttttttcttccaaatcctggcttgccctctggtttctctacctaccatatttatgaatttcttcttccaaaggtcaacaaatgtacttttcttagtctttatccttttcatccttacataactctgggcttcctttcttaagagtacttcccttcttgagagcctcactc

SEQ ID NO: 166130 - DNA, 599 bp, Homo sapiens
aagtgggcttaacttagcctcctccagataagagtctggaggttcttgcccaatgttgctcctccctcatgcgctttgctcagtgccagggagggggagtgcagtaagtgtggattgcaccccaggctggttccatggagatggaaatagcgttggcacatcctagctcatgaatggatccacatccatccagatgcccagccaagaagcccttccccgggctcctcatcatcatgcaccaggtgctgttcatcacttttcctacggacttgccctcccacgtccctggaacctatctgcatctccccatctccactcctccattctaatccaacgtatcttcactgcttctcctagaactgattcaatgccctcctaactgaactgccaggatccacatggcccctcttcaccactctccacactgcagccagggagctattttcagagcaaaaatatgatggtgtcatatagctgtttaaaattctttaattaggccaggtgcagtggctcacacttataagcccaacattttgggaggctgagggtggaggatctctcaaagctaggagtttgagacaagcctgggcaacacagat

SEQ ID NO: 166131 - DNA, 324 bp, Homo sapiens
agaggctagtcaatttatccaaggccacgcagcaaagctgggactcaaactcaaatcttctagtcctagtttcattcagttttttttttttcctacattgattctagactttgttctacaagtgactacttttctgttttgttcctgacatgaacatgtccatggctgtctcagacttgtttggttaccctaagtaaccatttagcagccaatttctgatatgactatagatacatctctataagtgaattctataggtgatttggcatgatcaaaatgaaaaggctttgtttgagttccccaatatactgctcaaatgaaagc

SEQ ID NO: 166132 - DNA, 209 bp, Homo sapiens
aatagtggatatataaaggtgatgggattatgaatatggtttcttgttaatgtccccttaatatatgatatttttcaaggctacagagtctataaaataaggaaaaatgtttacagggaagatgggagtgataatttcctggaatgggactggtttttctggacatcatgagatactgctctccatgattaaacagtaattgacataaa

SEQ ID NO: 166133 - DNA, 382 bp, Homo sapiens
acagctccagtttaaaatcaaacaattacctatatgtgaacctacaaaaatacctgcattcatacctgtatatctgagttttcttttaagctgaaagctcagcaactctacacagaaacagaaccaaaaggatcaatggaagcttttgtcctctccaaattttacacaatgaaaatatttaaagctaaactccctgacttaagaccgcgagatggaagtaagggagggagcacactgactgactctaatttgagagaggtaagaagcaaggatggacactcccctcaggtatctgctccccctaaaacaaggcccccgaccacagtgctgccagagccagcttcatgctcccaggtttctgtgagtcccattcttctgaata

SEQ ID NO: 166134 - DNA, 481 bp, Homo sapiens
aaaaaaatgcgtgcgctgagacagaggcctggatttgaatcctggctcttgcctttatatgaccttgggcaagttctttatcctttctgtgccacagttttctcctgtgcaaaatagggattaaaatggcatgtatctttcaggatatcacaaggaatatgtaagatattatacatcaagtggttagaacgctggctggcacattgtaagtactcagcatttgctggctttgtagaaaataaggctttgagaagcatctaatattgtgcctggtacctacttggcaacccataagtggtaactcttacgattaacaagggacagctcccatccttagagtgatactgcctcagggtaatctgtccctcggtggattgaaggagcagtggaccctgaccctgcttagcaataaacaacattttatgtaactcaatcaaagtacaaagggtcttcatgtactctgcccatttcatgacccata

SEQ ID NO: 166135 - DNA, 245 bp, Homo sapiens
attcatattgctatttgttctaaagtagcatttttattaccttttattcatgtcttcctgaattacctctaggatcctttccacttctaaaaatgtctgtttttttctctctgcatcaggtaattacctttgttaatttaaagggattaaccaaagtatcctgtgtttattttattttttttctattttttattttggagacagggcctcactccagtctgggtgacaaagcaagaccccatctc

SEQ ID NO: 166136 - DNA, 258 bp, Homo sapiens
catctaaaaggggcttttttgatttcctttgatttatttattctcctttcttcctttacttcccatacttggaggaatccaatggagaaagacaatattaattagataatctttaagggagtcataccctctcctgtgacataggcatgcttctcagttccaaaataacagagaaatttgacctctccaaacagaaattagctggcgactgaatgcatttatgttagattaaaaaatgtaaagttgacgcacctctct

SEQ ID NO: 166137 - DNA, 1233 bp, Homo sapiens
ttgtcctaaaaatagctgataacagcctacatttagtgagtggatagtaggtaccagcctccatgctaggtactttatgtgcattgcatttatcacttaatatttataaaccctggtatagtacagtggttagaacagaggctttggagtcaggcaacctttcactagttgtttgactgtgggcaagtcacagaacctctaaattacattccttatctgtaatagtaatgactaccccataggatgtgaagattaaagtgatctaatgaaaaccaagcagctggcccagtcctggcatggaattatcacaactaccaccaccaccatcatcattgttttacagatgagatgagaaactaaggtttagagatgttaaataatttgctcgagaccatatagctaggaagcaaccaagtcagaattaaatctagatctgtcttcctccaaagccattgctataaaattagaactcagccaaggggcaggggaaaaaaaagctccttttctaaacttgctttctaccttttcattcaagaatcctctactccagtcctactgaatctttgaccaacattccaggtcctcttgtaaatctttgcttctgtacatgctgttgaatggccctcaccccttcttcctaacttcaactttccagaagatctaacttaacatccacctcaactgtgcagacctctccatatacctgaggcagagttagtcacttctttgtgtaataccagaaacagtggagagacccaataaaagcctttttagtaaattaattctcttcttgcaaaactaaaatttatttttatgcacttcacccaagatttgtttgctgcctacatgctaggcactgtgcttgggtttcagaaatacagagggaaataaaagtctctcccatcaaacgttcatagtctagcagaaaagatagatatgcaatcaagccaagcacagtggcttatgcctgtatcccagcaccctgggaggctgaggcaggtggaccacttgaggccaggagttcgagaccagcctggccaacatggcgaaaccctgtctctactaaaaatacaaaaattagctgggcatggtggcacatgcctgtagtcccagctactcaggaggctgaggcacaaaaattacttgaacccaagaagcagaggttgcagttagccgagattgtgctactgcactccagcctgagcgacagagcgagactctgtctcaaaaaaa

SEQ ID NO: 166138 - DNA, 1843 bp, Homo sapiens
tcagctcttgaatcagaattttcaaagactcacctctcttacctgggcttgcacatatttgtcctaagtaattctctatcccttaaacctctgagtccctctgttttattacttgccccactcctcctacttgaatatgtttgttttcccagttgaatgtgatttttatctactgttcatattatcttttatacccatgagtataatttcatagtcctttcaggttccacatcatcaaagagatgaccataatttcacttttttttgaaatgaagtcttgctctgttgcccaggctggagtgcagtggcacaatctcagctcactacaacctccgcctcccaggttcaagcgattctgccttagcctcccaagtagctggaattacaggtgcctgccaccatgtctggctaatttttgtgtttttagtagagatggggtttcaccatgttggccaggctggtcttgaactcgtgaccttaggtgatccacccacctcaacctcccaaagtgctaggattacaagagtgagccaccgcacctggccaattcacttttaaatactaaaaggcacacagcacacagacattttcggggcagttttctttgggagggtctttgataaattttgtaatcacctctcggaagaaagcccaaaatgacatgtgaaaataatattaaaccatttaccagatgtccagcaatataaaaatagacctcacatgctacccttcacatgctgattctcttgccttgctgtttaaggatccagtttcttatgttaaacattttccttaccttttgcaataatattattggccatatactaaattctcattcacttagctttctaagaattctttgaggttggaatcctgaaatcataaagctaccagatctgcacaacagcagtggtagtatctgagcccaaactctgagacgctctagagttttagtttacaaacatgagccagaccaaacctgacctggtgaaaatcaataggtaataaactgcttgtatatgatagcagttcaagggctttctgggttccatttcactgaggaaatgaaaatataactgattagccaagacagagtggcaataaggaataactgatcctcctccaagttgcagtgagcaagccctcaagcctacctcattcctgaagagttgaaggagaaaatgccgtgctaattttctgccctgctatttttaacctgaaatttagaattacatcaggtattcaaagaatgttccctatcaaaggaaaatctgtaaacgatgactgcaaaaagcaagtgaaatgatgcaaagagaaaatatttgcaaaacagaatctaaccagacatcatcatgaagataaaatggcatctcttctgtgtggcctgggtgtgcttggacaatcctgtcacacgtttctattaggacatgttgcccttttgaggattcactctatgttggccagatggtttaactgattaaacaattgaatcaatttattttgctttttgaattgaccagatatttaactaaatgtactgggtttggcattttagacacactgccttagattcttgtagtgcatgatgactttgaaaatgtttggccattttagttaaaatgcagggtaacatttgatgcagccatgataacaggaaaaatctgttctgttctaaaaatgtttctagcaatagaagtatttctggctaagagaatactcttgacttgtagggaggctccctcggaataaatgtatgcaacacaaataaggcattttattttttaaaagattgtctatataagatacacttattaaataaagaaattgttggtgaatgctctga

SEQ ID NO: 166139 - DNA, 2020 bp, Homo sapiens
  misc_feature (211)..(211): n is a, c, g, or t
  misc_feature (504)..(504): n is a, c, g, or t
  misc_feature (644)..(644): n is a, c, g, or t
agaggggaggggagaagaaaagagaaaaaagaaaaagattctggaaaccattaataacctaaagctcttccaatgtacaccacccatttcttctcctacccataaagagtggcaacggggaagagagggagggtagggagggggttcctgcagctgagcagcagtttcacaaggtatctcttccagcctagctgaggatgcctgctatganggactctgcttaacctttcttttccaagcaataagctttactacttggggaggattctttgaaatcacaactagttcaaattgtaaaatccctttggaaaataatttgtcaatcaaggtatcagggtccttcatatgttcttatcttgtgaccctgtatttctcctaccacactatatacaaaacaaaaaaaaaattatgcatgaagctttttgtagctaaaagtttgacaagcctgggcagcaaagtgagaccccttctctacaataaatttaaaaattaaccaggcatggngtgcacctgtagtcccagctacttgggaggctgaggcaggagaatcacttgagcccaggagttgaaggctacagtgagctgtaattgtgccactgcactccacctgggtgatagagcaagattgtatctcaaaaaacaancaggttgggcatagtggctcaagactgtaatcccagcactttgggaggccaaggtgggtgatcagctgaggtcttgaactcgtgaccttaggtgatccacccacctcaacctcccaaagtgctaggattacaagagtgagccaccgcacctggccaattcacttttaaatactaaaaggcacacagcacacagacattttcggggcagttttctttgggagggtctttgataaattttgtaatcacctctcggaagaaagcccaaaatgacatgtgaaaataatattaaaccatttaccagatgtccagcaatataaaaatagacctcacatgctacccttcacatgctgattctcttgccttgctgtttaaggatccagtttcttatgttaaacattttccttaccttttgcaataatattattggccatatactaaattctcattcacttagctttctaagaattctttgaggttggaatcctgaaatcataaagctaccagatctgcacaacagcagtggtagtatctgagcccaaactctgagacgctctagagttttagtttacaaacatgagccagaccaaacctgacctggtgaaaatcaataggtaataaactgcttgtatatgatagcagttcaagggctttctgggttccatttcactgaggaaatgaaaatataactgattagccaagacagagtggcaataaggaataactgatcctcctccaagttgcagtgagcaagccctcaagcctacctcattcctgaagagttgaaggagaaaatgccgtgctaattttctgccctgctatttttaacctgaaatttagaattacatcaggtattcaaagaatgttccctatcaaaggaaaatctgtaaacgatgactgcaaaaagcaagtgaaatgatgcaaagagaaaatatttgcaaaacagaatctaaccagacatcatcatgaagataaaatggcatctcttctgtgtggcctgggtgtgcttggacaatcctgtcacacgtttctattaggacatgttgcccttttgaggattcactctatgttggccagatggtttaactgattaaacaattgaatcaatttattttgctttttgaattgaccagatatttaactaaatgtactgggtttggcattttagacacactgccttagattcttgtagtgcatgatgactttgaaaatgtttggccattttagttaaaatgcagggtaacatttgatgcagccatgataacaggaaaaatctgttctgttctaaaaatgtttctagcaatagaagtatttctggctaagagaatactcttgacttgtagggaggctccctcggaataaatgtatgcaacacaaat

SEQ ID NO: 166140 - DNA, 320 bp, Homo sapiens
accttcgatgggcgggcacttagtagaagataaattgagtgtagtgtttctgtagttgagaatgagtgaatggaaacctgtagaagcaaagcagttaggagaaaatcatctagagaaatgttagccttgagagtgagttccacaaccacttagctgtagtggttgaaggaggaaagaatcctacctccaaattacaactttacaagaaacagaactactaaccttgagaaaccattatttatgccatttatcagcccaaactgaaaatttagtgctcaaagctggcactattgtataacataagttgcccgccaatcgaa

SEQ ID NO: 166141 - DNA, 465 bp, Homo sapiens
tctctttggggtaaacattcagcttcagatcctgcaggtagcagagagagagagagagagagagaggagtggttaagagtgtggccattggagtccagggagtctgcgttctaattctggctctcctcttaaatagtcctgcagcttgggcaacttactcaactgtgtccttcctcaacttccacatctgtaaaatggggagaacaccttcctttcagggttataggcaaatgaggtaataatctcttttaaaatacttagcccaagtaaatgctcagtaggtgctagctatcatctccagtttctatttcctgaactgtgaccttgactaaatgtggcccagtcctttaagagaggggatttgtggtcactttaaaaaaatcttcagctgtgctcatgtggtccggagtactgtgttagttttcctgcctgtggctcatgggccagtggtcaccatggaaatgg

SEQ ID NO: 166142 - DNA, 129 bp, Homo sapiens
acgaaaactcgatctagggggagaatcttccaacctaccaagaagaggaaagaactcagaggtttaccagagggcaagggatcaaaatcaaaactcaaaagctcccaccagccaaaaatgggccaaccg

SEQ ID NO: 166143 - DNA, 190 bp, Homo sapiens
atcctttgaggcacagaagttttaagttttgatgaagagtagtttatatatagatttttgttgttgctcatacttttattgttgagcctaaggaccctcatgatcgaaggtcatgaagatttactcctatgttttcttctaagagttttggttttagctcctaacatttaggttgttggtcaatttgtgg

SEQ ID NO: 166144 - DNA, 395 bp, Homo sapiens
tctctgtttctgttcctccctctgcctaacctatcctggctctaagctggctcagacactgcgtttgtgtcttttcacgtggcatttttcttttttccctccaccttgctaagtgctgaaatttgcagtcagcatttatatatgccctatagacaaggcacatttctctagttttacctttcttgtcatttgtgatcttttaaattttcagtcaatggaaagtaattgttaatatgaattgcagtttggaaactttgtgccagatgatgaaactgaatgaatctgtggtctttacgtaggcagtgccttacgtatggtttggtttttggcccatgtactagatgtttgcctttctgtgggctgtcacagatctggcatgtacctttatttttttg

SEQ ID NO: 166145 - DNA, 367 bp, Homo sapiens
aaaattcacttcacttgccaacttattattatgagattcttcatcaatttttgaagagatttgggagtagggaattttttatccctaaagtgagctttattagcattttatattatactatttgaaatgtgcaaaaatgcaatcatgttatctgtgtattgcctggaatattgtcttggtgactaaggaacccagaaatactgtggaaactgctgctactgtcaccatgtgcatagacaatgtggagggatttctggaaaatttctgcagtctggcctctctggatttcgtgtggatacctacaaactgcactaagtgttgggagattctttagtggtatatgaaactaagttgcaagcaatatcaa

SEQ ID NO: 166146 - DNA, 415 bp, Homo sapiens
atttccacgtgcaacatcacttaaaaacccattctctgggctcagcaggcagaaccccctgatatatggcagggggtaagaagccagggaccaatgttcaggcaaaccattaaggtatggaaagaacagaggagttcgtgttgatttcactgtccttacctacatagcccaggaatgaatatatagatttataatacataaagaaaacatgcagtgaatgtggccaaatcccaagcttgaccttctgggccccatatgatatgcacggtgagcaggcaaagttccaatgagctcttgccacctgccaagcccatctgctacaaacacactggcagccaggaagtcacacattataaccctataggattcctaaaaagtgccaacagtcttcttgaggagtaagagggtaaaggga

SEQ ID NO: 166147 - DNA, 260 bp, Homo sapiens
gtgtgtgggtatgtgtgattaaagtatagaaatacctaacaattatccttttattaattcaacaagggtcaactaagtacatgttatatgcataatgtgaatgtagaaaaagaggagttttcataaacatgttcaaagggaggttaaactttaagcatgaagccaggcccagtggctcacacctgtaatcccagcactttaggaggccaaggtgggcggatcacttgaagtcaggggtttgagatcagcctggccaacat

SEQ ID NO: 166148 - DNA, 421 bp, Homo sapiens
ggacagatcacctaaggccaggaattcaggaccagcctggccaacatggtgaaaccccgtctctactaaaaatacaaaaaaaaaaaaaaaattatgtgggcatgatagtgggcacctgtaatcccagctacttgggaggctgaggcaggagaaccgcttgaacccaggaggtggaggttgcagtgagccgaggtcgcgccattacactccagcctgggcaacaagagtgaaactccatctcaaaaaaaaaacaaacaaacaaaacagctgtgcttaattaaaattgtgctgggttagaaaaattctttaggaaaaactacagactttttatttataaactacctatgaagccctcctatgcagtcctcatgacttacataacaacgaagtattaatagccaggtatagtgcctctaagaac

SEQ ID NO: 166149 - DNA, 241 bp, Homo sapiens
tcccagtgattttgtccttgcagtatctgggcaaagatgaagcaaggagggtcagatgtttgagacccaggctttcaccttggcagaccacaagcaaagctaccttccctggggatcagcattcctgggagcgcctctcaagaccagccctccaccaggaggcaggggcagcaggctccagggcaggcagagcccaggcagcctccacatagcagccaaataagtcaagaggtgtctttcc

SEQ ID NO: 166150 - DNA, 423 bp, Homo sapiens
gagttcatgtcctttgcaggaacatggatgaagatggaaaccatcattctctgcaagctaacacaggaacagaaaaccaaacaccgcatgttgtcactcataagtgggagttgaacaatgagaacacatggacacagggaggggaacatcacacagcggggcctgtctgggggtgggtggctaggggagggatagcattaggagaaatacctaatgtagatgatgggttgatgggtgcagcataccaccatggcacatgtatacctatttaacaaacctgcacattctgcacatgtaccttagaacttaaagtataattatatatatagtatatatacatacatacgtatatacatgtatatatattacatatctgtcctcattagttggaatacagcaggctttactagtgtatctgaagta

SEQ ID NO: 166151 - DNA, 254 bp, Homo sapiens
ttgcagctattgtaaaatggattgagttcttgattttattctcagcttggtagctgttgctgtatagcagtactactgatttgtgtacattaattttgcatccagaaattttgctaaattcatttatcagttcttggagttttttggatgagtcttcgggttttctaggtatatgatcatatcatcagcaaacagtgacaggttgacttcctctttactgatttggatgccctttatttctttctcttgtctga

SEQ ID NO: 166152 - DNA, 181 bp, Homo sapiens
ctcccactgtgggagatggcctcagcagaggctcaagggcctggatacagaatcttctttggttcaaataccccctagaagtttcccattggccacctcatgtaagtggcgtggtcgcccgaaataaatctgattggttgcagaaaggagacaaccagaggctaaactgaagttacaaagg

SEQ ID NO: 166153 - DNA, 744 bp, Homo sapiens
tcctgcagaaaggatatcttcatggtgtcagtgtaaagctggtgttaaaggatgcaatgtgtgaaggggaaagaaatctctgctttccagagctgtgctatggttaatagagttgcttagggaatggggaggtgaaaataaaggcaaagaggagcaggcctagggagcaggatgtcagcagtacacatgtgctaaccagacccagcgtgtgttccccagggctcctgccttttctgcgtctctggacttagaatcacactgatctgatctcagtcttttgctgcttctgtgtagctttgatgagttgctctaacttctctgtgcttcagtttctttattttccaaacaggaataatgatacctaattcctgggggttttgaacatattaaatgggtgaataaatgaatgaatgagtatcaggtgtctatatgactcactccagtagggaggttcccttttccctttgcagaagcagcagaagaggcaggaggaatagtacagtcccaccaccaccgcaaccactaagtgatctctttaccacttactgggtgccaagcctgtgttcaggcactttatcagcaccatttcttctggggagaccaggatgttgctttcagttcttacttatcttcatccttaattgattttgaaggggttaaattaaaaaaaatactaaaacaatttgaactgatatatattatagaaaatcttgatggactgagatgaaaggggcaaaaaaaccc

SEQ ID NO: 166154 - DNA, 331 bp, Homo sapiens
gttggtgagagaatgagcattattttagataccctgagtttgagatgacagttccattcaagcaggaatttcattaggcaagtgacaatgccacccccatccgcctttcattaaatctgtcattttcttttcttctaaattgggaatgttgcagagaaactgtgaaatagatgacacccctcttacgtgccaaatacctgacctccttttgcagcttcttacctttcactttcagaaatattctcccttgaaggggcttcgtgtttgtgtgcaggaattaatagcattttctatccctgtgccctgtagggaaagagcacagctaaacaag

SEQ ID NO: 166155 - DNA, 279 bp, Homo sapiens
catcaggcaggcccacagggaggacggtccagagcgataggcccatcctctttgaaagcatcatgacaagggagggccaaggccctcaaccagaccagaggagacggggaggggtgacaattaaatgcacatggaacctggaacagggaagggcactgggggagtctggtcacattcacatcaagtctgccattcagctgccaggactgcgcccacaggggactctcagctgtgataaatgcagcatgagtatgcaggatgctgctttgaggggaggcg

SEQ ID NO: 166156 - DNA, 451 bp, Homo sapiens
ctggtttccacaccttccttagatttccctgtgtgtaaaatccaacaacaatctttgacaaattgcctcccccaggagagagatggaggaagtgttaactttgcttttttttttttcttttttcagacagagcctcactctgtcactcaggctggagtgcagtggcgccatctcagctcactgcaaactctgcctcctgagctcaaatgattcttgtgcctcagcctcccgagtagttgggactacaggcagatgccaccacaccgggctaatttttgtacttttagaagaggcagggtttcgcatattggccaggctggtatcgaactcctggcctcaagtgatccaaccccctcagcctctcaaagtgctaggattacaggcatgagccaccatgcccagccacttagctattttttttaatagaaagcttcgaggtccagtatgattt

SEQ ID NO: 166157 - DNA, 415 bp, Homo sapiens
gcctcccaatcttcacacatttaccaagtaacaggacaaggttatgagcaggccagaaactcaaaagccaactagtccagcacaggaggctcctgccccagcacggcatcatcagaagcagcagcccagcagcctgcgccctgctccagcatactgagaacatttccccagtgagacctgtgtgccagctcaatgttatgaccttcatctgtcagtctagctccctgctctaggtccccttcttgttatttctgacccaaaggctgatgcccacctgtataggactcctctattaccaattaaaaaatatcctgcactactggttgactcaacttcttcctcttctcctctaagggactatcataaaaaaaaggctgtaggcccctcttcaataattggtcagttttactgtatc

SEQ ID NO: 166158 - DNA, 234 bp, Homo sapiens
tggaaaaacctagctgtccaaaattacttattcacgaaggcttttgaatagacaattatttttaaactgtttctatttagaaaatgagcatgtggatgattcaaataattggtgactgcctatgacttgggagttccaaaatgttagatcagcacttctcttaatgaacaacctctgctgtatggttttatctgataccttgtgtgacctctaagaaggattagacaactgaat

SEQ ID NO: 166159 - DNA, 398 bp, Homo sapiens
gagaggaggcaccagtggcaccctctggccctgcctgtgggtggctgatgagatggaatgtattaggtctctccacacctcacccagcccaggaactcttcaaggaaccccttggtgattaggaggcctgttacaggggttgggagaggcctgccacccacccccatcccatccccaactggttggcttgagggagggtccaagatgtgtcgggaggggccaagggctcagggatcccatcatttaccttcttcacgttgcttatgtctcaactggcttgcatctcattgttgggagaagcaggcattctctccaagaaccccagctcctttgacttgagggcctagtggagcttctgacttggccagaagagggtcatgaccttgggtttcgggttg

SEQ ID NO: 166160 - DNA, 371 bp, Homo sapiens
tctgtcatttaatattgggacaaaattgtatttctaactcacaacaaacagaaaaactacattagatgtactatcactttagatttgaaaacaattctttaaaacttttacaagaaaatcaaaataagactctactgcctttaatttgaggaagcacatgtcattaaggaaaagactgatgagttcacatttgctgataaaaataatataatctgtccatcctaagttaggtgtccaacaaatagttacatgtctatcctctcacctttcatgtcctccaacacttctctttaaagagtggcatagaataacatcatgaaagaatgaggaaactccagtgcaacaaaaaaattatagagtttataaatatc

SEQ ID NO: 166161 - DNA, 394 bp, Homo sapiens
tctaaaaacaattttatgaaaataagaaattaaaagaacaagtgaatgagcctgaaaatgatattggaagaatgtaaaacatacaccttaagttaataaaataaggcaaatgtataacagtaagagtcacttttaagaccaaagttctttgaaaactaataaaatagacaaacttctggtaaagccgatcaataggaatgagaaagggaataaatagggatttaaaaggaaataaagtgtatataagagattaaaaatttactactgtgagaactttaagcccatcaaatgggaaaactgttgaaatggacatgttcctagaaaaatacaattttaacaaaacatactcaaaagaaattacctgagcactcctattgcctaaattgaatctatt

SEQ ID NO: 166162 - DNA, 289 bp, Homo sapiens
gtgtctagcacatatatgctaagggctggataaagaactaatgaaaaataaatggataatgacagtctccaaatttatctttctgtgtacaaattacctagcatggtaacactggataatttttcctggaattctacttatgtagtgttgaattgatggcctagcattctggaggcctctactgcctggtcatcttttctgcattagtaggcctttttattgtactttccatcctccttcccatttctaggcttctgtcctttccactgaccactcctagaatggtttc

SEQ ID NO: 166163 - DNA, 295 bp, Homo sapiens
ccccaaagcatagaaaatgtaacacaccagggccttgaggaagcagcactataacagtgcaaatacacaaatatttaggaaaacttacatcacccaacagacagcatgtatggtcaccattatccagcactctccaaaataagtagctatgagtggcttatctaaaagttgccttatatatacttgtcaccacaaattgtttctgaacatactattgattccaattttggatattcacaacatggtaattatctggtaagatatatttatgactaacttgtaattagacttctaa

SEQ ID NO: 166164 - DNA, 471 bp, Homo sapiens
tacataatgtgtgcccaggatatcaaggagaatgatctatctagaatgaggggagtggtagcaagtagtgggagataagaatagagaggcagggtggagctagattatctggaggtcttaaaagagaagcagaaggaaatgaacaaaggcaagaaggtgggaataaatgtgtatccaggatatcaaggagaatgatctatctagaatgaggggagtggtagcaagtagtgggagataagaatagagaggcagggtggagctagattatctggaggtcttaaaagaaaagcagaggccgggcgcggtggctcacgcctgtaatcccagcactttgggaggccgaggcgggcggatcacgaggtcaggagatcgagaccatcctggctaacacggtgaaagcccgtctctactaaaaatacaaaaaattagccgggcgtggtagcgggcgcctgtagtcccagctactcggga

SEQ ID NO: 166165 - DNA, 330 bp, Homo sapiens
ccttagccgtgagtacaacagctatcagtgagctccatgagtccttctagagaattacctaagggtggtcttgaggacccccaagcttgcagttgctattagaagtgaaggtggtcttagggacccccaagccccacatacagtctcaaagcatctactgcaagatagttaattacaaagggaaaaacaagaagttgatggtgaagaaacctagcagctaccaccctaaccagtgatccaggttaccacatctgccgtgtggacagcatggcccagggaggatgtgtggggagggcacctcacccccgtctccagcaacccagcccgggt

SEQ ID NO: 166166 - DNA, 566 bp, Homo sapiens
agagagctctcagatgtaggggctgcagctggggaataagcctcaaattcctcattctcttcttctgacaaaactgcatgttcagctatagcttctacattggatgggggaactggctcaccttcttgctcctgtaattcatggttcaaatcctgtggtactgaatactctgatacaaaagcagaatcagtagaaacagatgcaatttcctctctttcttcctcagacaaagcaacatgttcaggagatgatgctgccaataatggtagaataagctcttcttctttgtgctccacttcaggggacatatgtggtgggaagggcttctcggaaaccaatgggctttctgggtaatcaagttctacgatctcttcttctactaaattagaatcttcaggttcaggggtaatagctatgggtagggaagtttctatttcttctttctctggttcttctaacattagaggttcagaaagagaaatggatggctcaagcatgttttcctccttctctcctttgacactggggatcgaagctttaggggatcctcagagtcaccgacagta

SEQ ID NO: 166167 - DNA, 455 bp, Homo sapiens
tagggaagtttctatttcttctttctctggttcttctaacattagaggttcagaaagagaaatggatggctcaagcatgttttcctccttctctcctttgacactgggatgggtaggggtcagttttgcggagactggttctgccctttctattgaagtcaggtccggctgttcttggtctgggtccaaaccatcctgggtagatgctgccagacctggtgacgctgcctccagagaaatggaatggtgagcagaatacacatcttccttctttacctcattagcaaatgatggtgagactgaagagtcattctctgaagctgcagttcctggtgaagcaagctcacattcttcctttgttgttctcaggaacatagttgcaggtgtgtcgggtgtcacagatggaggttccacttcatgtggttttgcttcatcttctggctgttgtggcactg

SEQ ID NO: 166168 - DNA, 406 bp, Homo sapiens
aattaaggcatcaattcctccttcccaaaccaaggcccctgctacctcctagataaagatagtgtatacttctgtaaggagaaacgaagacccttccccaaatcacactggaccctatatgggtgtccctccaaattcatggcctctcagagaagaatggcatgggtgatgaagaaaagaatttctttctctgaacgaatagatgtaattttagggttgaaggagtttgtgtgtgtgtgtgtgtgtgtgtgtgtgtgtgtgttcggttcgtttaccacaattctacactaaaatcataccatatagcagggaagaaattctgtgtcttaaaaatccaccagtcacaccaaaaatttgtaactccaggaacacacaaatacttggggatgtatgcaaagactgttct

SEQ ID NO: 166169 - DNA, 492 bp, Homo sapiens
cgagacggaccactcctctatgagttgctacagtatgagtcttcactctaagagcatcttgaccaagttgagaaggggaccttaagtttggtttgcggcaaacagcacttgcaagaaatataaccctcccttcccccaatacacagaaccaccgccaccaccaccaacaccgccacaccaacaccaccactacaaaaaaaaaagaattaataagtcacaaccccttcaaataagctttctttccagtcgctgtatgtatacaaagatattctctatgttttgtaagtaaaaacaaaaagaaaacctttcttttgttttttacacataagaaacagtattgaaaaatcccacgctatggttcatagggtggagaaggaggagttatctccactccaaaagaaaaaaaaaaagttttttaccttacaccaagttgagaaggggaccttaagtttggtttgcggcaaacagcacttgcaagaaatataaccctcc

SEQ ID NO: 166170 - DNA, 409 bp, Homo sapiens
tccccttttttgttgttttttaagagtcatagtctctgtcacccaggctagagtgcactggtgcaaccatagctcactgtaggctcaaactcttggactcaagcagtcttcctgcctcagcctcccgagtagttggaccacaggcagatcacaacgccagacgaactttaaaatttttttgttgagacagagtcttgctatgttgcccaggctggtcttgaactcttatcatcaagcagtcctcccaccatggcctttaaagcactagaatcctagtgattacaggcgttcttatgggttccttgagcagcttcagcctatcttgtgcttcttccatcttgtcttgcactgccttgaccatctatttgttcagaaatgcagaatgtggagttcctataagctctatatg

SEQ ID NO: 166171 - DNA, 358 bp, Homo sapiens
ggctgaggccggcagggcctatacctccctgcgttggacccgtgcctagctgggtgaagtgccctgtggtttacattgtaggaggcatgagaaagcatccttctctgtttggttttgtttgatcttctctgtgctcaggtcttcaaggggaaatacaggcccaagagtctgagttcagcccagtttgcaaccatagccctggagtcattcaggctgaactaaaacaaggccctagtggtgttcctgaaatcttaccccagctaaagtatggaacctgctctgagcctccgagagggagttttgcccccactgactcccactctcacacccttaacctcaagtggttttcttggcagga

SEQ ID NO: 166172 - DNA, 339 bp, Homo sapiens
cctatcacgtctatgcaaatgtccattttaactttaagtgcacagatgtctaatggcccgagacacgtaggttaacacccgtgcacgcgtacacagaggccttcacctacaaccatccccgtgtagacagcatcagaggcagggcaccaaaagcattaaaaccatgcagatgacctacctgagcacttcgcagacctagaacgtcaactatgtaaaatacctgcccatgaacattggcaaactcctggcctcaagcaatcctcccaccctggcctcccaaagcgctgggatcacaggtgtgagccaccatacccggcctcctccaggaggcaaatgctg

SEQ ID NO: 166173 - DNA, 631 bp, Homo sapiens
caaaatgagaactgtgcaaaatgtggattatggactcactcagcttaatttgcaatgtttatggtggtgaaaagcttgaccaatttattaaaacaacacagatgactgactttgaagaattggctttctgatgatcagcatttacaccagctagtctggtccccttaaagaaaccacgtaggtgaaggcctaggccacagcctgttgctgagggtcttcgaggcttcactgattgtctccaatactcagtcctagaattattgttcttcagtcaagactgggagcaatgaatggtcagtgattaaataatatcagagacttctagtgcattaattccctaacctctctttggcctctcccaaatcctagatttacatatcagcaaagatagggaggactttggaatcagcatctgatcagaggaaccccttcggatgcctcctttaaaatgagtctgccctcttatttcctggagtcatttggatggctaaggagggccttggggacattttctctggcacgtgcgctccttgctgttgcttgtaacgaggaagctcccaagcgaatcctcacgctctgcaggacaggctgtctttcagcatctggacacgtgggctacatggagttgcaa

SEQ ID NO: 166174 - DNA, 499 bp, Homo sapiens
caagccagactggttatttccctggggcgtaattcactcagacccacaggaaagcaaaaatgtgtaggatttgatggttcccatttgatagctcctttccagaaaacagtatgaaaagataagaaacactgtacaatatcctggtcatttctttggcctgggcatgaagctggctcttattattagaaagataaatgtcagcatccatgctgatggggcacaaatatccaattaaacatgaatcccagctcccaatcagcacacacatgtcttggccaagtggaagcactttcatttgctcagccttttcttccaatatgacttgtcctttgggtctttgagggtgaccggcctcctctagggaggatcattcaggaccataaatagaaatctggaatctcactgagcaatactcacttggctcttgaattctatttgtggaaatgaaatcttgaatcccatggaagtgcttaacaaaccagaagcagaaaaactctcc

SEQ ID NO: 166175 - DNA, 1753 bp, Homo sapiens
  misc_feature (106)..(107): n is a, c, g, or t
  misc_feature (234)..(234): n is a, c, g, or t
atgtgtgagcgcagtctctacagagcgggctatgtgggctcgcttctgaatctgcagtcgccagactctttctacttctccaacctgaggccgaatgcggccagtnnggccttccccctatctcctacccgcgcggccctgccctgggccgccacgcccgcctcctgcgcccccgcgacctgcggcgccactgccttcggcggcttctcgcagccctacctggctggctccgcntctcggctgcagcccccaacagccaaagacggacccgaagagcaggctaagttctatgcgcccgaagcggccgctgggccagaggagcgcggtcgtacccggccgtccttcgcccccgagtctagcctggctcctgcagtggctgctctcaaagcggccaagtatgactacgctggtgtgggtcgtgccacgccgggctccacgaccctgctccagggggctccctgcgcccctggcttcaaggacgacaccaagggcccgctcaacttgaacatgacagtgcaggcggcgggcgttgcctcttgcctgcgaccttcactgcccgacggtaaacggtgcccatgctccccgggccggcctgccgtggggggcggccccggggagggcccgcaagaagcggaaaccctacacgaagcagcagattgcggagttggagaacgaattcctcgtcaacgaattcatcaacaggcagaaacgcaaggaattgtccaataggctgaacctcagcgaccagcaagtcaaaatctggttccagaacaggcgtatgaagaagaagcgcgtggtgcttcgggagcaggcgctggcgctctactagccgcgcgcgtggccagggccgggttggatctgcccttttggacagaggccttgtttggggagggggatctggggctaaggctaaggcttttccttcggttccttctctgctggccccagaagccaccaagagatttacagaccaggccagttgggcctccttgctttcctcagtccctgagaagcccgtgagaaacgtgcggaagtaccagtgcaactctggctggccttaaggcttccacgttgggggactgaggccaactctccttgctcctggctggggcatttgcacccaccgctcattcttgctccccggtacctggatttttctgtttccacccaattcgttctccctttccccctctctccagccccttcagcgtatagcagtcgcctagttagggctcagagtggaaggcctcctgagggaatggaaaggactgtgggtacaattaggtctctgcagcagaagccctttgtggcaaggccaggatcttcactctggagaaaggaaagggcaccatccaccctccaccctcctgtctgccctggctgatttgagagaacaaaagccacactagatcttcagactttgggaggaaaagggagggaaggggaggggctgggtagtggggtaaacttggagatatctcgaaatgagaaatgcgaaataggctggcctatttccagctgggtagaatatgtggaaccttcatttcctgagatgggatgagagagactgggactccagacaagtgccatctccagacaagactggcaaacattgccctactcccaccttctcaaacatgcctaggccaggcctatgaaccctgtaactggatccccagaggctagctctggtgaaaggagctgttggtctgctttgaagctctgttgcacagggagagggaaaaatatccag

SEQ ID NO: 166176 - DNA, 1725 bp, Homo sapiens
  misc_feature (106)..(107): n is a, c, g, or t
  misc_feature (234)..(234): n is a, c, g, or t
atgtgtgagcgcagtctctacagagcgggctatgtgggctcgcttctgaatctgcagtcgccagactctttctacttctccaacctgaggccgaatgcggccagtnnggccttccccctatctcctacccgcgcggccctgccctgggccgccacgcccgcctcctgcgcccccgcgacctgcggcgccactgccttcggcggcttctcgcagccctacctggctggctccgcntctcggctgcagcccccaacagccaaagacggacccgaagagcaggctaagttctatgcgcccgaagcggccgctgggccagaggagcgcggtcgtacccggccgtccttcgcccccgagtctagcctggctcctgcagtggctgctctcaaagcggccaagtatgactacgctggtgtgggtcgtgccacgccgggctccacgaccctgctccagggggctccctgcgcccctggcttcaaggacgacaccaagggcccgctcaacttgaacatgacagtgcaggcggcgggcgttgcctcttgcctgcgaccttcactgcccgacggcctgccgtggggggcggccccggggagggcccgcaagaagcggaaaccctacacgaagcagcagattgcggagttggagaacgaattcctcgtcaacgaattcatcaacaggcagaaacgcaaggaattgtccaataggctgaacctcagcgaccagcaagtcaaaatctggttccagaacaggcgtatgaagaagaagcgcgtggtgcttcgggagcaggcgctggcgctctactagccgcgcgcgtggccagggccgggttggatctgcccttttggacagaggccttgtttggggagggggatctggggctaaggctaaggcttttccttcggttccttctctgctggccccagaagccaccaagagatttacagaccaggccagttgggcctccttgctttcctcagtccctgagaagcccgtgagaaacgtgcggaagtaccagtgcaactctggctggccttaaggcttccacgttgggggactgaggccaactctccttgctcctggctggggcatttgcacccaccgctcattcttgctccccggtacctggatttttctgtttccacccaattcgttctccctttccccctctctccagccccttcagcgtatagcagtcgcctagttagggctcagagtggaaggcctcctgagggaatggaaaggactgtgggtacaattaggtctctgcagcagaagccctttgtggcaaggccaggatcttcactctggagaaaggaaagggcaccatccaccctccaccctcctgtctgccctggctgatttgagagaacaaaagccacactagatcttcagactttgggaggaaaagggagggaaggggaggggctgggtagtggggtaaacttggagatatctcgaaatgagaaatgcgaaataggctggcctatttccagctgggtagaatatgtggaaccttcatttcctgagatgggatgagagagactgggactccagacaagtgccatctccagacaagactggcaaacattgccctactcccaccttctcaaacatgcctaggccaggcctatgaaccctgtaactggatccccagaggctagctctggtgaaaggagctgttggtctgctttgaagctctgttgcacagggagagggaaaaatatccag

SEQ ID NO: 166177 - DNA, 370 bp, Homo sapiens
gcttatgatcggtccggtgtgtcatgaaacagatatcattatatactcactgtagctcagacacagtgcaatgtactgatgtggggttcacatccctcaaccctcaagccatatacacttcctactatattcccctacagaatggaaagccattgctcctctgtgacaaggttcaaaaattacagtaattcttttgaaaaatcagtgtgaaacaccaaatagtcaagtgtgcctacaatgttgttggctgtaggaagtagaaggcagtatgagacacacttccaatctcaactcagaaccagaaaatctctactgaaaagatccatagacatgaatgatcaaatgtttcatctgtttcatgaacatttca

SEQ ID NO: 166178 - DNA, 326 bp, Homo sapiens
tgcgtagcttgtttctccacccagaggaaggcttccattagcatttgtcaaagccaggcaggtctcctgttgaattaaaccagacttagggagggaaagtctgtgtttacagaggaagctgtcctcccacccccgtcattaagaagctctagacaagtgacttttgacagttgtgttgttctgtattccttgtcaacagaagaatggatatgcgttgtgcacataagtatacaattttgcattttacttctgagggtgttgggcccagctatgaaagcttttgtttcggcatttgaggatgccagcagagatttaggaaaataaat

SEQ ID NO: 166179 - DNA, 830 bp, Homo sapiens
tagcctcctgagtggttttgctacctctgttttccccagctccacaatcttgttttccaccaacagagtaatgttttcgaaacataagcttgactctgtcatttattggcttcaagccctccagtatcctcccctctcactcagaatcaaatccagtttcttatcatggccctagggaccagcccgctgcctgtctgccctcaattcccactacccttcctcactccctggcccccagcctcactggcctcctcagtgcctttcctggagcaggctggaaacactccttcctcaggaagcttctccttgttgctccttctgcctggaaccctcagatgcagaccttgctcccttccttccttcaagtctctgctcaaatgccaccttagcagagggccttccctgaccagtctctctaacatagcgcccctggcatccttggaccctttctgatcccaactctgattttgcttactactgactgctacctgtcataattaacttacgtgtttgtttttgcccatctcctgaccattagtaataccccaaggggacctttggtgcctggcacatagtgagtgcttagcagctgggcaggaggtatggcatagtctggaagaggttaatgcaagtggcccctggtcactgcactgcctcttgcctgctgtgtgcttttgggcaactttacttaacctttcttagtttcagttccccctcagtaaaacctacctggaaggttttttaggaggattcgaggtaatacatttaaagtacctgagacatgatcagtgctcagacgggggctacacaggccacttagctgccctcta

SEQ ID NO: 166180 - DNA, 302 bp, Homo sapiens
agtccccctactggccttttcaggcctcgacccttcttggcaagcctcttccctccgctaccacacgacttactctgagcgtaggatctcacctctgctggagagaaaaaggccaatttgtggggagtaggaggcactctatcaactcattgcctcaaaatttttctaaacagctttttacataccataatttacataccgtaaaatttactcatttgaagtgtacaattcaatgatttttagtgtattgacagagttgcacaaccatcaccacatttaatctctgaacgtttccaccacct

SEQ ID NO: 166181 - DNA, 210 bp, Homo sapiens
taagtgtcatgcccttgagcctaggatcggcgatggtttatgccagaatcaagacatacaattcaatctaagatgcacagataggtccagacggggctcacattttagggccactttaaggacatcctcaatttcatatttctgtctcaaaatgccaattatagaaactttcaattcaggtcagttacatctgtaacagagatttagtag

SEQ ID NO: 166182 - DNA, 211 bp, Homo sapiens
taaagagagtttaaaaaataaaacttgatttatcaatattgtttaatgttcgtggttacaattgatggttgaattaataaacggttcttagaaaatttaagactactaaaaccaattatatgtgcatttttttcatgttttagtgtgaaatacggagaaggtgccaaatgaaaaagcatcacaatgccaatcttgggatttatttaccagg

SEQ ID NO: 166183 - DNA, 526 bp, Homo sapiens
tgtggcacgatcatggctcactgcagccttgaactcccaggcccaggagctgggactacagtaggcatgcgccaccacgcctggataatctttgttgtggtggagatggggtctcgataggttgcccaggctggtcccgaattcctggtgatcctctcacctaggcctcccaaagtgctgggatcacagatgtgagccaccacgcccagcccgctttatgtattatacttataatagtaaacataagtatcttcttcatatgccttcattttatctcatgaggaactaaagacaaaaataaatagtcactggaattaaaggcagcaaagggtttcaagcaggagagttctgtgtttttaaactatcactctggctctagaatggagaacaagttgatgcaaggccgaaagctgaggggtgccctaccccatcccccacatgaccaccaaacaactagatcctgcgcaaagctgatcgcaacctctgtgactgtcctcatggaaagaaaagaaaacctgcaagaatc

SEQ ID NO: 166184 - DNA, 313 bp, Homo sapiens
catttcaacagctcttatttccccctacctacagaaacgttatcttataatctttgactgcctttagaatataacctattggggaaatgaagtaggccagaaaaaaaattaagaaaaagtattaattcagcacagtgtagaaatcacgacatttggtctttcatcctgaaatgtaggacaaacttgagcaattcttttctttctgggctacacaagcctcagtcgtctctgaatcatgggagtttgcccttcatgatgagatctgggttttagtcctgacatttgctggatgggtaaccttgggaaaatcact

SEQ ID NO: 166185 - DNA, 736 bp, Homo sapiens
aatgccctatcgggaagtgcatagtgaattacctggaatattggtatgagctcaattaatgttggccattacaattaatgttggcagctactttgtcgagcctctgccttgtacgactccaggggcatcactcacagagagtacaatgtgtctggtgctccagggggcctttcactgtgagttctggatgactggcgccccctgcagttgtgcacaacagccctgtggacctgcatcgctctggaaggagggacagctgtctaggaatccgcaatagcccagggaggtgatggtgaggcctgaacgggggtggaggccgtggggagaaaacctggggaaccagttcagtaacaactttgttatcaatgattcaccattttcgaaagatcagtcagacttaggaccatgtcagtggccccagaagaaaaccaagccaatcagcggtgagagccgctgcacaggaatggctctgtacaggaatggctgcatagttgtggggacccagcacaaaaggaaaacatgggaccccttgttcaaaaattatgaatttcaagacagcaacagcagagcattaaagcacacacagggcacttctaagcatggggctctgtgcacctgcctgggttgcatgccagaagccagccctgtctcagtgctaccatcctacccccagccccaaacgcatcagccagggataggcgagtactggctctcgggcctccagcctgcaagctca

SEQ ID NO: 166186 - DNA, 532 bp, Homo sapiens
tgcttgacacaagaatgaaagagtatggcacattttagatacagtaagcaacttataactggactgtagaatgaaaaaaatgagagaggtaagaaatgaggctgtaaagggaggggacaggatttgcaaggacatgaggccatgctgagtagttgggaagtttattctcttaggtaagtggggttaccagatggattttgaggcttcatatattcaaatgatcacttaagctatttcccagttatctcttctttacattttataaggctttatttcttacaagtagacctttcctttcaatcctttaacccttttctgaatcccctgtaaattctcactttctctcacccagaactaaatacaaaagtctcacaagtagctaactgtactgagtacatggacattgtcccatgcactacatgcttctatttaagtactacaacagcaattattaaaatagctcttctcattatttttggtattcatcagaaggacttaagtttacttgtacagaaataaagtacagaggaat

SEQ ID NO: 166187 - DNA, 522 bp, Homo sapiens
tccacgcagccctgcggggtccccgggactgtgtccttcctcccctcccctctggcctccaaagccttttgggcccagtttcaaccagcagcctggtgcttgtgcccccgctgacacccggcctgccccctgccactctcccaggccccagtccaccagtccctccccgccgatggctccagcctgtacttgggcatcaaccagagaggggatgtgtaccctccctggccttgccaaagcccggcgtgtgcgttcatctgtgggagtggctgcctgaggggctgggggctggagtggggaggggtggaccttgtgccacattccaagcccctgccgttgccggagcatgcccttcaggcagccacgcttgggcgtctgctccccttgcagccacgtgtggaggggctgggaaaccccggctcatctgctgctcaaatcctttccagaggttttctggcagggtggcgacaagggtggagttctcccttgatgcgcccagccacctcccacctctctgtgcca

SEQ ID NO: 166188 - DNA, 515 bp, Homo sapiens
gggaaggatgtatcaaagatgataggttttggccgggtatggtggctcatgcctgtaattccagcactttgggaggcagaggcgggtggatcacttgaggccaggagttcgagaccagcctggccaacatggcaaaaccctgtctctactaaaaaatacaaaaattagctgggcgtgttggcatgcacctgtaatctcagctactctggaggccgagacaggagaatagcttgaacctgggaggtggaagctgcagtgagctgagatcatgccattgcataccagcctgggggacagagcgagactctgtctcaaaaataaataaatagaaaaaatgatagatttattcttgggcaaatcagtagatgatagaaccatttactgaaaaaaaaaaagtgcaggagaacaactttggttgggaagggagttggttagacatgatgactcagttctggaaatgttgagttcgagatgtctatggaataaccacatggaaatatccagacaacaatggg

SEQ ID NO: 166189 - DNA, 512 bp, Homo sapiens
gaaaaacttcatctttggtctagacatttgcagctgacaaccattcaacgatttggtttttttttagtccatggattaaacaatagtgggtcaagaatgctttttgaactttccttgaggaaactagggaaaccaccagtgcagttataattcatactgtgctgcctggccccgtcagccttgccgtgtccatgtgtcaggtcccccagcctacagtggattttccgtttacatcccaggatgatttaggaaatctctccagttttcaacagaaccagctgggtgcagatagggatttcgggataagccactgggtgccttcgcttcttccgtagtgacacccagcaaccctctgtagcagtcacctagtggctgtactccaaggcccatggtgagcccgagctgagaggagagcgataggaagtttcctctctgtaagtcctgcagagagcaactgcaggcaggaccatggtgctatccatctcaggggcctgagaaactgagggctcttc

SEQ ID NO: 166190 - DNA, 629 bp, Homo sapiens
tgttttctcgacttctttgaaatattctttcctgtagttattgtatgcagactattcataaaggctagttcttgagtcacttcaaactcagcattgacttctcaagtatacaacggggcagtattggtaacatttgttgactcaccaaaagccaagcaaagctacttgaaatcatttgccttgttttttaattaactgttggtgttgccacagtgtcctcatgtctccaagcaagtattcttgctgaaaagctagtagtcataaagaagtttttgtttgggcccactttctggttgctacaatcaaacacaattaaattaactctaactcaccatcagtatatagctgtctttgcttggctaacaaatgagccactcagaaagttactttggttacacccttattctaattttttaaattagtagattatgctgtgataagatactacattttaagttttctaattgttctgttgatttcctgtgggttgggaatattgtgatgagtgcttagtctggaaatatatttttgagcacagtgaaagtgtcattgcataataaacacaatgctttgccatatagttctactacaattcacactccactgtgccttaaaagtgcaacactcaa

SEQ ID NO: 166191 - DNA, 306 bp, Homo sapiens
cctaacctcaggggtagacccctccccagactctgcagtaactattcctgggccacatgtcatggagaaaatacgagaaagaactaagatttgttgagctttttactctgcaccaggcattgtgttaggtgatttattttgattaaactgtctcttttcttcttcttcttttttttttttttttttttgggggccaattcggtttggccgaaatgggagtgcagggttttcatctcagctcacgtgcaacctcgtgcctcacggggttacaaggggccagtagggggtgggggatcctcataaagt

SEQ ID NO: 166192 - DNA, 356 bp, Homo sapiens
aaaaaactagaaagtaatgatggttgaaaagattaggatgatttaggtcaacatgttaaatttaagaagagaatgtgacacaaacaaggagccacctggaaaccactgtaaatgcaagtagcacatacttagagtctgcttatttctatacacgtggaagctactatgtacagatggtacatgtgtacaggttgggacaagataaactcccccaaaccagggggagtctaagatcatggttagaagactaaaagatttaagctttattattgaggcactcaaaatgagaaaaaagtttgtgccgacatagcattttttaatactaagacagacatttaagactatctagacaaaaa

SEQ ID NO: 166193 - DNA, 238 bp, Homo sapiens
tgcagtgctgggattccaggtgtgagccactgcgccgggctggtgtactcattcttggttgaagttgccacctcctggtgggtgtcccttgctgcccaggcccctccctacattatctctggaccctttttccttcgcccttggctcctgcctcatttctgtcctcgatcagccctgcatctctcccagccatcacagctttccaggtttctctttcccattcaatgggcgcctctgt

SEQ ID NO: 166194 - DNA, 342 bp, Homo sapiens
aaatgcttctcagagttgtaggatgtctcctggcttctccacatcaacactgagaaacaccactgcataggaaagaaccatggagcactatgcaaccagattctaacttaaaaaagcaatcattgaataaagacaaagcaatcactacagaaggaagacttgaaatgccagttactttactgaagcagtgttcaactgaaatgcccaattataagagcactgcatactccatttcagaagtagccacataatactcaggtattcatgtaacagaagctcagtgattttaacgccagttgtttcagttgctaaaactagtacctacagttggtgttctctgtg

SEQ ID NO: 166195 - DNA, 190 bp, Homo sapiens
ggtactgctaatttacagtgttggcaataaggccaagctctccacctccatccatcttcaagcccaaattattttaggcctctcggaattgacatactagcagaggcaggagtcgttcctaaagaagttatgcatcttcttccccttgacattttcgtaaataaaatgatttctctctcaaatttaactg

SEQ ID NO: 166196 - DNA, 185 bp, Homo sapiens
tgctggaattacaggcacgagcccccgtgcccggcctgattcatcagtacttatactgtactgaacacgagattgggggttcccctgtacatttaaaaaattgatgtgtagtagttatttccttaatagtcacttcactaaagagcaggaggatgttttttggggaatgctgtctgaatgagata

SEQ ID NO: 166197 - DNA, 359 bp, Homo sapiens
gtgtgtgtatgtgtctgatttgttgctaacatttgcaaattaggatttctcacacaaaaatccagatttctagtttttcttggaaaatcataagatgtggcaatgctaaaccatcacaacctcacagcaaccatcaactagaactcgagagtggctgtcccctctaaaccaggcacgggctgacccagtgaccactgtcccactcagcctgcttcactcctccaggttatacacctggctcctgcaggcatttgactttgtgacccctgtactctactagtctaggctgaggcagggtcagtatggcagaggccaaattttagtgagttgacaatcagaaaatgaaattagtaaaacaa

SEQ ID NO: 166198 - DNA, 313 bp, Homo sapiens
gccattatagctgtgtagcgaagacagtgcaaaggcaattaaaaaaatcagaaccaagaaaaacattataaatataaaaggttttcttggagggtctcttgttggatttttactgctgtgttgtttgttgattatattttccctccctaggactaaatttacaaagaagaatttagatttgagctgtttattgctgccttgtcatcagatgtatgaagcccagttgggggtgttatgtgttaaatgccagtagttagtatcttactaaggagtgttcaaatacagctgttcggtgggattctggtaggtatag

SEQ ID NO: 166199 - DNA, 863 bp, Homo sapiens
ggatcccaagaggcccctgaagccccaagagctcccctgattgttccaaagcaacattcccctccatgaacaactcagggaccccctcgatccacggcgtgaggcccaccagcagaggaagaggagcttccagtcctgactcccactaggcgcaggggagccgaggtgagctcccaggcccgccgcatcttcccctcctctttgggtggattaaaacagacttggacagagtctggaaaaacaaactcttttaaaacaagacaaagattgagtctggccaactggctattttcaatccttgctgaacggagtcaagacagtcggtagtaacagcttgtggccatccgcaatcgtcctccccgcacgagagggtggagcctcctggaagtgaccagagccggtgacttcgggaatcaaccctcctgaaacagcggatggcctagtgagcctttccagaactgcagaggggcatttgagtgtggaacatgagtgctgggcacctggaggaatggaggattccccaaagctcgctggatgcacatcccttgctcagcagtccacatcatccgtatctctcatcccacagccgcgggctgcccagccagggccttgcggcaggaggtgggacagatgcagacttcagccccgagtctggcttacttcaggatccctcagggctctctcacctcagaggcagcgtgggaccccaggccacaccttgtttgcaggcctcgcctagatcgtggtaacagccagaactcaacaatttctccaagtcagcctccccgcagcccggagtggggactgagaccaacatgcaccctcatctgcgggcacgcagggacacagcaagtccagagtga

SEQ ID NO: 166200 - DNA, 635 bp, Homo sapiens
ctcttgggagctggggggaaacacatttttctctaccatttttaatcttcttttatttatcaaacttagctcctctttgggtggattaaaacagacttggacagagtctggaaaaacaaactcttttaaaacaagacaaagattgagtctggccaactggctattttcaatccttgctgaacggagtcaagacagtcggtagtaacagcttgtggccatccgcaatcgtcctccccgcacgagagggtggagcctcctggaagtgaccagagccggtgacttcgggaatcaaccctcctgaaacagcggatggcctagtgagcctttccagaactgcagaggggcatttgagtgtggaacatgagtgctgggcacctggaggaatggaggtgagccccccatcctgcggaccctcacagatgggaagtaggaggaggactcgccaggccatgccctcacgcactcttgatccttttaggattccccaaagctcgctggatgcacatcccttgctcagcagtccacatcatccgtatctctcatcccacagccgcgggctgcccagccagggacctgcccagctgtctccacaccctagagcccacctggtactgctcctggatgatttctgggtg

SEQ ID NO: 166201 - DNA, 731 bp, Homo sapiens
ggatcccaagaggcccctgaagccccaagagctcccctgattgttccaaagcaacattcccctccatgaacaactcagggaccccctcgatccacggcgtgaggcccaccagcagaggaagaggagcttccagtcctgactcccactaggcgcaggggagccgagctcctctttgggtggattaaaacagacttggacagagtctggaaaaacaaactcttttaaaacaagacaaagattgagtctggccaactggctattttcaatccttgctgaacggagtcaagacagtcggtagtaacagcttgtggccatccgcaatcgtcctccccgcacgagagggtggagcctcctggaagtgaccagagccggtgacttcgggaatcaaccctcctgaaacagcggatggcctagtgagcctttccagaactgcagaggggcatttgagtgtggaacatgagtgctgggcacctggaggaatggaggtgagccccccatcctgcggaccctcacagatgggaagtaggaggaggactcgccaggccatgccctcacgcactcttgatccttttaggattccccaaagctcgctggatgcacatcccttgctcagcagtccacatcatccgtatctctcatcccacagccgcgggctgcccagccagggacctgcccagctgtctccacaccctagagcccacctggtactgctcctggatgatttctgggtg

SEQ ID NO: 166202 - DNA, 262 bp, Homo sapiens
ccaaaataaagccttcttcacaaaaaggtacaaaatactctcttccttaaaatgttcataaggtttttaagagtgttgaaaattatatgcaagaagcctgaatgactactttagaaatgagtctgtggctcttctcaattatacccattactggaaaaaactaagaacatggacccacaaaaaacagtatctatgtaaaacatgatttccaattttgcttatctcggccccttctagttaaaatttgtatctgtccatcctg

SEQ ID NO: 166203 - DNA, 308 bp, Homo sapiens
gaagttcctaactgcttagcgcagggaacagcccccacaccacacagcatccccaagagcaattagtgccaggcctgagcgcctgccctccattccccctcagcacccccatccccaggagcggagggagggccactgtgctggtgtgaggcaaggggctggcgacctgtgtttttacagttgccttttttggtgatggatgaagtcttggggcagtttattctgggaagctactgtaaaaggcagcagctaagttcaggctccaatcattgtcctgaccccttccccaaaacacagttctcctgatg

SEQ ID NO: 166204 - DNA, 533 bp, Homo sapiens
ccaaaagcacaacccataaaaggaaaaattggtaaactgggcctcatcaaaattagcttttttttgttgttctgtgaaaatccatgagaagaggctaaaaagataagctacagaggaagtacttgcaaaccacatatcctacaaaagactagtatataggatatacataaatagttcttcacaactcaagagtaaaatacaaacaatccaattcaaaaataggcaaaagacataaagagacattacaccaaagagggtatatacggtagcaaataagctcttgaaaagatgtcaacatcattagccattctgtaatgcaaagtaaaaccacaatgaaatgtcactatattcctatcagaaaggctaaaatataaaacaatgataacatcaaatgctggcaatgatgcagagaaactggaccactcatatattgctgctgagaatgtacatggtacagccactctgaaaaacagtttgacagtttcttataaaagtaaacatgtgacccagcatttgtactcatatttatacca

SEQ ID NO: 166205 - DNA, 610 bp, Homo sapiens
accacccagcattgctgccccagacctgcactggtggtcactacacaggggtgactgttggcaatgagcaggcacccagccatggaatttcagtcagcaactcaggagttgcttagcctccagcaagctgccccattgagatgaccaggctcttgggaggaaagaagggtgcaccaggatctaggggttgctaggacaagaagtgaaactgacctgcgttaccctactacccccacctgccagcctggcccaccaggaccctcttcctcaggccactagctttttgtccaagtgtgagtctagtggatcccagatggcctgccccagacacttaggactaggtgggtcaggtgttttctctcctcatgtgtaagtatctacataatgtctttgattttgcttcttggccagcaaaacctaaaatatttatttactctctggccctttacataaaaggtgtacagatctcttcgctagaatatcacaagtctagtctttttcagctattcgacaattcacgtgacttttaagtacgctacttagtggcagcgttctgttgtagaattgtagttcttcacagtctttctgttttttaaatgaatatgaagct

SEQ ID NO: 166206 - DNA, 702 bp, Homo sapiens
ggacagaacagggctgtattgaaactggagaggagcctgcaggagtctccaggagggagggccctctcctaatgatgctggcctgaagaggcctgaggccgaaaggtgagggggcggggctgttcaggacacctggtctgtgtactcacggcctctatctaccctgttcaggggaaccccaaacctgcttttctttctttctcagcctctcctccctcctcacaccctggatgctgagagcagggcccagctctgctctttccacaacatttgggccatgttggcacagagcgggggcctcttgggctatggtggccacactccccgggctaactgagttacctgattcccagcggaaaggtcaggaagggagggaagaaacttgctgagctacaaattcgagactgctggggctttctaggacaggccaccttcctgcaattgtccctctgtgtccccaactccccgcagtcccgcaggccaggaggtgggtgcctgatgagcggtgcttccctcagatgatatgtgggcaccctgaagctctcacgtaatggttctgctgtgccgggttgtgacccagctgtccttggtaggctctcctgtttaatgagcaactgctatatgccaggccctgttctagaaacagatgaggcccctgttcccatggaacttagatctgagtatgtggacagagtgagtagg

SEQ ID NO: 166207 - DNA, 132 bp, Homo sapiens
agaagtagatcgtgctggcatgcgcgcttgtgactggtgagcgattgctatatgccaggccctgttctagaaacagatgaggcccctgttcccatggaacttagatctgagtatgtggacagagtgagtagg

SEQ ID NO: 166208 - DNA, 106 bp, Homo sapiens
tacattttgccatctgatatggtttggctctctgtccccacccaaatcttaccttcaattgtaataacttccatatatcatgggagggacctagtgaaagttacct

SEQ ID NO: 166209 - DNA, 146 bp, Homo sapiens
aattagtctgggatatgagaaagaatccaggtaggaaaaagatgttaaaataatgccaacatttctttggggagaaaagtggttttcacatgaccttctccaatttgagctcgaaactgtataggaatgaaggaagatggaacaac

SEQ ID NO: 166210 - DNA, 106 bp, Homo sapiens
aggcggtgtctaatcttctatttattaagtgaattttctatattagacattgaaattttgatttccagaagtttgattgcatgttttcaaggtttctacttaacat

SEQ ID NO: 166211 - DNA, 294 bp, Homo sapiens
atgttgtccaacctaacagagtctgaatttgtttaacatttacagtaccttagagaggagctcagtgagctcaaatgagacgagaaaggtagccactgggttctgagcagggtctgccacccctttctggaccccaccccctgcccagagtgccagatggcccagctgctgtccttgcctcttccaaaagcttggggaggtcttgctgcatcttcccatgtgggaaactcaggcaggcaggcagccctgccaaccagggaccaaatgcactggcctggaggccatagggtgttc

SEQ ID NO: 166212 - DNA, 402 bp, Homo sapiens
atttagcacacatcagattactagttaagagaaactcactgtactggagatcctggcctcggtgtattcgttggcctcctgttcttttattacattttgaaacaggagtgttatttgattagttttgagatgagtggattagagctgagttgagcaaaggttgctttctctgaagcattcatcttaggacagtgacctgctttccaaaaggcagagctcagactgtaccatatttccaaggatctctatttctaggcaaaattctgaaaattttttgcaaacaataggcagcttagaattaacaatgtttataaggaaatgatgagatatcattcttaggggctcaggttgtcccttcccctttggaatgacatggattaatgtctatacccggtggctggc

SEQ ID NO: 166213 - DNA, 302 bp, Homo sapiens
aatggcatggagaaagacaaacactggtgggtggctctgccagcttcccctggggtgcttctggcgatgcccaggcctttgcacgctcagatctttgcaccccactgttttaacttggagaggagaggaggaagttagctgctctgaatggtgttgctgctaatctctacagcactttcctgtaaattaggaacggtaacacacacacccctcccccaccccgttggagaagccctgcaccagagcatacagtttggcaagtagggggagggctggagcccagcctcacttgccaccctggc

SEQ ID NO: 166214 - DNA, 136 bp, Homo sapiens
  misc_feature (112)..(112): n is a, c, g, or t
  misc_feature (123)..(123): n is a, c, g, or t
  misc_feature (125)..(125): n is a, c, g, or t
acttgtaagacagatgttaaacaaatgatttgaagggtcagtgggatatcaatgtggaacatgaacagaaagaggctagagacagggaggtgacttaaaggcctgtggcgantaaaccagacnangaaagtgatgg

SEQ ID NO: 166215 - DNA, 323 bp, Homo sapiens
atgctaaaagttcttaagtgtccttaaatagcccatgagtataaatattcagttaaatagaaaaaccgcagaacaatgtaagaaaatcgatgtaagagaacaatgattttgtagatgggaattaagattctaatatgcatttgacccagtaaatgaactcttaagaagggatgtctcattgctctctcttgtattgctgtgttttaagcaatggtaaatctaagcaaagaatattacaatcttagctttttaaagcaaattcggaggcttaaaataaaactccattattaatgattctctgtttgctttggccattgacattt

SEQ ID NO: 166216 - DNA, 770 bp, Homo sapiens
ggatctcaaattccctgaagttattcaatttttttcttttcttcttcagtttccaattctcaaattatttcagctatacttacacatgtatttattttacttatttacttatttatttatttatttatttatttattttttgagacagagttttgcctgtcgcccaggctggagtgcgatggcgtgatctcggctcactgcaacctccacctcccgggctcaagctattctcctgcctcagcctccctagtagctgggatttcaagcacacaccaccacgctaggctaatttttgtatttttactatagacggggtttcaccatctcagtttggccaggctggtctcaaagtcctgacctcaagtgatccgcccaccttggcctcccaaagtgctgggattacagccgtgagccattgcacccggcccatttacacgtttaaatgttcaaaaactttctaactgaaatattctgtcttttaactgcaactcattgttccagactttgtctgtgagtgactttaaaatttgaaagctaataaacaacagtatcagttttaattttattaatatttttgtctgctggctggataatgtgacagaattagacttcttttttacacttgatcttagccaaaaggccgagaagctattagacttcttttttatgctttcaatactacaaatcttggcttgttcaaaagggaattttttagcttcaagcaaagtagcttctcttttcttattatccatcagtacttaaaattctgt

SEQ ID NO: 166217 - DNA, 362 bp, Homo sapiens
taccctccccgggtacttgctgctaggaagaatggctgaggcctgaatggcaaatggaggagactggaagatgcatagattgcaaagagatattgcaccccaatccacgctctatacttgtctccagaaatccctgaatttaaatccattgcttcagtttctttttaccatttttaagagactatgagaaatatccttttatggtgttaaagactgtttagtatacaactcctgaagaacagaatttagccataatagacttttggaaaacattgcttacaagagattccactttttctcatattggttatcctaagaataaagtttatagttactacccggggaggggggggtaccgagct

SEQ ID NO: 166218 - DNA, 206 bp, Homo sapiens
tgaggaagcagcagacaagtatacctgaatacaatatcttaacctggaacacgaagacataaggcctacgacttacttaggcatgtgatattgtattcaggtatacttgtctgctgaggaagcagcatggcagataccaaattaattttttagctaccagatgcagccactagcttgtgggttgtaagagcaaatagttctttctc

SEQ ID NO: 166219 - DNA, 3578 bp, Homo sapiens
atacggtgcaacgggtccgcgggactcttggatgcgcggaggtcccgagaccaggtgcgtgtgctaagctcaggtctgagcacggtggatcccatgggtgtggctctgaggaaattgacgcagtggactgctgccggacatggaactggaatcctcgaaatcacccctctaaatgaagcgatattgaaagaaattattgtgtttgtggagagttttatctataaacatcctcaagaggcaaaatttgtttttgtggaaccacttgaatggaacacaagtttggcgccctcagcatttgaatcaggttatgttgtcagtgaaacaacagtcaaatcagaagaagttgataaaaatggacagcctttgctatttctctctgtaccacaaattaaaattaggagctttgggcagctgtcacgcttgttacttattgccaaaactgggaagttgaaggaagcccaagcatgtgttgaagctaacagagaccccatagtaaaaatcctgggctctgattataatacaatgaaagaaaactcaattgcattaaatattcttggcaaaattaccagagatgatgatcctgaaagtgaaattaagatgaagattgctatgctgcttaagcaattggatctgcacctcctcaatcattctctaaaacatatttcattagaaataagtttaagtcccatgacggtgaagaaggatatagaactgctcaaacgtttctcaggaaaaggaaaccaaacagtcttggaatctattgaatatacctcagattatgaattttcaaatggatgtcgagccccaccgtggagacaaattcgtggggaaatttgttatgtgctggtgaaacctcacgatggtgagactctgtgcattacttgcagtgcaggaggagtatttttaaatggtggcaaaacagatgatgaaggggacgttaattatgagagaaaaggttcaatttataaaaaccttgtcacatttttaagagaaaaatcaccaaaattttcagaaaatatgtctaaattgggaattagcttcagtgaagaccagcaaaaggaaaaggatcagcttggcaaagcccccaagaaggaagaagcagctgccctccgcaaagacatttctggttcagacaaaaggtcactggagaagaaccaaattaatttttggaggaatcaaatgaccaagagatgggaaccaagcttaaactggaagaccactgttaattacaaaggcaaaggctcagcaaaagaaatccaagaggacaaacacacaggaaaacttgaaaaaccaagaccatctgtttcacacggaagagcacaattacttcggaagagtgctgaaaagattgaggaaactgttagcgatagctcctcagaaagtgaggaagatgaagaaccacctgaccatcgtcaggaagcaagtgcagatttgccatcagaatattggcaaattcagaagctggtgaaatatttaaagggaggaaatcaaacagctacagtgattgcgttgtgttcaatgagggatttcagcttagctcaagaaacctgccagttggccatcagagatgttggaggcctggaagtgctgataaatttgcttgaaaccgatgaagtcaaatgtaagattggttcattaaaaatactgaaggaaatcagtcataatcctcaaatcagacagaatattgttgaccttgggggcttaccaattatggtgaatatacttgattctccacacaagagtctaaaatgtttggcagccgagactatcgcgaatgttgccaagtttaaaagagcacggcgggtggtgaggcagcacgggggtatcaccaaactggttgctctactagactgtgcacatgattccacaaaacctgcccaatcgagtctgtatgaggccagagacgtggaagtggctcgctgtggggcactggccctgtggagctgcagtaagagtcatacgaataaagaagccatccgcaaagctgggggcattcctctgttggctcggctgctgaagacttctcatgaaaacatgctaattccagtggtggggacattgcaagagtgtgcatcagaggaaaactaccgggctgcaatcaaagcagaaaggatcattgaaaaccttgtcaagaacctaaatagtgagaatgagcagctgcaggagcactgcgccatggccatttaccagtgtgctgaagataaggaaacccgggacctcgttaggctgcacggaggacttaagcccttggccagtctactcaataacactgacaataaagagcggttagctgctgtcacaggggctatatggaaatgttccatcagcaaagagaatgttaccaagtttcgggaatacaaagccattgaaaccttggtgggacttctaacagatcagcctgaagaagtacttgtgaatgtggttggggccttgggagaatgctgccaagaacgtgaaaaccgagtcattgtccggaaatgtggtggcattcaaccacttgtgaacctccttgttggaataaaccaagctcttcttgtgaatgttacaaaagcagttggtgcttgtgcagtagaacctgaaagtatgatgataattgatcgcttagatggagttcgtttgttgtggtccctgctgaaaaatcctcacccagacgtgaaggccagcgcagcatgggcactctgtccatgcatcaaaaatgcaaaggatgctggggaaatggttcgttcctttgttggtggtttggaacttattgtcaatttactgaaatcagataacaaagaagttctggcaagtgtatgtgctgccattaccaacatagcaaaagatcaagaaaatttagctgttatcacagatcatggagttgttcctttattgtccaaactggcaaatacaaataacaataaattgagacatcatctagcagaagctatttcacgttgctgtatgtggggcaggaatagagtggccttcggtgagcacaaagcagtggctccactagtgcgttatctgaaatcaaatgacaccaacgtgcatcgggcgacagctcaggccttgtaccaactctcagaagacgccgataactgcatcaccatgcatgagaatggtgcagtaaagcttctactggatatggttgggtcccctgaccaggatctccaggaagctgcagctggttgtatatccaatatccgcaggctggctcttgctacagagaaggcaagatacacttgaaatttaaatggacattacaagctatcaaattctacatgacacaggacatgtcactcccatggccagaaagcctaaattgggaaacagttgttagcaaaccctttcaaccatctaaatgaaaacacacaaattgaaaatgcacagaatgtttttcatctgaaaattgcatggagacttttgtttctatttaatgttttcgagatatgacatgtgataagatggaaagccaataaacctgtgataagtttctaagaatatgagaatatacgtatatgatgtatttttagttcagtgatgcttttgtatttgtggcgattttaataaaggatatggccttcccaaaaaaaaaa

SEQ ID NO: 166220 - DNA, 2742 bp, Homo sapiens
agagtagaggagagcggagagaaggaagctctcacttctctgctgaacagcagagtgccttacatgcatataggagggcaaaacagatgatgaaggggacgttaattatgagagaaaaggttcaatttataaaaaccttgtcacatttttaagagaaaaatcaccaaaattttcagaaaatatgtctaaattgggaattagcttcagtgaagaccagcaaaaggaaaaggatcagcttggcaaagcccccaagaaggaagaagcagctgccctccgcaaagacatttctggttcagacaaaaggtcactggagaagaaccaaattaatttttggaggaatcaaatgaccaagagatgggaaccaagcttaaactggaagaccactgttaattacaaaggcaaaggctcagcaaaagaaatccaagaggacaaacacacaggaaaacttgaaaaaccaagaccatctgtttcacacggaagagcacaattacttcggaagagtgctgaaaagattgaggaaactgttagcgatagctcctcagaaagtgaggaagatgaagaaccacctgaccatcgtcaggaagcaagtgcagatttgccatcagaatattggcaaattcagaagctggtgaaatatttaaagggaggaaatcaaacagctacagtgattgcgttgtgttcaatgagggatttcagcttagctcaagaaacctgccagttggccatcagagatgttggaggcctggaagtgctgataaatttgcttgaaaccgatgaagtcaaatgtaagattggttcattaaaaatactgaaggaaatcagtcataatcctcaaatcagacagaatattgttgaccttgggggcttaccaattatggtgaatatacttgattctccacacaagagtctaaaatgtttggcagccgagactatcgcgaatgttgccaagtttaaaagagcacggcgggtggtgaggcagcacgggggtatcaccaaactggttgctctactagactgtgcacatgattccacaaaacctgcccaatcgagtctgtatgaggccagagacgtggaagtggctcgctgtggggcactggccctgtggagctgcagtaagagtcatacgaataaagaagccatccgcaaagctgggggcattcctctgttggctcggctgctgaagacttctcatgaaaacatgctaattccagtggtggggacattgcaagagtgtgcatcagaggaaaactaccgggctgcaatcaaagcagaaaggatcattgaaaaccttgtcaagaacctaaatagtgagaatgagcagctgcaggagcactgcgccatggccatttaccagtgtgctgaagataaggaaacccgggacctcgttaggctgcacggaggacttaagcccttggccagtctactcaataacactgacaataaagagcggttagctgctgtcacaggggctatatggaaatgttccatcagcaaagagaatgttaccaagtttcgggaatacaaagccattgaaaccttggtgggacttctaacagatcagcctgaagaagtacttgtgaatgtggttggggccttgggagaatgctgccaagaacgtgaaaaccgagtcattgtccggaaatgtggtggcattcaaccacttgtgaacctccttgttggaataaaccaagctcttcttgtgaatgttacaaaagcagttggtgcttgtgcagtagaacctgaaagtatgatgataattgatcgcttagatggagttcgtttgttgtggtccctgctgaaaaatcctcacccagacgtgaaggccagcgcagcatgggcactctgtccatgcatcaaaaatgcaaaggatgctggggaaatggttcgttcctttgttggtggtttggaacttattgtcaatttactgaaatcagataacaaagaagttctggcaagtgtatgtgctgccattaccaacatagcaaaagatcaagaaaatttagctgttatcacagatcatggagttgttcctttattgtccaaactggcaaatacaaataacaataaattgagacatcatctagcagaagctatttcacgttgctgtatgtggggcaggaatagagtggccttcggtgagcacaaagcagtggctccactagtgcgttatctgaaatcaaatgacaccaacgtgcatcgggcgacagctcaggccttgtaccaactctcagaagacgccgataactgcatcaccatgcatgagaatggtgcagtaaagcttctactggatatggttgggtcccctgaccaggatctccaggaagctgcagctggttgtatatccaatatccgcaggctggctcttgctacagagaaggcaagatacacttgaaatttaaatggacattacaagctatcaaattctacatgacacaggacatgtcactcccatggccagaaagcctaaattgggaaacagttgttagcaaaccctttcaaccatctaaatgaaaacacacaaattgaaaatgcacagaatgtttttcatctgaaaattgcatggagacttttgtttctatttaatgttttcgagatatgacatgtgataagatggaaagccaataaacctgtgataagtttctaagaatatgagaatatacgtatatgatgtatttttagttcagtgatgcttttgtatttgtggcgattttaataaaggatatggccttcccaaaaaaaaaa

SEQ ID NO: 166221 - DNA, 4053 bp, Homo sapiens
agcggagtttggcggctgtggggatttgccggaaggttaataatgtccatgggcacatcggcctcctcctttcttattctctcccaagtgtaattccaggacgccccctgagcgcagattcatccaggcatttggcctagaggcccgcggaggagaaataaagtacaggcctggtaggacctttgagaacctgggcttcagctacaaaaccagagccccagtccttcatctgctgtctcctcaagctcttttcagtgtattgtggagttcattaccactctaagctcgcacggaagtgtacaccagcttcgtgatcttaaaagcaaaacaaaatcaaatggactaggaattaacttgaagcagagttgtgacacttaagtggtttcttgccatcagtttccacgcactgctttaagatgcaattttacaagggtccttcaagaagttactatatgaatgcacttggggaaaccagagctaccagaatcatgttcttcagtcatcattgtgatgatgcagatattgtcacttgcgtgtgctaagctcaggtctgagcacggtggatcccatgggtgtggctctgaggaaattgacgcagtggactgctgccggacatggaactggaatcctcgaaatcacccctctaaatgaagcgatattgaaagaaattattgtgtttgtggagagttttatctataaacatcctcaagaggcaaaatttgtttttgtggaaccacttgaatggaacacaagtttggcgccctcagcatttgaatcaggttatgttgtcagtgaaacaacagtcaaatcagaagaagttgataaaaatggacagcctttgctatttctctctgtaccacaaattaaaattaggagctttgggcagctgtcacgcttgttacttattgccaaaactgggaagttgaaggaagcccaagcatgtgttgaagctaacagagaccccatagtaaaaatcctgggctctgattataatacaatgaaagaaaactcaattgcattaaatattcttggcaaaattaccagagatgatgatcctgaaagtgaaattaagatgaagattgctatgctgcttaagcaattggatctgcacctcctcaatcattctctaaaacatatttcattagaaataagtttaagtcccatgacggtgaagaaggatatagaactgctcaaacgtttctcaggaaaaggaaaccaaacagtcttggaatctattgaatatacctcagattatgaattttcaaatggatgtcgagccccaccgtggagacaaattcgtggggaaatttgttatgtgctggtgaaacctcacgatggtgagactctgtgcattacttgcagtgcaggaggagtatttttaaatggtggcaaaacagatgatgaaggggacgttaattatgagagaaaaggttcaatttataaaaaccttgtcacatttttaagagaaaaatcaccaaaattttcagaaaatatgtctaaattgggaattagcttcagtgaagaccagcaaaaggaaaaggatcagcttggcaaagcccccaagaaggaagaagcagctgccctccgcaaagacatttctggttcagacaaaaggtcactggagaagaaccaaattaatttttggaggaatcaaatgaccaagagatgggaaccaagcttaaactggaagaccactgttaattacaaaggcaaaggctcagcaaaagaaatccaagaggacaaacacacaggaaaacttgaaaaaccaagaccatctgtttcacacggaagagcacaattacttcggaagagtgctgaaaagattgaggaaactgttagcgatagctcctcagaaagtgaggaagatgaagaaccacctgaccatcgtcaggaagcaagtgcagatttgccatcagaatattggcaaattcagaagctggtgaaatatttaaagggaggaaatcaaacagctacagtgattgcgttgtgttcaatgagggatttcagcttagctcaagaaacctgccagttggccatcagagatgttggaggcctggaagtgctgataaatttgcttgaaaccgatgaagtcaaatgtaagattggttcattaaaaatactgaaggaaatcagtcataatcctcaaatcagacagaatattgttgaccttgggggcttaccaattatggtgaatatacttgattctccacacaagagtctaaaatgtttggcagccgagactatcgcgaatgttgccaagtttaaaagagcacggcgggtggtgaggcagcacgggggtatcaccaaactggttgctctactagactgtgcacatgattccacaaaacctgcccaatcgagtctgtatgaggccagagacgtggaagtggctcgctgtggggcactggccctgtggagctgcagtaagagtcatacgaataaagaagccatccgcaaagctgggggcattcctctgttggctcggctgctgaagacttctcatgaaaacatgctaattccagtggtggggacattgcaagagtgtgcatcagaggaaaactaccgggctgcaatcaaagcagaaaggatcattgaaaaccttgtcaagaacctaaatagtgagaatgagcagctgcaggagcactgcgccatggccatttaccagtgtgctgaagataaggaaacccgggacctcgttaggctgcacggaggacttaagcccttggccagtctactcaataacactgacaataaagagcggttagctgctgtcacaggggctatatggaaatgttccatcagcaaagagaatgttaccaagtttcgggaatacaaagccattgaaaccttggtgggacttctaacagatcagcctgaagaagtacttgtgaatgtggttggggccttgggagaatgctgccaagaacgtgaaaaccgagtcattgtccggaaatgtggtggcattcaaccacttgtgaacctccttgttggaataaaccaagctcttcttgtgaatgttacaaaagcagttggtgcttgtgcagtagaacctgaaagtatgatgataattgatcgcttagatggagttcgtttgttgtggtccctgctgaaaaatcctcacccagacgtgaaggccagcgcagcatgggcactctgtccatgcatcaaaaatgcaaaggatgctggggaaatggttcgttcctttgttggtggtttggaacttattgtcaatttactgaaatcagataacaaagaagttctggcaagtgtatgtgctgccattaccaacatagcaaaagatcaagaaaatttagctgttatcacagatcatggagttgttcctttattgtccaaactggcaaatacaaataacaataaattgagacatcatctagcagaagctatttcacgttgctgtatgtggggcaggaatagagtggccttcggtgagcacaaagcagtggctccactagtgcgttatctgaaatcaaatgacaccaacgtgcatcgggcgacagctcaggccttgtaccaactctcagaagacgccgataactgcatcaccatgcatgagaatggtgcagtaaagcttctactggatatggttgggtcccctgaccaggatctccaggaagctgcagctggttgtatatccaatatccgcaggctggctcttgctacagagaaggcaagatacacttgaaatttaaatggacattacaagctatcaaattctacatgacacaggacatgtcactcccatggccagaaagcctaaattgggaaacagttgttagcaaaccctttcaaccatctaaatgaaaacacacaaattgaaaatgcacagaatgtttttcatctgaaaattgcatggagacttttgtttctatttaatgttttcgagatatgacatgtgataagatggaaagccaataaacctgtgataagtttctaagaatatgagaatatacgtatatgatgtatttttagttcagtgatgcttttgtatttgtggcgattttaataaaggatatggccttcccaaaaaaaaaa

SEQ ID NO: 166222 - DNA, 2623 bp, Homo sapiens
agcggagtttggcggctgtggggatttgccggaaggttaataatgtccatgggcacatcggcctcctcctttcttattctctcccaagtgtaattccaggacgccccctgagcgcagattcatccaggcatttggcctagaggcccgcggaggagaaataaagtacaggcctggtaggacctttgagaacctgggcttcagctacaaaaccagagccccagtccttcatctgctgtctcctcaagctcttttcagtgtattgtggagttcattaccactctaagctcgcacggaagtgtacaccagcttcgtgatcttaaaagcaaaacaaaatcaaatggactaggaattaacttgaagcagagttgtgacacttaagtggtttcttgccatcagtttccacgcactgctttaagatgcaattttacaagggtccttcaagaagttactatatgaatgcacttggggaaaccagagctaccagaatcatgttcttcagtcatcattgtgatgatgcagatattgtcacttgcgtgtgctaagctcaggtctgagcacggtggatcccatgggtgtggctctgaggaaattgacgcagtggactgctgccggacatggaactggaatcctcgaaatcacccctctaaatgaagcgatattgaaagaaattattgtgtttgtggagagttttatctataaacatcctcaagaggcaaaatttgtttttgtggaaccacttgaatggaacacaagtttggcgccctcagcatttgaatcaggttatgttgtcagtgaaacaacagtcaaatcagaagaagttgataaaaatggacagcctttgctatttctctctgtaccacaaattaaaattaggagctttgggcagctgtcacgcttgttacttattgccaaaactgggaagttgaaggaagcccaagcatgtgttgaagctaacagagaccccatagtaaaaatcctgggctctgattataatacaatgaaagaaaactcaattgcattaaatattcttggcaaaattaccagagatgatgatcctgaaagtgaaattaagatgaagattgctatgctgcttaagcaattggatctgcacctcctcaatcattctctaaaacatatttcattagaaataagtttaagtcccatgacggtgaagaaggatatagaactgctcaaacgtttctcaggaaaaggaaaccaaacagtcttggaatctattgaatatacctcagattatgaattttcaaatggatgtcgagccccaccgtggagacaaattcgtggggaaatttgttatgtgctggtgaaacctcacgatggtgagactctgtgcattacttgcagtgcaggaggagtatttttaaatggtggcaaaacagatgatgaaggggacgttaattatgagagaaaaggttcaatttataaaaaccttgtcacatttttaagagaaaaatcaccaaaattttcagaaaatatgtctaaattgggaattagcttcagtgaagaccagcaaaaggaaaaggatcagcttggcaaagcccccaagaaggaagaagcagctgccctccgcaaagacatttctggttcagacaaaaggtcactggagaagaaccaaattaatttttggaggaatcaaatgaccaagagatgggaaccaagcttaaactggaagaccactgttaattacaaaggcaaaggctcagcaaaagaaatccaagaggacaaacacacaggaaaacttgaaaaaccaagaccatctgtttcacacggaagagcacaattacttcggaagagtgctgaaaagattgaggaaactgttagcgatagctcctcagaaagtgaggaagatgaagaaccacctgaccatcgtcaggaagcaagtgcagatttgccatcagaatattggcaaattcagaagctggtgaaatatttaaagcaaaaggaaacaagtcaaaatggcagaaacaaaagatggatcaggaagcagaataccagagtgattagaagcatgatctttgacgttggaaagaccagttgagttgaaattctgccgcttactcaatggccttgggtgatgatgctgtaccctaattctaaaggaagcaatgaacccccttttcagctaccttactgataagcacttatgttctgccttctgctatcctgatggttcgggttgtctgtcttactatctacttcttgagtagagagaccacattaaatttattgctgtatctcacagggcatcttgctagtgtgcacaggctcgcctccctacctctgccccgatggtgtgaaggggagagggcgaggttccttagtggcagggctttgctgttcttcactctcagccccctgaaagcagttcttcctgcctctgagcctgtctttccttctgctgttaacttctttcctacttttcttgcatccctctcccttccttttcctgccgtctttcttgtagacatactagttgattgctgtatttgctgactttatatggatattattttttcctctggccaaaattgttttaaaatcttgcaaggaaaatgtcttgcttttgatcacttccagcgattaaaggagatggtttgttaatgtc

SEQ ID NO: 166223 - DNA, 343 bp, Homo sapiens
ttttctgagatgtttgggctgaggatgtggtttacaaatatgattgatgtaaatattagagccatgttaagaaaatactatcttggtgggcttacatttcttgtgggaaggaaatgtataagctcccaaatctggaggaaggttttttgtagggttttgtttctttgctttccgtggctgctatggagtacgaaaagtgattttttaaagcattcttgtttttgacggaggtgagcttggtaaggaacactgtagctattgaagaatgccttaaatgttctttttaagatttccatgaacattggatttatctattattataggttgctctactagactgtgc

SEQ ID NO: 166224 - DNA, 2088 bp, Homo sapiens
agcggagtttggcggctgtggggatttgccggaaggttaataatgtccatgggcacatcggcctcctcctttcttattctctcccaagtgtaattccaggacgccccctgagcgcagattcatccaggcatttggcctagaggcccgcggaggagaaataaagtacaggcctggtaggacctttgagaacctgggcttcagctacaaaaccagagccccagtccttcatctgctgtctcctcaagctcttttcagtgtattgtggagttcattaccactctaagctcgcacggaagtgtacaccagcttcgtgatcttaaaagcaaaacaaaatcaaatggactaggaattaacttgaagcagagttgtgacacttaagtggtttcttgccatcagtttccacgcactgctttaagatgcaattttacaagggtccttcaagaagttactatatgaatgcacttggggaaaccagagctaccagaatcatgttcttcagtcatcattgtgatgatgcagatattgtcacttgcgtgtgctaagctcaggtctgagcacggtggatcccatgggtgtggctctgaggaaattgacgcagtggactgctgccggacatggaactggaatcctcgaaatcacccctctaaatgaagcgatattgaaagaaattattgtgtttgtggagagttttatctataaacatcctcaagaggcaaaatttgtttttgtggaaccacttgaatggaacacaagtttggcgccctcagcatttgaatcaggttatgttgtcagtgaaacaacagtcaaatcagaagaagttgataaaaatggacagcctttgctatttctctctgtaccacaaattaaaattaggagctttgggcagctgtcacgcttgttacttattgccaaaactgggaagttgaaggaagcccaagcatgtgttgaagctaacagagaccccatagtaaaaatcctgggctctgattataatacaatgaaagaaaactcaattgcattaaatattcttggcaaaattaccagagatgatgatcctgaaagtgaaattaagatgaagattgctatgctgcttaagcaattggatctgcacctcctcaatcattctctaaaacatatttcattagaaataagtttaagtcccatgacggtgaagaaggatatagaactgctcaaacgtttctcaggaaaaggaaaccaaacagtcttggaatctattgaatatacctcagattatgaattttcaaatggatgtcgagccccaccgtggagacaaattcgtggggaaatttgttatgtgctggtgaaacctcacgatggtgagactctgtgcattacttgcagtgcaggaggagtatttttaaatggtgtaagtaaatttttaaaaacgtaactaaagccagtggactttgattgttagctgtagatgtctcaagggtgtgtcccaatgaccacagagaatgaattaccattctgtgggatagaagcagattcctttgatatatgcttgctgggcaaatccaaaatagcttcagaattagctctcttattctccactgcaggtcattaagccaatctgataagaaatgggcttcaaagtgacccattccactttataaatgtctttaacgtaatcacttcactgattcattacacagcttccaaatgatagaaaggtcaaaaaagaaacattgagataatacagatgtcataactgcagcttgcatcctaagagttggagggacaaagggaaagagaggggcttatctaaatgtagaaggtaggagacagtgccctatgaagctgggacccagacctcttgggagggtccacttccaggctgtgctggtccccacagagttcagaccatctccatgaggcagggctccagatctctgaagagtgggcactgcccagttaatgctcatacctcgggaagaggatccttgtagagatggcagagctgggacctggacctttgaaaatggagcactggatgactgatagtgatatttcccagggggtgaggtgagcctgtttctgggaccgtgaaaaatcaacaaacctgga

SEQ ID NO: 166225 - DNA, 434 bp, Homo sapiens
tctttttttcaaaaattgggttgtctttattattgatctatagaagatataattatgttagatataaatattagaaatattttttccagtctatggcttgcttatcatttttaatctatatttttgatgtacagaatacttaatttttgatgttcaattttatcaattttttcttttgtgtgctttttgtattctgactaattttgtgaggtttcttgtcctgtatttgcagccaagtttttctattttgttgttgttgttgattataaagtgcttgtgctcagaagtttctttattttacttttctatttattactgaactgtgacattttattttaacctcctttatttacacattctacatttctccttcgaggtattttcttaaaaaatcatagagtcatttatctcttattattaaaaaatattttccc

SEQ ID NO: 166226 - DNA, 203 bp, Homo sapiens
ggagttttttaggaagataaatccagcagtggtgtgtcagctgaattagaggaggagaaaagaagccatttaggagtactttaattgtttagatgtgagaggctgaatgtttgggttaagatgttagttgtcagaatcatgagaaaaggttttaagcaagaggcatttctaattctaaaaataacaactactgttatttattg

SEQ ID NO: 166227 - DNA, 431 bp, Homo sapiens
gtgaaatggtgcagctgctttggagaacaaaacttgtagacaagtcaaacagttgttaagtggaatcagaaacacgtatttcgtctttgtctccatttgaagatcctggctggcatacagctcctaaaaccctcagaatttcctaagtgatgaatgtctgtttaatgctactgagtcgattggtggctcctgtagtttcaggagggggatagtcaccagaaagaccaaggtgtgattagaggggtggaactttcagcctcaccccctcaacctccaggtaaagcagagaggacagagagtaagccaatcatcaaaggccaataatgtaatcaatcatgcctaagtatgaaacctccataaaaaccccttaagtgtcagggtttggacagctctgagttgaaaaacacatcttcatgccaggaggctggtgt

SEQ ID NO: 166228 - DNA, 373 bp, Homo sapiens
  misc_feature (367)..(367): n is a, c, g, or t
tgtgtgaccctgaaacaaattttaaaaatacaatgcaaagtcccaaagaaatgacagttacacatccattgttttgggcaatctctgggatggcttctaccctaccctttatgaacctacacagaaaatacagagtggactctgtctagtttccttaacattttagtaatttcagggagagtcttcctatcacaagtgtactcacacttgccttttaaattcaaaatactaccaattccttcttcctattataagaagcttagagtgaaatgaaaatattcttcatggcaccatctaataccaccattatccttttgttgtatttcctttcaatttttatacatttgtttcatgacacccggaccgngctcga

SEQ ID NO: 166229 - DNA, 1125 bp, Homo sapiens
gaaatagtgggagatggagaagagtgaatgagtttctcccactctatactaatctcactatttgtattgagcccaaaataactatgaaaggagacaaaaatttgtgacaaaggattgtgaagagctttccatcttcatgatgttatgaggattgttgacaaacattagaaatatataatggagcaattgtggatttcccctcaaatcagatgcctctaaggactttcctgctagatatttctggaaggagaaaatacaacatgtcatttatcaacgtccttagaaagaattcttctagagaaaaagggatctaggaatgctgaaagattacccaacataccattatagtctcttctttctgagaaaatgtgaaaccagaattgcaagactgggtggactagaaagggagattagatcagttttctcttaatatgtcaaggaaggtagccgggcatggtgccaggcacctgtaggaaaatccagcaggtggaggttgcagtgggcaccatctcagctcactgagggtccggctctttgggttcaagtgattctcctgccttgttcctcctgagtcgctggtattcacaggtgcttgccatcaaaacccaagctaatatagagtcctgatagaaggacacggggtttcctccatgtggggcaaggctgtgtctcaaggctccttgacctcaagtgacctaaccaaccctgtggcctccccaacagtggttggaaggccacgtgaactggttcaggaaatactttttattggagaatgcagtctttgacactcatacacggcaggtggagtgaaagggggaaatctgggtacatggacctccactacggagtcaaggcgatcatcttcctcaggaccccaggtagctggattaagggtgggcccaccagaaacagctaactgggactcacagaaacgggttcgccaggtacagggtggtccaaagccagccatggagatcaccactggtcaaaaggtagatacgggggagccacgccgccaaacttcaaagaggacggcgcaacaccgtgcgcggggcacgtgtacaggagccatcagagaaacgtagcgcaggaggcaaatcaggagggaaaacaacacgtggagaa

SEQ ID NO: 166230 - DNA, 588 bp, Homo sapiens
gaaatagtgggagatggagaagagtgaatgagtttctcccactctatactaatctcactatttgtattgagcccaaaataactatgaaaggagacaaaaatttgtgacaaaggattgtgaagagctttccatcttcatgatgttatgaggattgttgacaaacattagaaatatataatggagcaattgtggatttcccctcaaatcagatgcctctaaggactttcctgctagatatttctggaaggagaaaatacaacatgtcatttatcaacgtccttagaaagaattcttctagagaaaaagggatctaggaatgctgaaagattacccaacataccattatagtctcttctttctgagaaaatgtgaaaccagaattgcaagactgggtggactagaaagggagattagatcagttttctcttaatatgtcaaggaaggtagccgggcatggtgccaggcacctgtaggaaaatccagcaggtggaggttgcagtgagccaagattatgccattgcactccagcctgggtgacaaagcaagactccatctcaaaaaaaaaaaaaaatcagggagggttaaagg

SEQ ID NO: 166231 - DNA, 832 bp, Homo sapiens
tctggaacccccagtagggaacaactccttttccccaacaaagggcatgctgccccacctccactcctttgcccaggctggtctctttggctggaatgctcaccttcccactgcccaccccaccatcttgagcctgtgtctagacacaggaagatggaggactgaggacttttcctgtgactcagaccacaggacaggaatgcatttttccaagatgagccaccagcattcctttggagaagtcagggtttgtcaggtcagtccaacttgctgtgagcacactaaatataggtactaagaacatgtcttttaggaaggggatggaaggaagggaagggaggcaccgtgagagggtgttggaaaggactgagcacttcagccagttgatttacaggcaaggtcatttccaagtccttacttacaaggttgggccctttggctatttcttttccaaagttaaattttcctttctgcaaagggcacaaagagaatttttagtttcattaaaggctgactcctcaaagtttatatagtcaaggaccatttttttttttaatctaggaaatttcctgaagaaaatatttgactttgtagtcgtatttggctttgagtataagaattataaaacagcagcaggccaggcatggtagctcatgctcacacctcccagcactttgggaggccgaagtgggtggatcacctgaggccaggagttcgagaccagcctggccaacatggtgaaaccttgtctctactaaaaatacaaaaattagccaggcatggtggtgcatgcctataatcccagctatttgggaggctgagacaggagaat

SEQ ID NO: 166232 - DNA, 245 bp, Homo sapiens
gccttcaccctcctgctggaagaaaagaccccaaccctcctcccttctgaggccagagcacctggtgctctgaattctgaacccctgcccccccacttccttagacacctcagcccaatgtttatccctcctgctctccaggctctcagaattctttttattttctttttattttttttgtctttggttgttgttgctatttctggggccgctcccgcggcatatggaggttcccaggctagggg

SEQ ID NO: 166233 - DNA, 610 bp, Homo sapiens
gggaagatgtgctgatgacagtcctgcacgcggaaggtggaaggtgcagttgcccttctctcaagactcagctcaacaactatattttctggtctgcctctcccagctgctttaacttacatactaatgtaatcaagttcacagcacccgccttaacatgaaattacatgctctcatatattgctaattcacttctcactagatttacgtggtctccctgaaacactttaagctcctaattacagagtcatgtctcccacatgctatgtctcagagtatgatggagaatgctgacataccaggccttaaagtgaggtggtgttggtagattcgtggccaatctttattttgccaaagcagcagtcagcagaaggtggtgggaaaatagcatttcaggctcagtaagcatctgtttagattaccagggagaagccaactctcagtttgtacctgggcttcctgatgtggatttacagctcaacagcaagttgtggatccaacagctgaatagaaaagtttggggagtttctgtcctccaaccagatgcacaaaaagcaccgtgtctattcagattgtttcagcataaatggagcatttataaaatggaggg

SEQ ID NO: 166234 - DNA, 364 bp, Homo sapiens
caaagttttttgttcccctttggccttgataccatctttcgttttattaaagttgattatggttcctctgtcttgtccctagccagacaaaggcttaggagaagtcaaaggacgtgttaattatgtttcttgtaaactgacttttcatttccccctaacacatttagttggcttggtgtttagtttaacaatcaattgctacaaatatgctgcttaaaaatgctgcttttattaaaacaaataaatgaattcaaagacctttctaatttcaactcgtgtgggctagaaacagaagagaaaatcgaaagcaagagagagggaaaggcggcagggaggggagagaaaggagaccaggaaacacaca

SEQ ID NO: 166235 - DNA, 370 bp, Homo sapiens
tatggactacattctatactactctcagaggtcaaagtgttgtgccccattcctctgcttgacaaaaaccgtacttacctttcaaagctcacttcaagttaagctaagctattcctgataaccccctcttctgtctcccacaaacttcagttatacctctagtatggcatttattattgtttcctatgacactgattcatgtataggtaacctcttctctttattaggctgaaggctctacggggaccaacactgatttagtactacttgtttactttatggtactaagtgcatggcatgtattagataaatgtacgctaaactgaacctatgaaactactggactcaacagcagtcaacttggtattta

SEQ ID NO: 166236 - DNA, 642 bp, Homo sapiens
tgtggcacctttgtgaattttaacaagcttctgctttgcagctcatacatgatcatgtctcataccatcaggacctctcgctggaaccttcttccgcagacttaacttcctccactggattatgcttttgtgttatattcccaatttttcaaagttcatttattctttcaacattgaaaaattatttatcagatatctcctgtgggccagggactgttaagaggtgctgcggatatagcaatgaacaaaatagacagaatccattcttttactgaaacggcagtctagtggagggagacaataacaacacaaaaattgtcacatggtggtaagtgtggtggagaaaaataaaatacactctaatgaatttcattttttttcttctgttttttgtaaaggtgggatcttgctatgttgtccatgctggtctcgaactcctggactcaggccatcttcctgcctttgcctcccaaagtgctgggattataggtgtggccaccatgcctggcaaagacaactgtcttaattgaaaaaagtgacatttggctgggtgtggtggcccacgtctgtaatctcaatgctttgggaggccaaggtgggagcatcgcttgcgcccaggagtttgagaccaacctgggcaat

SEQ ID NO: 166237 - DNA, 500 bp, Homo sapiens
atgtaataaataagaatctctggaaataggactagaaatccatatttttttaaagcttctcaggtgattgcgatatgtagtcaagttgagaatcactatattaactcaggttgaatagctgttctctgcttttttacgcagagaactaatcctaaatcttgttttccatacataattttagattcctaggctgtgacctactttaaaattaagaaatgtcttccctagtaaaaggatgtaaggggtgttctatttcactggtgtagggcagggggcagaagtccttcacatactccccatgccaggagctaactctgctccctttatagattgtaaaatcaaaaaaaggagttttgggggctgcgtgtggtggctcatgcctgtaatcccaactctttgagaggctgaggtgggtggatcacttgaggccaggaatttgagattacagtgagctatgatcacactactgcaccccagcctgggtaacgagattgtgtcaa

SEQ ID NO: 166238 - DNA, 171 bp, Homo sapiens
ccacatatttattgatgcaattaaaagtttgaggaacaaaaataccctggaagagaatacatgaatattttcatgtatagtggttcaatagtggttatctccagaaagtgagttgtggaagtctatatcatttatttgtttaatattttaaaacaacaaccttgtattact

SEQ ID NO: 166239 - DNA, 427 bp, Homo sapiens
tggggtgacagaaccggttttttaaaatcttgattttgttggtggctacacaacagcatgtgtttatcaaaacttgtagaatagcagacttaaaaagataaatttcattttgggaggctgaggcaggtggatcgcttgagctcaggagttcgagaccagcctgggcaacgtggtgaaaccctgtctacacacaaaaatataaaaattagccagggatggtgacacatgcctggagtcccagctacttagttacttggagggctgaggtgagaggattgcttgaacctgggaagtcaaggctgcagtgagccgagattgtgccactacactccagcctgggggacaaagtgagaccctgtctcgaaataaataaataaataagtaaatttatttatttattttactgtatgttaagttgtaccttggt

SEQ ID NO: 166240 - DNA, 639 bp, Homo sapiens
acaaaagatagtatttctgtccatatgtagttatcagactctggagtcagatagacttgggttagaattctggatttaccaccacctggctgggtgactggacagaagtaacatattctcaactgagtctcacattcctcagctgcagaatggggacagaaatactttgtacagttatatgagaattaagaaaatgcacacaaagtgcttagccagtggctaccatgccctaagactttaacagatgataactattaccatagcctattgttaatggctgtaataaagcctgttgtttttaacttttattaacttaaagaataaatgttgcagtttgactcagtgtgggactataattgcaaagcaactcatttatccacacagcctcctttctgagaattagaactaatgtacttagaaggatttgactgaagttctgctctggattttcttaggaattatttgggcaaccatgtccattaacacttatctagaaccgcaaggctgaaagtatgttattgtttgattaggttttcattagccaattattatttattgaccatatgataggtggaatagataagtatcacaaaagacatacgattcctactctacacatttagaactaaaaacagaagg

SEQ ID NO: 166241 - DNA, 469 bp, Homo sapiens
caaagtccaaaagtcggtataacttttgatcaaccaaatggacaataaacaaactttccattttttgggagactaaaaagcttagtaaaatgtttggaaataaggtaatacacataaataaggaaaaaacataaataaaatatatacagtacatataaaatattcatgtataaattaaatgccattcacaggtaccaaaaatactcagtttgaaataagtaattaaaaaggaatcctaatttacaatagcagcagatgtgaataagttaatgaactttgagggaaaatatattaccaatatgaagaaaaccagaagattcttctgaaaagtataaagtacaagaaaagcaatatgatatttttagaagactactattttaataatgtcgttctcccaccaatgaattaatatgcatagagcaaaatcccaataaaaaataatttgggagaacttgacaaaataattctg

SEQ ID NO: 166242 - DNA, 396 bp, Homo sapiens
agttgtgttcctataggacacatgggtttctgcatgaaagcaactatgtccagtcccctaaacctggtgattttattggaaatacctccagttaatttttacgctaataacctcagcccactcacaccaaggccaaaagttaccagagttatgaacagagccattgcccaccttttccccctaaacgttgttgttggtgcacatctgcagaaagaggccgtttacgtggaatttcaaatctggttgtttagtctacaaggaggggggaaggattctgtctctttaatgtttataacggttggacagagcttgtcgggtgaaggttaattgctctccagtttaagcagttctgtgcccagatgggttatcagggctgaacactcgttacaagactaa

SEQ ID NO: 166243 - DNA, 444 bp, Homo sapiens
acagaatgtgagaaaatatctgcaaatcatgtatctgataaggaattgatacccagaatatacagagaactcctaaaataacaacccaattcaaaaatgggcaaaggacttaaatagacattttccaaagaagatatacaaatagctaataaacacataacaagatgcgtgacatcacaaattactagggaaatacaaatcaaaagtataagaagataccacctcacatccattaggatagccactgtcacaaaacagaaaacaagtgtcggtgagaatgaggaataactggaacctttgtgcactgttgatgggaatgaaacatgggtacagccgctatggaaaacaatgtggcaattccttaaaaaattaaaaataggattaccatatgacctagcaattgcatttctgagtatatacccaaaagaacgcagggtcttgaag

SEQ ID NO: 166244 - DNA, 203 bp, Homo sapiens
ggaattaatttcatattttctccatgtggtcaaataagttattcatgtgtttgcattctttttgtgtctcttcctttgtcctaagtgtaggaggtctagaaatatactcccttttaatttctgttatgggtgaaattgcaagagtgtggggtcttagggtacagattgtttgctgattgtcctatacacagtaaagtagatga

SEQ ID NO: 166245 - DNA, 356 bp, Homo sapiens
caatagcctcaataaacaacaacaaaaaccctaagaataaacctaaccaaggaaaagaaattgctaaaaggaatttaagaagacaaatgcatggaaagacattctgtgttcaagactggaagactttgtattgttaagatgtcaatactatccaaagcaatctacagattcaatgcaatctctatgaaaatgccaatagcatttattgtaagaatggaaaaatccatcctaaaattcatatggaatatcaagggatcctgaatagccaaaacaattaagaaaaaaaaaagggaacaggctgggcacggtggctcacacctgtaatcccagcactttggaaggccgaggttggtgga

SEQ ID NO: 166246 - DNA, 558 bp, Homo sapiens
aaatatttcaaactcatttacattcagaaacatctttttaagatcactgtgatacattcgactgtcaattctgaagagacgtataaaggaaatgccagctaaggagcaaggaaacagctttcattcatgggctaaattgcagcttaaaaaagatggaccaggattatttcctttagaaacttactgtacaaaagatactgttcaccccattagagaactgatttgaagttactcttccctgtgagggctctgtcatcttaactgtattcacatactttcaactgttccccttgctgctaacctcaggttctttagttcatctatctgacagagctgatttggggaaaacaagacaaaccttgtcaggttttcttaataaataagcagttgtcatgtttcaagagttttagaaatgagcaataatcaaggaagaggacaacgattgcatacgtttataatatttagaacatcttttgccacaataaacactggaaaccacccacttgtggacaccaaacatttggatttgtatattttgtggcattccctcactctaat

SEQ ID NO: 166247 - DNA, 502 bp, Homo sapiens
atgccaaagactagttattgtggccatactctttttccattagtggcattggagaaccagaaacatgggatccaaagagaagcttagcaatgttaagtcatgttaatactaatttaatttttgtttgccaccctacccccaccaaaaaaaaaaaaaaaaggttataatgtgattgtcacgacagcatggggctgtactgagctttttgtcatgatattaaataggcttctctgttagaaaaagatttctggtctaaggacccaagtagatcatataaacagaagtgtgctgttatggtggaggcatattcatgttggttctgcattcacagtgaacatttgtacccaactcctaagacctactagagatcaaatgtgtttaaattgagtgtactcagatagaaagatattctgaaatttctcagctcttttctctatattgttgaaaattatcttttacaatgcaaagcctctttaacttgtaaaatatattattatacttt

SEQ ID NO: 166248 - DNA, 536 bp, Homo sapiens
ttaagtgaccctccagaacaggtgatggcagagccagtgccttctaactgatgttcagtccagtctccaaatttcccctttgtataagaataccagttgtatttgattagggcccaccctgatgacctcatttgtaaatacttatctccaagtaaagtcacattctgactttaaaaccacatcctgggggttaggatttcagcatatgaatttggaagtgggggacagagttcagctcataatacttcactctctccccaccagaatacatgtccttcacccaatgaaaatattccatcccaacaaccccaaacgtctttcagacatcaactctcaagtccaaaatctcatcttaaatatcataaaattgggtatgcgtgacactcagggtatgagtcatcctgaagcaaaattgttctctagctgtgtgtgaacctgggaaaccagacaaaaagttatctgcttccaaaacagaatggtgggacaggcatagaatatacattcccattctgtaagggagaagttgcagggggaaa

SEQ ID NO: 166249 - DNA, 316 bp, Homo sapiens
aggttaccccctagcctgggtcacggcagggaccagcaccgaggactagctacataatttgtgggccccggtgcaaactgaaaatgtgctcagatgtcaagacaaagtcctgactcgaagtcaaagccaggctccacccaccgagacgcttaggtcccctaaggcagtgggtctcacacttgagctggggtcacaatcactggaagggcttgttaaaaaacaggttgctggggcccagtcctagagttctgattcagtggatgtgatgtcggcctgggaataagcatttctaacttttttttttttttttggggac

SEQ ID NO: 166250 - DNA, 641 bp, Homo sapiens
tcacatctcacttcttatatttcaacagcttccaaaatgccacccttcatactgctatcagattcaactttgtaaaacacaaatgactgtttacctttcttaaaagactcagtagtgctccagaaacccagactaatgattctcaccttttctaccagaacctatctaagtaagtgaaggttcagagtacaactcaaggagcaggctggagaaggtgagatgggggaatgacgctggagtggaccagcatgtctattttcttaacacctccctactttctccatgtctctaggagttacaatgcagactgtccagaattgctattatcggtctgtagaataaaatctaagtatagcatagatgtaagatccttcacaaaaagacctctacctaactttcccagcattacctttatcatttaccatgtattagctcactggttctcaaagtatggtccaggaccacctccccaacccccagccatcagagggagtctgtgtggagttaaaacctaggtctgtcaaacatgaatgtgcaccaccctactttatacatttatctctcattttgtaaatattaaaagtagagataattgagatcaaattctggatcagccacaaattagctatttgctaatttat

SEQ ID NO: 166251 - DNA, 398 bp, Homo sapiens
gatgagtaaaaacactttcagtccctacagttgtgccatgctttttagcgagtggtattgcaggatgtccagaattgctattatcggtctgtagaataaaatctaagtatagcatagatgtaagatccttcacaaaaagacctctacctaactttcccagcattacctttatcatttaccatgtattagctcactggttctcaaagtatggtccaggaccacctccccaacccccagccatcagagggagtctgtgtggagttaaaacctaggtctgtcaaacatgaatgtgcaccaccctactttatacatttatctctcattttgtaaatattaaaagtagagataattgagatcaaattctggatcagccacaaattagctatttgctaatttat

SEQ ID NO: 166252 - DNA, 500 bp, Homo sapiens
gctgagatctgtaaatgggaggaacaggtctcccgctggaagaccatgcttcctctattgtagcagggaagaaaaataaatggtttacttcagaattgataaaatgtaatagttacgtatctcacaggtcaagtagcctaaattcaaagctaaattttcaagttttatcagctagtatatgaacataaaacatggagtcacacagtcaagtggtggttaggtcagactggtcatataaaaatgcaccacagccaagattgtgccactgcactccagcctgggtgacagagtgaggccaagcacagtggctcacgcctgtaatcccagcagtatgggaggccgaggagggcggatcacttgaggtcaggagttcgagaccagcctggccaatataatgaaaccccatctctaaaaatacaaaaaatattagccaggcgcctgtaatcccagctacttgggaggctgagtcaggagaatcgcttgaatccgggagacagagg

SEQ ID NO: 166253 - DNA, 424 bp, Homo sapiens
ggatgctgcccagaatctatctattgtagcttactctaatgcatcagttcccagcctttttggatttatgacattctatttgtgtttgattttgcatctccctcctcacaacttcaatggctgtgacagccgggtctgtgttatcagtggagagcaaagtcctgataggaactccacaaattttctctctcattcagttttatcttaattacattaacctttaattttaactatcactttcagactttttctggaccattaacaagctgctcaattacattgctatatggaatatgtttatttaaagtttttgaccaattaaaatgccttgaaaaattttgtgatacagtataaaaagtagtcaatgatagtgagaattgtattttatgtgcatttttgtgcaagaaatttgatagagtaatat

SEQ ID NO: 166254 - DNA, 435 bp, Homo sapiens
aaaaagcagtgatcctggaaacacaagcatcagcatgtgcctggggtccacactcggttaatccatgaatcgtgaatccacgtgtcacacagagaggcgcaggcattgcaaggggacggggcagcagcacccttaggcccagcgcccgtgctaggcgacccacactctggtggcgccacacagagaagtaaacggcaacggcccacaccggaaggggttgaggagtgacgggggatcggcgcgatggtggcgcgcagctgggcaggctgggagcgggtggctgcctgcatcaggcctgggctggaggccagctctaatctgagaacgtggccattaggatggaattagcagcaactcagtatccgctgagtctctaaaagccaagttatgagaacgccatcatctcgcagaaaaccaatttatggtaaagtgtga

SEQ ID NO: 166255 - DNA, 516 bp, Homo sapiens
atttaaacctgggcaactatgaatatactgtttaaccttctttatcaagtataaagagatagttcctaaatcgggcaaattatgtgccagtaaaactttggccattactgatgggaaatgaagcagcgtggtgaatgatgtttaaaaacaaacagaaaactatttcaacagattaaaaagggaaacgaagaaggtatgaagtccaatgtagctagagtgaagatcaaaataaagcttccttatctaaactggaaattggccaggctacacgagactaatctttctaattaaaaagcaaggtatactctttaatgtccattatgagcatttaaatgaacacctagaatattgtcaaaataaaaactgtgatgctgacatcttccaccaatgttaaatatatatttttatacaattataaaacttctcaatctggaatcttggcaccatcaactcaaatcataaacaaaacattttggcacttgaggcaagatcactgattgatgtatactcccactc

SEQ ID NO: 166256 - DNA, 440 bp, Homo sapiens
ctgggataagtgggctagaaatgacaggggctggcattgcaatgacctttccacaggaatttcattttcaaaacaaacaaaactataagcgtttcctctagcaacacatctaagaaacaacgatcaaaatgtaaacattattaaacctattttccttcttgctaagtagaggactcctggaaatctccatcatcttgccctgttgtgctacaggacatatggtatatcaaaatcacccactgctcggctacccccaattaagagtcataaagggttatcgtgcacgaagcagtttacgaaggcccctcttttaaaggtgacctgccacactgaatttaagtcaaaggactgcttcatagtatggaggttgagaaagccaagcccaaaggggaagctgacccacaccccaccaatatttaacacacccgccaagccccctc

SEQ ID NO: 166257 - DNA, 228 bp, Homo sapiens
ctgggataagtgggctagaaatgacaggggctggcattgcaatgacctttccacaggaatttcattttcaaaacaaacaaaactataagcgtttcctctagcaacacatctaagaaacaacgatcaaaatgtaggctaactgcttatggtgtgatggttctcaaattagtttagtgaaaacatctcgaaccccaaagaaagttttgaaaatgtgaggtggtgtcatgc

SEQ ID NO: 166258 - DNA, 232 bp, Homo sapiens
cagcataaagactatagttaatgtggtattgcttttgggatttttggtgctcttgccacatgcaaaaaaagtggaagtaactgtgtaagatgatgcgtaatttgcattataatagtaaccatttcactaggtatatatatatcaaaacatcctgttgtacaccttaaatatatacaataaaaatacaaaatacaaaagtcataccagcagtagtgtatttccagaacctagt

SEQ ID NO: 166259 - DNA, 286 bp, Homo sapiens
tggccaaaagttcctaatccccaaaatgtcacagtttagtaaggtgatacggcgtccataccacccatttatgttttgggcaggacctagaaccataggggtttatagtatgagtggcaaggatagagcattttgtggttatagtgaataagaaatagtttctctatttaaggaatgtctaatcttgtacagcaactaaccataatgtgagatggaatgtatgctctacacaaggcattaacaacttcattttggagttaagaggttgggaaattcactttgggct

SEQ ID NO: 166260 - DNA, 463 bp, Homo sapiens
cggggtcttcccgtccggcctccgggactccgcgtggagcggggcgtgccgggctcgggcggaggatcccgactgctccaggggcgtgtcgcctcttgcgccgagcactggtgaatagcgctgagctccgtagccctctccactctgcttgtcggatgaatccaggaagaaaagtgggtttaggcaccgtctcctttgctatgccctgaataaaactcgggtcaaacaacccaggcaggttgcgcttggcatctcgtagtcgagcgtgggctctgtacctttgagaatgtctcgaagcctgacttccaaactaccgggcgcaggtctgggcgaagggaaaactcagccctgcttcctgaatttcccgacccaaccctggctcggtactagcacgactgcctgggtagggctggaaccttcctgcctctctttgcaaataaacttgttcgaacctgttttttaa

SEQ ID NO: 166261 - DNA, 122 bp, Homo sapiens
ggattggggcaaaaaatgagtaaggagagtttggaatgtcttgtcaaattagaaagcaaggaaaatgttaaagactcctagagttgcatcaaaataacttgaagaagtagatgggacagttt

SEQ ID NO: 166262 - DNA, 322 bp, Homo sapiens
tgcagtgacaaagcaagtggagttatttcgtactaatgttaagtggttaggaacaaacaaaactgagactcttgggccagggtgctgcagcgaggtgcttgtggccttaggttgttggagagcagaggcaagcccgctccaggacctccatgctccgcctcctttctgccttgacccctcaccactgcgatagcaatgagctttccagtaagtactagaaaaactcatctctcttcctttatgggggatggggggtactaagtatggagaaaggtctcaccggctccagccaaccgggagcctgatttccttagtaagatta

SEQ ID NO: 166263 - DNA, 228 bp, Homo sapiens
cacaaacaccctgataagacatttacttctagatatacatccaaattaaatgcacacacatgttcaccaaaacacacatagaagaatgctgacacccatatgaactgtaataacctaaatgtccatcaccagtaaaataaattggtatattttaaaagataattcaacaataaaaatgaacatacatgcaatataaatttcggcatttaaaaaaaacaaccaggcatg

SEQ ID NO: 166264 - DNA, 534 bp, Homo sapiens
attcttgcattgctatggagaaatacctgagagtgggtaatttataaagagaagaggtttaattggctcatggttccgaagcttgtacaggaagcatgatgttagtcatctgttcagcttctaaggaggcctcaggaaacttacaatcatggcagaaggcaaaggggaagcaggctcatcttacatggccagagcaggagaaagagagagagggggaggtgctgcacaccagatctcatgagaattcactcacatacagtaccaagggaagatggtgctaaaccattcatgagaactctgtcctcacgagccaatcacccccaaccatgccccacctctagctttgaggattatatatatattttttgagacagagtttcactgtgtcacccaggctggagttcagtggctcgatcttggcctactgcaacctccgcctggatgagagatcaagatgccatctcaaataaataaaaataaataaataaagttgctttaacagtttataaaaataaaaatcacctacttttcagt

SEQ ID NO: 166265 - DNA, 445 bp, Homo sapiens
ttgcctttgggatttggagtgggacagaggggactgtatcctgtcctgggggcgccaggtgcagagctgaggctgcacacttctcagtccgtcagcccggcaggggtgggctggggatggcagcaaactctggcgctcagggcccctctgatgaggctgccggaccaaatctgaattctaaaagcactgtgcggggtgtctgtgtccaggttcacagaccgggtcgcaaagcctgggtgtgctgagacttcatctgccctgggggtggtgaggatgccaccccagaaggcaggacttgggacctccggccccctgcctgtgcgtgtgaagtggcccaggctggggtcttggtgccgcacacctacaccctgacagtggcagggccctgctggccctgggagtggcggccgacgctcagcaactgtgatgggaatggacgaacaga

SEQ ID NO: 166266 - DNA, 420 bp, Homo sapiens
tcctatcgcagaagagctgaggccagatattgagcagaaaggaggctcaatgagaatgagaacaacttccacttaattgagtcaggttaataattctgaagttctcagaaatgcctttgtctccatcactgtcacagaacagtcactgtcagtgaccaagggggagaacagtgtgtggaatgtccctgagtcccttggctaagtccagcaggaggcagcttggagcacggagaggacagagagctgggggttaagactcaggagtgctcatctcagccctgggatttctaatgagtgtgagcctgacacagcaagcctcattcctctcttctggaggtgaatgcctggggggtgggatcatggcctggagttcccaccagctgcaatcccctatatcccaatgtcccaaggagggatgag

SEQ ID NO: 166267 - DNA, 521 bp, Homo sapiens
cagaaagtttacatttaaatttgtttctatttataactcgttctctttattttaccaagttctaaatataatttctctaatttatttgggtagataagattaataattcaagacttgattctagaaaacataatcaaatttgttaagtaacctgaatgtggattttggtcactcaaatctcttttccttaatgtgtgtcataaatgcataacatgacattattactaacaactgtaaaatactccacacatcataaagttgaatgtacaattcattgaattagtaaaaaatccatgttaatttcataaatgttcctatagacaacacacatttcactatagatgtgcaagtacattatcttatattgtttgcttgctaactaattaaaattattttttctataatattatagaagaggtttatggcaataatcaaccggtctcctaaatctatggtttccttgttatatgttttgtggataaaattgattgaataaatgatatttctcataatcagttaaa

SEQ ID NO: 166268 - DNA, 492 bp, Homo sapiens
tagagttgaactttattctgtagctagggaaaaaccatggaattgtatcttaaaagaagataaaatggtcagatctgtgcctggaaaggatactctagctgttatgtggactggagggagctggaattgaggcagtgagcccagctaccagagtcttgaaatagtttagtgtaagatgctgaatcatgagttggggcagagatctgaccattttatcttcttttaggaatacccagccagtctcaaggtagtgccctgggaaaggagaacacccagtctcagggtagtcctccagactggggtaagagacatagccctgctgaccagatgcatgtggtctgatgatatccttatcaaaaacaagaggacagccacatattgccttatatgtaagtgctggggggaagggaaggctgtgatgataaaggcagtgtagtgtggctgagaggtggggagcactgaatggaggcttcctaaaggaagtgagtgtgg

SEQ ID NO: 166269 - DNA, 402 bp, Homo sapiens
tgtcatcatgatcatggtcatcatctcaccagggaccaaggtgactttgccctagagcagtggttctcagtctgtgccccatccctggcatcaacatcacccaagggtttgttggaaataaaacatcttaggctctatcctattgagtatcaagtttggtaggtctggggtgaggtccaagagtttgcatttctaacaacttcccaggtgatgctgatacgcctggtttgtggaccacgtgagacaacatctccttgcattgcgttccaagtaatatcatctagaacatgcagttgcatacactgttcctcccactccactattatctcttctaatggttagatgatttcttagccagaattcttctgaaatcaaggattcctgtgattaatgcaggaatac

SEQ ID NO: 166270 - DNA, 519 bp, Homo sapiens
tggggaggtgtttgctaaaatgagaagttcattggttactttcatattttatgtgcccccttcatcccaactgcatgcctctgaaagggtgttacaggcactgtgggtaccagtggcagtacctctggtgaggcataaatctagtactgcttaccactgcagaggtatccctaaccaaatgctactgcagtcttgctgggtgtaggttttgtggtcctgttttcccctgaaacatagcagaaaacatcttttaagcttaggttctgagttatcacggtctgtgtttccaccaagggagagtgagtgacgagccacttaggagagatacctatcaaccagataatctagaagaaattctttcagactagatgaataatatctttacctttgcttttgggctgctgttcaacagaggtttaaaaagggtaactgggataatgtcctattttatcccatgtctgaaaaaaaaatctatttcttatcaaggatgtcttttattaaaaataacagtagctacta

SEQ ID NO: 166271 - DNA, 456 bp, Homo sapiens
ctttatgattaaaactctcagcaaaattggcatacaaggggcatacctcaaggtaatagaagccacctatgacagacccacggccaacataatactgaatggggaaaagttgaaatcattccctgtgagaaatcgaacaaggcaaggatgccgtctctcaccactcctctccagcatagtactggaagtcctagcaagagcaatcagacaagagaaggaaataaaggacatccaaatcagtaaagaggaagtcaaactgtcgctgtctgctgataatatgattgtttacctagaaaactctaaagactactccggaaagctccaagaactgataaaagaattcagcaaagttttcagatacaaaattaatgttcataaatcagtaactcttctatacaccaatagcgaccaattggagaatcaaatcaagaactcaacacattttacaatagctgc

SEQ ID NO: 166272 - DNA, 544 bp, Homo sapiens
aggtaggcatgggagcaggagtcatgagtaagttagaaaaccctacctcacactataaacacaaattagctcaaaaggtatcaatgacctaagagtaaaagccaaaaccaaaaacccttggaagaaaactaggagtaaatcttcatgacctcagattttgcaatgctttcttaggtatgacatcaaaagcatgagcaacaagagaaaaaagagataaattggacttcatcaaatgtaaaacttatgtgcgtcaaaaggtattatcaagaaagtgaaaatacaatccacagatattgcaaatcgtatctctggagagaatttaatatccagaatatataaagaacttttattttacaactggacaacaaaaagacaacttacctgaaataaaactggaattaaatagacatttctccaaagaagacatacaaatggccaaaaagcacatggaaagatgctcaacattattaatcactggaaaaatgcaaggcaaactaccatgagataccatgcactaggatggctatcatatgaaaaattaatt

SEQ ID NO: 166273 - DNA, 326 bp, Homo sapiens
cacagctcattgttttctggtgggctccttggttgaaaccatattctcaaagaaactccgttttgtgacagggcccccatcagtaggctcagccacatgacaggccgaggagcagccagcacaactgccggcaatgcttgccaataagccagatgctgccacatattggcatctgggtcctggaatagcaaccatgttctcagtctggctagggattctgaccctagctacggaaggagacaaatacaaattcttcatgaaagcaacgcaacttgaacagatgaaggaagattattcacacattatggaaacgaaagaaagaacaa

SEQ ID NO: 166274 - DNA, 324 bp, Homo sapiens
aggagggcagaccgtgttccatgaagcacaaagaaagtcccccaagtaatgccactgcagaaaccgagcctatcccacagaaattgcaaatgcctccttgctctgaatgtgaggtgaaaaaagccccagaaaaaccattgaccagctttgaagggatggcagctagagaagaaaaaatactgtaaatactaagaaactgtgttaaaaacatccatttgctattgtcttcatattctttttagaccacaagcttgatggaaatactgtttctaaagcatgcaactttttcacaattttatgtaactttataaagtagcctacatg

SEQ ID NO: 166275 - DNA, 328 bp, Homo sapiens
aaacttgcaccccgctgccgcagcttcaacggagaaatcccttgccccaagcacacgtcagccctgcccgcggagtcatggcacagcaaaagagaggctctccatggagatatgctccagaagggtgggtggctgtgcctaaaggtttgttagaaaaggacagtcagtgaggcttgctggctgtggcgccttacgacgctctccccgacccctcgtcattcagaaggttccgcaggtctcgacagcggtgcgcttgtcagccccatccggcggccagcctcccttgccggatcgcccacgttgtcggcctggtccgagttcttcattt

SEQ ID NO: 166276 - DNA, 604 bp, Homo sapiens
cgatatcaaaatccttcttcgccactatgcaactgtgctttcgtgtattcatatccaggacatcataaactatcaatacagacgatgtattaaataaatatacaacttggccatcaggctactatttatcattctaacaggatgggggcaaaagcagattccttagcctgcttttctgatgagagatcgcgggggagccaaaggcagtttgcaaaagaggaccagtctctgcgcaggagttttggtggtaaacatgtgagggtatccagagagtgatggaaatggtggataatctatttattttgaaataccaaatggtactaatataaaaacttgttcaacctactttggcaacattaaatatgaagggaatgtaccttcttcccctcctccaaaagtatttacttcaaaaatcgatttcctctgtcactggttattgctgcattttgctcagtggttctgagaaaccgcatggaaaatcacaatgttacactcgttaaattgaccctgcagggctctaccaccagtacatgcatcatcccaagaggtaaaaaggcaaggctgccaggctcatgctgagaatatcatcatgaaatcaacgagg

SEQ ID NO: 166277 - DNA, 192 bp, Homo sapiens
catgttgcagataggcttcaagggggacagggactccaggtttccaaccaccgaactgtgcctcaagtagcaagtgtatgagacccagttatggtggtggttgggttttcctcactgtggagtggagtcagtgaccactttttagctctgtgaccttgggcaagttacccagcttctctttttttttctctg

SEQ ID NO: 166278 - DNA, 304 bp, Homo sapiens
attgggtgtgttgtgtgaaaaaaagtgatgttgcaaggtctctgtcagcagcattaagagtcactggcacaattaccccacaaacggagggctgggagtgctgcacagttccctaggcagctgtgattttcaacccagtctgacatattattatagaccacacattgtttttttgacattaattcatttgtgatctttactgccacgctgagtatcttatctcgaggtggtccttaatggtgcatggtatattttattgatgtttcttttattctggtgtttttcttcctcatgattatgtctg

SEQ ID NO: 166279 - DNA, 491 bp, Homo sapiens
gttagaaaaacatggagtcagttaggtttggtgtgtaggttctggtctacttttgtagtctgtagttccaaagacaattgagttttgtaagcccctgtgatggtaatatgtgtctgcttcattcttctagctctgctggagctcccactggatagcttctggtgccacacagcggggtggaaggcacatcctcaggctgcacagtatgattaggccagtgggtaggggactgccagacctgaggggtgaataagagcatttcccgtggcttgttctacagtcacctcactggtaagcttctcactctatctctgctgggccactgttgtgggcagactaggcctgctactgccactgggtaaaatgtctcattggcaagtccctcctgggcttcccttttcctgatcctttggccagagaggacagggttttctgttttttgtttttgttgctgtttatgcctgttggcaatttcaagttgtactccactc

SEQ ID NO: 166280 - DNA, 376 bp, Homo sapiens
gttagaaaaacatggagtcagttaggtttggtgtgtaggttctggtctacttttgtagtctgtagttccaaagacaattgagttttgtaagcccctgtgatggtaatatgtgtctgcttcattcttctagctctgctggagctcccactggatagcttctggtgccacacagcggggtggaaggcacatcctcaggctgcacagtatgattaggccagtgggtaggggactgccagacctgaggggtgaataagagcatttcccgtggcttgttctacagtcacctcactggtaagcttcccattgtaaatgacgggcagtactgtggtaggccgatttgtcatgccatctgggctaactggagcacaatgtactt

SEQ ID NO: 166281 - DNA, 162 bp, Homo sapiens
tggaggagcaaaagacctcaagccgggtggcttaagccgcagaggtgggtttcttccggttgggaggctggacgtccatgatccgtgaaccggcagggctgagctggtttctcccaaggcctctccctggcttgcaggcagtgctctttttctctgtgcggg

SEQ ID NO: 166282 - DNA, 322 bp, Homo sapiens
gtggatggatgaatggatggatggatgaattgataaatggacagatggatgaatagatagatggatttataaaaaattggatgattggatggatagatgatggacaaataggtgaatgatggatgggtcaattaatggatggatggaggatggatggatggatggatggatagatgtataaataagtagacgaggggacagatggatggatgaatggatggatggatggatgaatggatgaactgaatggatgggtggatgaataggtagatagatgtataaataaatggatgattggatggatagatgacggacaaatagg

SEQ ID NO: 166283 - DNA, 532 bp, Homo sapiens
agcgatcctcccacctcagcctcttgagcagctgtgatgacaggtgtgtgccaccgcacctggccacaagatagcatttctcaatggaatgatgttcacagcagagtctgtttcagacacaaaattatctccttgaaaaacaaattgtgtaattgaatttcttgttcatttaaaataagctgtatttttatcctctcccaaatcattttaaggatatatagccgataaaagaaatctggtcttcataaattccatggattctcagtgtccgacagacttccaagtctagcccagcttcaaaaccaccacgtgaacctgagcacggctcatcatgatcctggacccttcttggctgatctaagtaattagactcattgcaatccttaaaacagcttattattcgcaagcaaataaatagtcatttgaccttaataggcatgttttttacatttgacataaaaatgtgaaagttggatcagggtgttatgaaaaaattactgaggcactgaggttgtgaaaatgtagagacact

SEQ ID NO: 166284 - DNA, 332 bp, Homo sapiens
tattatggcatcatttctttctgttttcatttacatttaatatactcaaaatcgtgttttacttgtatactttataccctactttaaaaaaatttaaatacaagctttgtattatcaacatgctttgaaagagcaatttataatagctgcttataatttaccaaaccgttcttctattgttggacatttacgttgttcacaaattttgcatattataaataactaaagctaggaaaacattttacacgtgtggtttttattctggaaattggatcttttctgaagccaagttctgcgtaatattttgactgagtactagaatgccttctaag

SEQ ID NO: 166285 - DNA, 158 bp, Homo sapiens
gcagggaacgccaagctcacggcgggctttggcagggcgcgccccgtgtcctggaggactgtgtcctggtcatctttctaggcccccactgcatgcccttgaggactaggaagggtgcctccttctctgcatcaggctgactcctagcagctgccgta

SEQ ID NO: 166286 - DNA, 240 bp, Homo sapiens
ctcgtgctgtttggaagcaaattccagacatcattaagtaggtcactatctccaaaagataaggactacatttaaaaacaagcacatgaccattatcactccaaggagaaatgaattacattttcttaatatggtcagttagtgttcagatttccaatagcctgaaatgtcatagtttttaaaataggttgaatcatgattcaaataacatccatatgttggaattggtgggtaggtcgt

SEQ ID NO: 166287 - DNA, 277 bp, Homo sapiens
tatttccaaatgaggtcacattcacaggtaccagaagttatgaattgaacacatcttttttgggatgtgttctacccattataattcattctacccactataatcacaagtggctttgacattcagtgacacaaagatgataaggactcggttcctgacctcaggacattctcagtctatcagtgaagacaaacacatgctggtgaacacacacacatacacaagcacacatataccccgagcctcattcaagtcagactgtgattaaaaatggaaa

SEQ ID NO: 166288 - DNA, 287 bp, Homo sapiens
tatttagcattcctcccaacagtgtatgagcattttagttgtaccaaatccttatcagcacttggaattgttaattttcttaactttagtcattctagtgggtgttcagtggtatctcattttaatttgcatttccctgatgagtagtgatgttaagcatcttttcactgttaccaattatttggataagtttttaatgaagtgccaattcaaatcatttgttcatatttaaaaatatggtcttcagcctgatggccttcaaacttcaattgtagcattggatttta

SEQ ID NO: 166289 - DNA, 398 bp, Homo sapiens
actgtttccctgagttctatgagcctctccagcaaattaatcaaactcaaagagggagttgtggaaaccctacttaaagcccattgggtagaagttccgaaggcctggactttggtttggttgggggcggagttgggggaagtcttggggacagagccctcatcctgtaggatctgatgctatctccaggtagatggtgttgcagttgaatcagaggatgccccgctgcttggtatgtgaggaaaaactttcatacatttgaactcaaaagtcttcttctgggccaggcatggtggctcacacctgtaatcctagcactctggaaggctgagatgggaggatcacttgaggtcaggagttcgagaccagcctggccaacatggcgaaacctcttctct

SEQ ID NO: 166290 - DNA, 542 bp, Homo sapiens
ctacaaaaggcaagaaaatgtcattttgcaaaaagatatcttatgtaatagaacaaaagtatatatgtttcctacaaataaatctaacaaaagataaagttcaaatttttactcagccatggaaaagaatgaaatcctttcatttgcagcaatatggatggaactgctggaggacattatgttaagtgaaataagccaagcttagaaagacacgtattatgtgttctcattcatatgtgggagctaaaataaattgatctcacggaggtagagaatagaatggtggttatcagaggcttggaagggtagtgaggagagaaggataaaaaggggttggttagtgggtacaaaagtacagttacatagaatgaataagatctaatgtttgatagcacaatagagtgactataacaatgatttgttgtatatttcaaaatagctagaagagaagacgtagaatgtttccaacagaagaaatgataaatgtttgaagtgatggatgtttcagttactcaaattttatcattatacattatatgcta

SEQ ID NO: 166291 - DNA, 195 bp, Homo sapiens
ggagaggtccctaaaaatgacttactctaagacctgaatggcgaggagctgcctatgcacaaatctgggtaaagacacttccaggcaaaaggatcagcaagtaaaagtccctgaggtgggaacaggcctgaaatatttaggaacaacatgaagggtaatgaagagtgggacaaggagaatgatgtagaaggagac

SEQ ID NO: 166292 - DNA, 878 bp, Homo sapiens
tacctgaacgtactgtgcactatggtagcagtatgccccaaacaccacaggttgaagcagggagtcaccattctaactggggagtcgagaaaggctatatacagaaagtggtccttgagcttgatcttgaggccttatataggtgttgttgaggcaaaaatagaagaggaaaaggcatttcagaaagaaaaaactgtgtaatcaaagccgagatctatcagaagacactattcagaatcaagaaacatcaggtttggggacaacgagattcagagatgtgagggcaggagtcaaaaatgaggcatggtccagactgcgctggcataggtgtaaccttcagaagccaagccttcatcagtgtgcacaggtgatgggaaacagattttcagccaggtgagctttgctacacaaacgtgtggaattgtagcaggctgtttctccctaacaatcacacagatgggcctgcatgacagtcacacagacaggcctgcacagcactccagttacacagacaaatttccacagcactgccttaacactgagcaaataattaaacctagggaaatcggtgcccagacatcaaagctagaaatataaacatatggtcagtaggagacgtgcataggcttctccctatcctggagcaagtcaaaataacggagacagtctcacattcctagtgccaggacctgtcttgggttgtcgaaatctgagacagtcaaggtaacagaggcagttgtttgaatagatttattggaaagtctaagcagctcttcagaccaagctgtacatgagataagataggaataatcactccggatgggcacggtggctcatgcctgtaatcccagcactttgggagactgaggtgggcaggt

SEQ ID NO: 166293 - DNA, 474 bp, Homo sapiens
tcattagccccagattctgcaattgcgaatttacctacttgctaaaattgacctgtagccccaaaatcaatactcacagtgcaccaccagtcattccaccacacaaagcacatgaatgtccatgaatgatcaccatggcagggaaaattttccttgcaaatcacaaaataattaatgtaaccagttgattcctgatggatgattttcctattttataccttttagctacaaaatataactgataaatgttagctctctctcaaagacattaaaccaggccaggcgcagtggctcgtgtctgtaatcccagaactttgggaggctgaggtaggcagatcatgaggtcagaagttcgataccagcctggccaacatggtgaaaccccgtctctactaaaaatacaaaaattagctgggcgtggtggcgcacacctgtaatcccagctacttaggaggctgaggcaggagaatcact

SEQ ID NO: 166294 - DNA, 711 bp, Homo sapiens
caggaggctgaggtgggaggattgcatgacccccggaggtcgaagctgcagtgagccattgatccaaccactacattccagccagggtgacagagtgagaccttgtctgaaaacaaacaaacaaaaagattaatgcagtacatgtccttttggtgaataagtaaatatgttttggtaactttagctttgcattataatctagtcgtcagcagattgactaagggcagataaaacaagatgatttggttttgtggtttggcacttactgtctgatttatgcccccaagaactcttgcaggccaaggtcgagtgtatctgatacctgctctggctcttctcacgaactgatttagtagctttgggccagcattagattttttaaactctttgacctatttgtacatgacaggcatttaatctttccagtagttacttgtcaaatagaaaagcatcacttcttagtttggacatttgcaaatatgactgagcagagctgacagatgaggtgggcatcttcaggccatagggtacttctggcctcctgtaacctagaaaattgggatgcctcagatatcaggtattcttccaagcagctagggttagtccctgacctcagaaaccctgagagccctcagaaaccctgagaaatccacctgggaatggtgtatttgttttggatgagattacctttactttccattctccaggtct

SEQ ID NO: 166295 - DNA, 400 bp, Homo sapiens
gaaaaatttaaggatcactgctactattcctttttcttccttcccactgctactattcttaatgacaaatggttctgatgagaaatcaagtttaaaaagatgaccaagtgtccagataaggagtaaatttcatttcctaccataaggagattttataaagaataacaaaactggctgggtgcggtggctcacgcctataatcccagttgggaggctgaggcgggtggatcacctggggtcaggagttcgagaccagcctggccaacatggtgaaatcctgtctcgactgaaaataccaaaaattagctgggcgtagtaagcccagcgactcaggaggctgagacaggagaatcccttgaacccaggtggtggaggttgcagtgagccaagattgcgtcat

SEQ ID NO: 166296 - DNA, 412 bp, Homo sapiens
agcctcccgagtagctgggattacaggcatgtcccatcatgcccagctaacctggcttatttctatatattatttttttctaagaataaacaaatgaacaaaaacagttaatatcattggaataacatgcaggtcctaaaataagaagtatgtaagatgtgtttattgaaatatatatatggtatactggaaaaaaaaccccacaaaatattacacaaatactggttacagcttacagtagccagcctccaagatgccccccagtgatgctcacctcctaatattcatgcctttgtgtagtccccttttacagttcgtcagggttggtctgtatgagcattagaatatagggatatgatagtgtatgacttccaaaacaaagtcataaaagacattactgcttctgccctgc

SEQ ID NO: 166297 - DNA, 1086 bp, Homo sapiens
cttgggtagttcagggtaatcttagagtcatgagagatatgatataaaggaataactagctaaaccagaaaaaatgcctgggtaatgactagcaaataggtggtcaacagatgtcctcattagattgaaaggtccatgaaagcagggactatttcttttctttactgcttaaaaaggttagaactggacctggcaacatatgatgagctaaataaatacatatttgtgaattgggttaacacatattgcataaagtggttttggctctgttttattcttcataagccctagtgatctttttaatttctgtaaaatgtggtcttgacccccccaacccaagtgacctccttatttgctaggctctgatatttctgttaggtttctactgtattttctgagatagcaattagtagatactatttctcctttgatggagctagccatatattcttgtttgttcattttagctttcaaatttctgtctgattcttgttcttttactctggaatgtagtgaatggaatgacttggaaggtacaaggtaggtcagtttaggttgtctagggccttgcatttaaaagtttaatttgatgacatggtggattacaagaatgtaacagtatcaaaatgatactatcttcttgtggtggtatgtagacttaaaaagagaaactgcagagaaaagggtcccttaggatgtagagcagcagttgatatgtgagaagttgatgccttgcattagggattaggagtagatgtggaaggaagagatcaggtttgaaagagtttaaacaaagaatctctaggatttgataacactggatatcagaggggaaggtacaagagagagggcagaatcaaaggccactcagaggttaaaggaatcataccggtttggcatggtggctcacgcctgtcatcccagcactttgggaggctgaggcgggcagatcacgaggtcaggagttcgagaccagcctagccaatatggcgaaaccccgtctctactaaaaatacaaaaattagctgggcgtggtggcgtgtacctgtaggcccagctactcaggagactgaggcagaagaatca

SEQ ID NO: 166298 - DNA, 302 bp, Homo sapiens
caaaaaatgacagaatagatttagagagaggcaaatagaaattcggaaaaaacaaaacaaaacaaaattaagagctcaatggaagagtttaacaggagagcagtcacaactgaaaagagaactagtaaaatggcagatgaggaagaagaaaaaaattcagaatatataacaaggagaaaaaataatatttaatacacaaacacaaaaatataacaaatagagtgagaaagtctattttatttttagttagaggctcaaaagtagaagagagagaaaatagaggcaataactgaagagataat

SEQ ID NO: 166299 - DNA, 483 bp, Homo sapiens
ctcggtacccagttcgacggagactctcttctggacagggaaaccagaagagagactccaagaagaggacgggaaagaagggtggatgtttctcttttgctgatggaagggctgtacggcttgaaataatactggatttcttttctctttccctggctcactgctcactccttcaggagccacttaagaggcgacccagaagaaaatgtggaattggaatttctggttggaaaaacagttttatttaactcaggcagttgattttgagtttgcaaagcttgcttacctagacttccaatccacttctccaaacctccttacgttagacggcgagacccagaaagcaaaaggagagcagtttgcagtgaacagatgggtgggtgtttcaaagttgcttgaaccgagttctaaaaccactctgtggatctctgagaaggactcaagaattggtcttcagcctttcatgaaatgagccttgaaatg

SEQ ID NO: 166300 - DNA, 149 bp, Homo sapiens
aaatgcttattgatatactcaaacactaactgcataatctgaccttgggacattgaccttaatgtttctgtgcatgtggctttcaaagcaattacatttatatcctgaagaaattgtatgtaatgactaagctccacacattcatgtgt

SEQ ID NO: 166301 - DNA, 390 bp, Homo sapiens
ttgtacgctatccggttcaatgtcatgaagacagagaaaggctgaaaaaattttcaggtaaaaggagactaaatacacaagactcacatgcaatgcttaataccagactagatcctgaaatagattttttaaaaagaaaaaagctgtcataggctgggtgcagtggctcatgcttataatcccagcactttgggaggccaaggcaggcagatcacctgaggtcaggagctcgagaccagcctgatcaacatggtgacatcccgtctctactaaaaatacaaaattagtcaggcatggtggcggatatgcctataatcccagctactcaagaggccgaggcaggagaattgattgaaccggatagcttgccgggatcctgctagagtcacc

SEQ ID NO: 166302 - DNA, 480 bp, Homo sapiens
gtcagggagggaacaaaggaccccgcctccctgctctgaagcaagaacctgattctcttttccgcccttggggccccaggacccttctcttggccaccagggctggcttcctccaagcctcatctacttgggaggggtggggcgggatgggtgagacaggacaaccagccgggaacacgggagcctcgcagaccatcgcctccctctggggcctagtccctccacaggctgggccgggaaggtctggtgtgggacctcttgggaacctgggccccacggtggcgtgcatccctgggggttgctcccatgccagccaggtgacgctgacaggatgggtccctttaccccagacttgggtgctgagggccggagctccatgctggagcccgcctgctcgctacagccaggcccgagccacagcgcgcccgggcgggacgcggggcccctgccgtggggcagaagtgcgggcagttgcgggga

SEQ ID NO: 166303 - DNA, 123 bp, Homo sapiens
attatttacatgctaacctgacttagtacagacacactatattggatggcccagaggttaacctctatttaaatacagttgagttctcccaccaaagttttgggttacataaaccttgttgct

SEQ ID NO: 166304 - DNA, 755 bp, Homo sapiens
atattgtgttattcagggtggaatggcccaggaattgtaaaatacagtatactgatgccggtctgttcagttctggtagaatatactgttttggatcagtgtggttcctttaaggaaatggacatccctactctgcagtgatcaccaactgaaggaaacgtatctcaagctctgagggaggcctttgaaggcaccctgcattggcttgagtttagacagtagcactcctgctcccacctcccaccctgaaactgtggaaacacagcatggcaaaagctctcttccaagaaaatcttctgtctcctcctcaattctctgcattttcatagtcctgcagtgactgaggggctttaaggggtgctaagcacgttcacagccatttcctttgttagattctgcatcggatgatctggaacctcagtggaatttcactcctttcatgtgtggaaacctctcaagacttcacttttatcccttcatgagcgtctgggtcatcctaactcacgtaggcttgcatacccccacttcactctaattcacatctttgattatttccttcggaaaatttaccataacctgcagttatcttgtttatttgatgactttatcatctgttttcccctctagaatattaactttatgaaggcacagttcccgtttgtctcattcgctgttgtatcccagggctagcacagcccctgggatgtggtagatgccccacaatatttgttaacagaatgaatgaattcactaat

SEQ ID NO: 166305 - DNA, 421 bp, Homo sapiens
ttatttggttgcacatgttttgatgtcatatctaatgattcactgctaaatttaaggtcataaagatacaccactatgtcttcttctaagaattttctggttttagcttttatagaaatagatcattgatctattttgagccattttgtatgtggtgtaacatagaggtccagatttatttttttgcatatgaatatccagttatcctagcactattcttttgcatgtggatgtcctagactattctttctccagtaaatagtcttggcattcttactgaaaattaattgaccatagatgtatgggttatttttgaactttcaattctattctattagtctagatgtctatcctcatgagagtgctaccctcttttgattactgtagatttctagtaggttttgaaatcgagaagtattgg

SEQ ID NO: 166306 - DNA, 467 bp, Homo sapiens
ttttttccatcatcacttacaccccacctgtcactgagctaaggcagattctacttccactttagaaggtgattttccccctttttcctttgcaactgtccctgccttcattcagaaccatcacttctcacctactaattacaacagtttcatagattgtctagttgtcaacagcactgttcccacatttaatcccttctgaagttgctgccagattcacctttctaaaaatgcaaatctaatcatataagtttcctactcaaaatctttccttgttccctgatagctttcaggataatatgaagctccttatcctagcacaaaaggccattcctattctagccccttcctatccctctgggctcacttcctgtcactcctccccttcctccactatacagagggtgtagtcttcctacttccaagatctatgctcagcctgggcaacatgataaaaccaaaaaaaa

SEQ ID NO: 166307 - DNA, 343 bp, Homo sapiens
gtcctaatcacgtaacctattcccccgagcaatctcaattacaatgatatacagcatcaaacaaggtcaagcagtaactaggactaatcaacgcccatgatcatacaaagccccgggaacaataggatacagtagggagatctccctactgtatgcctagcatcagaagtagtcagtaaatatttattgaattaatcaatacttttagttataataccaaagcagggattagaaaatttactcatgtctctagttagatttttttcctaccatattcattctaatttttgtatataggtaaaataaatcagtaaataaaatatagcatataaataaatacata

SEQ ID NO: 166308 - DNA, 499 bp, Homo sapiens
gttatgtgttgctaaatgcatggctctttgaaggtatttccagatggttgtgggaaaccttgccagattggaatgcgtaagagaaggtaggaaaggtctcaggaagaacagagagactgcttaggacatgcttggttgaaggaattatttgtgagttttggctgacatggtttttctgtacaggattcaacggccataggagaatcaagcttttgtactccctaaccctcaatccctttaatccttctctatgtcatctgatgctagcagcaaaggtcacctgtctgtctgattaggttacaaaccagagactgggtatttgaagcccaaacttcttggatcttgtaggtttttgggaaaggtgctggttaattgacctcaggccagtggtgcagcctggaggccccaaaccctagagcttggtaaactatttccattattttaaaaagcctattagaagttttgctttacctaggatatgtgtggatacaggctaatg

SEQ ID NO: 166309 - DNA, 420 bp, Homo sapiens
gaaaaccaggtccctaacaccgaagagttaaaagaaataagtaaatttggcaaattggtctttttgtgagttagcttataggcaactgatcgagggtctctttcccgtcttcaccctgcaattgtggctcagggcaagctgccagctccctcctgccaatgcaggagcaatagagcttggcctcctcttgcagggcgagtttgggagtcagatatgaagccactaatccgggacctttttgggacccaaggcactcatctgccccaagcataccaggcaggccaggtgcaatgactcatgtctgtaatcctagcactttgtttttgcgacggagtctcgctctgtccacccaggctggagtgcagtggcagaatcttgactcactgcaacctccacctcccaggttcaagcaattcctgc

SEQ ID NO: 166310 - DNA, 189 bp, Homo sapiens
taaagaatatttaggaatagcaaaatcaaatttatactgatttctttatggcccatagaagtcatgagtcttttactaccattaaataaatgtggcttcagagccagagatgatcctttctttatcacacgcacacacacacacactctctctctcacacacatagtttatgtaaatacttactcctgt

SEQ ID NO: 166311 - DNA, 308 bp, Homo sapiens
ggcaggatctgagcttctctcacaggccagagcagggagaagggcttctggggggttgcagggagtccatattctagtcccacctaaaagcagtgcctgcctccttaattctgcaccgggtcacagatccctgcctgcttctcccgcctttcacacaaatgctcttagattaaatctgtgggaagggggtgggagggaaacaggcccctctctgatacaggccctaagtttcaaattcccctcttactgggcagatggagttcctagaaaagttttgggatagttttccaaaggaaatgtgcagaatg

SEQ ID NO: 166312 - DNA, 665 bp, Homo sapiens
acataaacataaattctactggagctcctaaattatttaggaaaagttctccaatcccataacactcccaaggccctttcggttcagtccattttccttttttcgcctcttcaaaccacctttctgcttcccttattctcaattccacttaaaaacccttgacccagcactattcatcggccccttccagtacaatgcagtttgcctgtagaagcttccagaacatttcctctccaatgtcccgcattttaggcctcccttagccctcatgggcttagccagttgcttggcctcctccacctgtctcccttcagctccctgctcctccttccttgctagagcaatgcagtcatcccccagcccacctttcagcactaattacaccgcccattggcttctgagatgaggcagccttagacaacgcatgggcttttcttccatcttgatccaaactccatgaagatgctcaggggtgttcctgctgcttccatgtgtcacctgcattcgcagtggacgtggctagaatggaggtgtggtttctccacaagcccctcttctcccgtgttttccatcttagtcaacagcgctaataccttcccacccctttgcttaggtaaaactctagcaggtgccttggacacttctctctcccaggtctttgagaa

SEQ ID NO: 166313 - DNA, 291 bp, Homo sapiens
cttacacagagatgtcccttacaaaatgttagttgaatgaatgagatgcataagaaaagtttagtaaatattcctgctaggactgacattttatttataagaatgggggaaaaataggatattatctaacaataatttaaaaatcaacagagattttgaaaataacttttagttcatcttcattgtccgccttcctgagagcatcatattgcttaaaaagtcatctacaatttcccagtttttcttttctttttctctctctgtctctgtctctctctttctttttttttt

SEQ ID NO: 166314 - DNA, 223 bp, Homo sapiens
gcgtaaacttgtgctcaccatgacagggataggtttcatgactctcaattttggaagaatagaataaccctgctggccccaggagcttattaggaaagattgaggaagcaagatggtcaaggtctcaggcagctggacaccagttaatgcccccaccctcctgagtgtagtcactggatcagctccctttcaaaatagcacaaaagggcaaactcatggattc

SEQ ID NO: 166315 - DNA, 234 bp, Homo sapiens
tgtaagtattatgctttctatactaagttgtatattctccccaacacaagctttaacatttcaaaatatattcaaatcaatgtcaaaacaaacctgttatcaacttctgttgttgacagtacaccggattaagataccctaacagaaataactaacaaactgagaaacaacaacaacaacagaaaagttcttaaaataattcaccgggttgtccaaaaagcaagaaggcataac

SEQ ID NO: 166316 - DNA, 479 bp, Homo sapiens
aggccagcactggggtggggctgcggtggaacaggcccaggcagaagaggggacagggcctgtgtcacaagggcagctgggagctgggagcagaggaatggctggtctgactcggggtccagcaggaccacctgactgttgaatggagacaggcccagggccagagtagaggccgtggcaggaatccaggcagatctgctggtgtctcaggtgagagggcagcagcagagggtgagggttcaaggcagccagctggggactcgtggcacaggcagacaacagggagcgcactgtgggatgtgggggcaatggtgacggctcccgggttttcagtctaagtggctgaaggtcgacattcctatcaattgagatggggagaagcaagtggaacaattttgggggacaatcacgagctgaattttagactttaagaggtttttccatctctgagcctttgtttccttttctgtagaaagggg

SEQ ID NO: 166317 - DNA, 506 bp, Homo sapiens
accattagtgttatcttaagttgatcctgtaatagtcaactactattcttgcttttgaattccattagatcatgagctctgtgaaggcagatgttgttatcacctgttgcacagtaggtaatcaacaaatgtttgctgaatgaatgaagaaaataatcttactttagctttatcactgtcaatttagtttgttgtggattgtttggttaatcctataaaaataaaaatatgggccaggcgcattggctcatgcctgtaatcccagcaatttgggaggcagaggtgggtggaccacgaggtcaggagttcgccagcctgaccaacatggtgaaaccccgtctctactaaaaatacaaaaattagctgggcgtggtggtgcgtgcctgtagttccagctacttgggaggctgaggcaggagaatcgcttgaaccaggcagtcggaacttgtagtgagccaagatcacgccactgcactccagctggagtgacagagccaaactccgtc

SEQ ID NO: 166318 - DNA, 272 bp, Homo sapiens
aaagatgagggtctcatcatgttgcccaggctggtctcgaactcctgcattcaagcaatcttcctgtctcagtctcccaaagttttgagattacaggcgttgagccaccgtgctcagcccctttttaaaaattaagacaaaagcaccacgacacagtgcaccacgacacagtgcaccacgacacagtgcaccactgacacagtgcaccacgacacagtgcaccacgacacagtgcaccacgacacagtgcaccacgacacagtgcaccacga

SEQ ID NO: 166319 - DNA, 161 bp, Homo sapiens
ggagttaaggttgcggtgagttatgatcgtgtcattgtactccaacctttaccctatctccaaaaaaaaaaaaaaaaaaaaaggcttaaagaaaaggaagtagggcctttagtttgtggcctttacctggacaaacaattaattctatttccccaagttat

SEQ ID NO: 166320 - DNA, 524 bp, Homo sapiens
gggtaggggctgtttgtgatctttttcatttaccccagcttttgcgttcagtagatttcagaattttaaaaatgtgtgctctttaattgtattaatattttgaagtaagagtacagtatgtggggaggaaatatgagggagatgcagtgggtcagtgttggcagaccactcacactagactcctgatgactatagccgcctctctccctgaacctgaaatttacccctcccagactaccatttgaggaagagagctagtccattatgagagactcaggaccaaggcgaggaattggaacactgtaaaccccgcaagaggggagtgggccttgcagagagttccagaatagtgcctgatcagcagtgtctcaggatcatcaaagatcctggcttcaggagctggaatgttacttgctgtgcttcttggaaaaagagtcacaatgtgtgacatttctgacctcaaggattcagttttggtggtcattttaaatatgtaaaattgtgagcactgtagttaccaacac

SEQ ID NO: 166321 - DNA, 393 bp, Homo sapiens
ggaatgatgtgcagaatggagattcagaaccctaacagactctggtattgatatctagtgctcatatttctgggagtctgctagggttatgggagtttgcatttaaattgtaggttgttgcagaaaacagaatttatatgtggaaaattgtaacgaatccactaaaaaactattagaactaataatcaagtttggcaaggttgtaagacataagtcagtatacaaaaatcaactgtatttctatacactaataatgtcctagctaagagccaaatcaagaatgcaatcccattcacaaaatgggatacaataccaaggaatacagctaaccagggaggcaaaagagctctacaatgagaacgacaaaacaatgctgaacaaattgtcgagata

SEQ ID NO: 166322 - DNA, 204 bp, Homo sapiens
caaaggacagaatgggaaagattaagagagagaaaaggaagtgtggaggagtacaagcagaaataacagcctgggcacagtggctcatgcctgtaatcccagcactttgggaggctgaggtgaaaagatcattgaggccaggagtttgagaccagcctgggtaacaaagcaagaccttgtctctaccaaaaagtcaaaaaaaaa

SEQ ID NO: 166323 - DNA, 148 bp, Homo sapiens
ttaaaactctaaacatcttaaaaatactaaattacacattcttttaatcacctccttgtagctgtctccagattaaaaaaactgacaatatctggtgctcaattcccaacatcatgaacggtatgaccctaaaatgagtttagtttag

SEQ ID NO: 166324 - DNA, 334 bp, Homo sapiens
caactcaaccccagcaggacgctggaggggcctccctcgcccgcctgtcttcgccggcgctggtctcccgcacccgggtctgcagtccctccgccatctcgcaggtgtgcagccgctaggcctgggggatccgaatgactggggctggataggaatgccttcgtgtttcccaagacccccgggcctgctccacaaagtttgaagggtgggtacaccccgacccaggcaagttgctcccccaaacccatgactgactaatctgatatgacaaaagcccatgatggatttggtatatgttaattcacaatgccctttcctccagaatttaactata

SEQ ID NO: 166325 - DNA, 199 bp, Homo sapiens
aaagatatccccatcctgcttcccagaacctgtgactatgttacatgacaaaggggaattaaggtcactaattatggtgacctttaaataggattatctgggtgggcccaatataatcataagcatctgtaaaagataagactgtagatgaatggcacagaagggaggtgatcttctgcacaaggtgatgttctgcaca

SEQ ID NO: 166326 - DNA, 378 bp, Homo sapiens
acaatccaacacggaagtaacacaggctgtcctttgggctcccccgcctgatccgctgaacagaatctcagttctgtttgacttacacggtcggtggcagagggaggagggagaaactcttccatctttattcccaaatggggatctcattttgggtgcatgtatgcaaaatctgttctgtctcctcatgcttagtgtgctagtatatatttactgctgactgcatttctttatgaggactcttctgtagcgttttgatactgacaattttatgaaggctatttcttgatatttgtttattactcctttaaaaatgtatttttgtggcagcttcaaggcagttgcaagatagtgtatttttcaatagagaagttggat

SEQ ID NO: 166327 - DNA, 195 bp, Homo sapiens
acggggcgtagacttgggtggggtgtgagttcagacccagcggggtgactctggagaaggtaccctggcctccatctatcggggcgacagcaggatgtctgcttgttgcagggcaaccggagctctgggagaagggctggcatgggtgtggctggtattcaacacaggactctgggagaagggctggcatgggtg

SEQ ID NO: 166328 - DNA, 723 bp, Homo sapiens
tgaactctctgctctattaagtgcctgtaaagcccgtaatggctgtaagcacatgaacccagctgaggatttgcttagttctgctttgctctgctgcagcaagtccttctggagacctgtgggaacatatggagctacctgagcaggagctgatattttaacagaaatataccatatctggtttggttcttttcttctttcaatctaatttggaataataggggccaagaactgtccaaactatttctgttcttgacttacgtatatgatacttagaagcagaaagactgttaacaccaatgtgacattatcaagggggattctatttgcattctttataaatgttaactatatatggaggcaggaacgggcagtgaatgaagttagcttaaaacatatttgacatttaaatgccaaattcatctccccctttccgaaccagcttgttttagtgaaatatttttacctttaaaaaatgggtgagggaggattaatttattaagtgagaaagtcataagacattcagtatacatctcccaaaatctgtaaatttctgtgctcacatctatgaagcaaattattctgaatatgctttagaatctctcagttgtggcataaaaaagggctctaccttattattagagaaagaaaaagaaaagaaaattccaaatttaagggtgaggtgaaggagaagggcttaattattatatctccctcaagaag

SEQ ID NO: 166329 - DNA, 610 bp, Homo sapiens
acctgggcgataggctgagcactttggaacaacatttaagggcaatgtgagcacaatgcataatgtccttaaaaagcatgttgtgatgtacacattctgtaattaccttttttgttgttttgtagcaaccatttgtaaaacattccaaataattccacagtcctgaagcagcaatcgaatccctttctcacttttggaaggtgacttttcaccttaatgcatattcccctctccatagaggagaggaaaaggtgtaggcctgccttaccgagagccaaacagagcccagggagactccgctgtggcccactctcctctttccgaaccagcttgttttagtgaaatatttttacctttaaaaaatgggtgagggaggattaatttattaagtgagaaagtcataagacattcagtatacatctcccaaaatctgtaaatttctgtgctcacatctatgaagcaaattattctgaatatgctttagaatctctcagttgtggcataaaaaagggctctaccttattattagagaaagaaaaagaaaagaaaattccaaatttaagggtgaggtgaaggagaagggcttaattattatatctccctcaagaag

SEQ ID NO: 166330 - DNA, 405 bp, Homo sapiens
agtacacaggctcaagatggtgtcattcagtcgactgatttttatggacctcgagttcaggactgctgcttgttcttggcacgggctctgaggcgcatgcagagaggaggaggcggaggaggacttgggggagaggtagagagaacgatcattagggctgggttgtgtgtgggctgtctcagctggcagaggggcacccagtcccatcttgagcctgtgtctagacacaggctcaagatggacatatatgtgtgctaggtgttggtcagagtgtttggttgtcaaattcagcctggctggatgtatgtactaggcactcttgtgtcatcactttcatttctcacagtagccctgaaagtgtttaccttaccttccctcctcctgtccccagcccaccattcagga

SEQ ID NO: 166331 - DNA, 311 bp, Homo sapiens
cccaagccaggcctttcccctcgtgagggttcctacccctcccttgtgtggccctgcaagccgcttctgcttgtccacacctgcgcccgagagttcttctcatggctggtgcgtgccatgaatgaagggcactggccagtggaagggagtgcccggccaggccttgcctgcctcaagtcctcagaccagagaggccagtgggggtcttgcccagaccatacagccgggaggtggtctgcctggctccatagcctcctcccgacctcacagctgtcctgggacggggactgagagagagctcaaagacagga

SEQ ID NO: 166332 - DNA, 290 bp, Homo sapiens
tggactcttactctcttactctttactgatttcaaagatgtttttgcatgaattcacttatttgatcataacacttggaacaaggagaagactaatttcagttttactgaaatgatgtttagaagttatgtgccatgctccatgtcacatgtcttcaaatgagtagagctagtgtatttgccagtctcttagtccaagcatttccctttgcaacattcagacattaatccgggaaccctgataggcttgaatgtacacagagagatggcctgcatctattttgcatgaag

SEQ ID NO: 166333 - DNA, 667 bp, Homo sapiens
gagtattgcctcctaactagcatttccacatccgttcttatgccttccatttacacccaactccatcgatccttctgccacagccttctgagtagttgagattacaggtggaagccactgtgcccagctcacgtgcaagtttttgtatggacatatttttatctttcttggtcatatacctaggagtggaatttctgggtcatatggtaattctatgtttaacctgtgaggaactgccaaacagtttttcaaagaggctgcaccattttatattaccaccaacagtgttagaaggctccaatttctctacatttgcatatctttataccagttggacatttgtatatctttagaaaaatatctattcagatgctttgctcttttaaaaactgtgctctttttatgatcgagttacaagtgttcttttttctagatacagatcccttacatatatgatttgcaaatattttcttccgtttcataggctacctttttactttgttgatggtgtccattgaagcataaaagttctgaattttgaagaactctaatctactttttttgttgctgcttatgcttttgataacatatctaagaaaatgttgcctaatcaaggtcacaaagacctacctatatgttttttcctaaaggtgctatagtttagctc

SEQ ID NO: 166334 - DNA, 533 bp, Homo sapiens
caccctgagcttgctgcccctcccttccatttcccagcctcctgcagtctcactctgtctccagtacttactgagactgctgaggtcctcagcgacatgcccattgccaatcccagcagcctgtgtccagttcttcacgttttttgaattcactgcaacattgaatgcttgccagtgatgcctccttgctgaaattcttccttggatgaaaagacacattgtttccgggttatcccttttctctttgactattgcttctatgtcttactgaggcctctttctatttccacccttaaccattagtgttcccaggattctagcctcagctcaacttctttcatctctcccagtagcctcattcatccccgtgaccccagctacacttgcaaggactcccagatccaaacctttgatccagcctttcactgagacattctccagctgaatgttgtgctggtctctcatatgcagcagagtctattcctcctcctctcagctctcttttctgtccaacctagaccacaggcatcagt

SEQ ID NO: 166335 - DNA, 217 bp, Homo sapiens
tcaccttggcctcccaaagtgtcgagatgacaggtgttagccaccaagcacagccagaaatgagtcttaaagtggacatgagattggggtttaagccacactaagctggatttgtaatcattgaaagtaatctgagagctatgggatctgctccttaaaagatgggagaggagaattttaagagatagggtctcactgtgttgcccaggctggtctt

SEQ ID NO: 166336 - DNA, 298 bp, Homo sapiens
gggtagaacattttgcaccccagctctacatgaccaaagaggtgtcaatgaacgaggataagttcattctaacaaatcagtaaaatttaagatcagtttgagggcaggaacagtggctcacacctgtaatcccagcactctgggaggccgaggtgggtggatcatttgaggtccggagttcgaaaccagcctgaccaaatggtgaaaccccatctctaataagaaaaaaaaaattagctgggcatggtggtgcatccctgtaatcccagctactcgggaggctgaggcaggagaatca

SEQ ID NO: 166337 - DNA, 1050 bp, Homo sapiens
taatttgagtgaggggtgagtggggaggaacggggcttgtctggtagggttgagactagagtcttggaatttgtgggagcaaatttcctcttcttgtaaattaaaaaaagaaaaaggccaacaagctgtcaaataaggcttgaagttgttgttattattattattgcaatgagaagatgaaccttgctctgaattgaatctcaaacttccagccctgatagggatcctgggcatctggtaagtcccgacttgcatgggggcattggggacgggagaagagctttctatatccaattcagagaatctttctggcagggtaatcagaggggtggcaataagataacttattttaataacctaaggtgagaggtttcgggattctggatgacaatgtctcggtgccctcaaggccactgattcctcgccacacagtctcagtaactccgcagcctctagacacggctttccggaagcggcctgcaagctggaccccagcgagttcgcaggatctgcgtagtccctgctcgcgattagagcgcacacgagtttactcctgtccaagtattctgataagcttcctctactgccctctcgtggccacagtcctcagtggtataaatctaaaaaacaacaaaaatcactgcgaatacctaaaagcaattgcaccaaattcttagagcagtagcggcagaagaaacgaagggagggaaggatgaagaaagggagccggagaaaagagagagagagaggaagaagaaaaggaaatctagactaaccagtcatctcgaacaatcgcacattcaacacaggactgggggatctaggctttactccaacatctgcagaaatcagcgaattcttcaaaagttcttcattgtaattagctgaaatttgtgttcctgtaactttcactggctactgctagttttgtcctgtgggaccacaaagaatctgtctaagctgtgttgcctgatccatacctgttctttccttcaaacttctttagcattcattgttggtaacacaccaataaattatcatatttaccct

SEQ ID NO: 166338 - DNA, 513 bp, Homo sapiens
tcagcttatttattttcctactcgataggcttcggagtaataatagccaacatttattgagcacaaagtgccaatagttgtgcccaacattttgcatggattatttcatttattcctcagaacaattctgtgtagaggtgcaggattcatttgaccaggtttacccacgtggaaacagactttctgataattaatgaatgaattagcgaatgaatgaaagtatcttacccaaggtcacacaacaattagtagcaaagtcagaatagtagctgaactttcagactcgaaaaggcctttaaccgctacactgttgccttgccattagtatttccaggttaagaagaaagttatcgatagattcaattaattgtagaaaattattaatgaaaatatggggccacttgttttgttgtctcttaaatttttttctctacgtcgttgaagccctgtgctctttgcttttctctctatcctttccattacattgccttctaacactatacccatgaggac

SEQ ID NO: 166339 - DNA, 439 bp, Homo sapiens
agtatttaggatttgtaactcataaatctctaacctttagttttcctttagattttggaagattttttatatttgttttcaaaatgaattcctaactcgaatgactttttaaaacgaaatctaacatttaacctataggaaagctctccagactttgagttcattttcagctttactgggtattgtgagataactatataaagatatttagtaattaattgtatatatcaactctggagctccagagtaagagtcaagtttgggacttctacccatataggtagtaactagggctaggcagtataaatagagtgataggagaagatcccaggagaaaatgctgaaaaacaccagtgtttattggaagagaacaggaagaagaacaagaactagaaagagagagaggagtaatgtccagagagacaggaaaaaaaaaaaa

SEQ ID NO: 166340 - DNA, 531 bp, Homo sapiens
tagaacacaattaccttgaaagtccaggaaatggggctgaaatgaattcttttatgacagaagagaggacatagttcatctgacttcagcttcttttcactgtgtctcgaggagtgggaagggaacatggctatgtcgtatgtaaactaagagagcgggttctgctttctcatcctccattcctgctccctgactcaggctcttataaccactcatcttccttctcttctatcattgtgttcctcacatcccctgcaccatgtctgccttcttctccagtccacttggactcaggttattcagtttgtttaaagagtcagtttcttcccgcctcaggaccttagcacatgctattcctttcacctgagtgcccttctccaaccccctgcttctctccacatgggcctggctgactctactcatccttcaagccacaactgaacagtatctcatcaaggaagccttttgggaacaccctgaccagcatgggcccccctgttagggattctttacacaaggtacttttctttt

SEQ ID NO: 166341 - DNA, 801 bp, Homo sapiens
gcaggttcccagccacggagctgagctttcccaccagcctctgaaccaccacctgctcataggatctggcagcccctttcaagaccatgggagtatactgtaggccctctcagtccctggtcccaggccaagcccagggtggaggtcattctccccacctttgcctatgacatcatcatgtcttcctcccgcccattcagacactcaggaaagggcactgatatggtttggctgtgttcccacccaaatctctccttgggccaaatggagataattgaatcatgggggcagcttccgccatactgttcttgcgatagtgaaaaagtcttacaagatctgatggttatataaatgggagttcccccatacaagctctcttgcctgctgccatgtaagacatgcctttgcttctcctttgccttctgccatgattgtgaggcctccccagccatgtggaactgtgagtccattaaacctctttcctttataaattacccagtctcaggtatgtctttattagcagcatgagagtagactaatacaggcatgtaggtgggcaagctgagtagaatctggagccaagaacccacatggtcacaactgcttttggggacccaaccaggcctggccaatgagggagatggcccttactgcccttggcccagacctggctagcctctcccttcctcgggagggaaagtcctttgattcagtgggcaccctgaatggggtgaacacttatcacccacttcactggaaaagagaaatgatgtgccttccattcataaacaaatctttgtc

SEQ ID NO: 166342 - DNA, 276 bp, Homo sapiens
ctcctgagtagtaagcaagctagggaacaatggctggttattgcttaatgatgcttacagcttaacagaatttaggtccttaccataattctaaccttgtggcctttcattattttcacaaaggcagtttccatcctgaacaaagaggaggttagttttaagcagggactattatcatccttgcttcaaactgtaaactaaattcctcctatggttagcttggcctacacggaggaatgaacgtacagacaacttatgaggttagaagtgagatga

SEQ ID NO: 166343 - DNA, 209 bp, Homo sapiens
agaactgggttaatgtcagtgaaatcggaagcttgttcatcagcatgatggtaggattgggctctcactggtgaaatataagttatttgagatgcagggattagctaaaatatttagagaaactctcacacttctcaagagtgtattagaatcttgcgaggccgcagcctgtatcttagtagggcttgattcgaaacaaccccacatcc

SEQ ID NO: 166344 - DNA, 461 bp, Homo sapiens
ctttggggttgatctgccaaggtgggcagatcacctgaggttgggagttcaagaccatcctggctaatatagtgaaaccccatctctactataaatacaaaaattagctgggtgtggtggtgcgtgcctgtaatcccagctaccctggaagctgaggcaggagaatcgcttgaacccaggaggtggaggttgcagtgagccaagattgtaccactgcactgcagcctgggcagcagagtgagactctgtatcaaaaaattttaaaaaattaaaaaaaaatagataaagggacaagctacagactgggaaaaatattttcaaaccgcatatttgacaaagaactcatacctagaatatgtaaagaaatctcaaagctcaacataaaaaaaaactcaaataaaaaaatagacaaaagacctgaaaaaatatttaaaccatgaggctatacggatggcaaataa

SEQ ID NO: 166345 - DNA, 386 bp, Homo sapiens
  misc_feature (29)..(29): n is a, c, g, or t
agggaaaatggcccaagagggcaagaatnaggaaagaggatagatcacgccattgcactctagcctgagtgactagagcgaaactccatctcaaaaaaacaaacaaacatacctcatagtcaaactcaaggtctcttacactttctcctagacgttttatagttttatattttatatttaggtctataaaccactttgaaataatttttgtataaggtatgaattatgtgttgaggttccttttttgcatatggatgaagaatcattctagcaccatttgttgaaaaaactgttccttctctattgaattgcctttgaacttttgtcaaaaaatctgttgactatatttgtgtaagtttaatttgggccgtttattctgtttaatg

SEQ ID NO: 166346 - DNA, 235 bp, Homo sapiens
tgtttcagtggaggaaaagcacagcttcatataaatcaactcaaaatgtaaacataccacttaaatattaatcaaggtaattacagaaaaatagtccagaaaatcgctgtaacaatccaagataaataaatgtcccttcgctaaaaagaaactcagaactcacttgttcataacctaacttgactttctttgcacaactcataccaaataccatatgcttggctgtatctgtttg

SEQ ID NO: 166347 - DNA, 424 bp, Homo sapiens
caatatttttcaaaagcaacatttatgcaaaaaactcgtgatgcacaaaaaatcaaaatgaaaacccacttggcatatatggttcttttcctgagctgaacaaactcttgacaggttccatccctttttcctatcactcttctgtgataaaaagtcatctggtcactcgagtaagcaaaacgaatcttctttcaataataaaaaatgtccagtccaggtaagagcccactctcagcccacttccagcctgttcctgccaccggtttggctgggatgccactgccttgagaaacaggggcagcccagttctgctctcctgacttctgccctcctcctccaacacatccctttggattctgacccttcacagggaggcccagggagagaggggatccaggacagaatgtacagcctcctgcagcag

SEQ ID NO: 166348 - DNA, 509 bp, Homo sapiens
attccactgcccaattttgacaattgtgttatttttcagctctgttggagattagagaggttttcataaaatgtaaaaatactgtaaaatgtctaagggtctaactgtctcctggtgacatggacttggcagcagatgcttctttccggttcctggtctgcctcctcacactcctttgccagcacatttccaaaaggtatgagccagaccagcggatgcaatgactgagatttttctcgaagttactctaaaggctagcagcatgagcatcattaatacatattactggccaactatcacaaaacagggtcgggatccttcagacactggagtacaaaagcctccaggcaactcaagagcttcaatgtaaaaggtaacttgtaggagaatcactggagcacagagctggaagaggccttacatggtatggtgaaggctttaaattcagcacgactttgcaggtttagatcctggctttgccttatactaactgtgctatccaccattga

SEQ ID NO: 166349 - DNA, 263 bp, Homo sapiens
ggtcagtcctaggcaaagagaagaaataggaggcaacattgatctttggtgacacctaaaggctctgtgcaaccttttcctctgtccagagtaagcctttggtgtaatccctgctgcctctggggaccccagggcaaagtcttggggagggcgcaaagagggcttgtccatcacttgaggacgcagaggacgcatgtgccctgcacatcaggatgagtaaacctgagctccttactaaaataaagctgtcttttgagtgtgtc

SEQ ID NO: 166350 - DNA, 407 bp, Homo sapiens
tggctctgccagattctcccaggagaaaaccctcctattcatccttagaatgccacttggtgtgtactttagcagtaaattaccatacactacccccatggtttgaaggagctgattcacaatgaaagcaccagagtttccttggaattaatttgactatgccacatttctatgcccaagaaaacaaaataactttaatattcaatagaatacatacacaaaaatggacttttaaaaaagacagttgtttttaatacaagatcttaaaacagcatcatttttcatcttaggaaatcatgtgtgtccaagtgattttgtattataattacattgtttacaatgtaccaaaaagcataaagacacataacaccttgcccagatgtggtggttcacacccgtaatcccag

SEQ ID NO: 166351 - DNA, 410 bp, Homo sapiens
gaatggatcagggaatgttaggtgtggaatggaagcctaggaaaatggcatccacaactgatgggtagaataacacttacggttctgaggcatgtttgaatggagggtaaaacctgattgggcagcttaaaaatgttgtgatttaaactaaccatccttagatcattttgttaattgagaacttaagcgagaacaaggtttgatcatatattgtttcctgactagcagaaacggattttaccttattaatgtttgcatttggctgtgtcttgtttacgtctttgtcagaagtcatttcaaatttttttttgtttttttttatttgaggtcagcaattcccttttctattctgtgactttgtattaattatattttctctctgtagactggatgtgatacttattaataaa

SEQ ID NO: 166352 - DNA, 162 bp, Homo sapiens
tggcctatactatgactttatggacaaatccttcactgctgccatgaagcagaaaaaggtaagaaatcttctcagttcattttatgaatctagcatgacctggatatcagggtacacacttaaaaaagaaaatgaaatgcaaaactcattcaaaatgcagct

SEQ ID NO: 166353 - DNA, 427 bp, Homo sapiens
agctgacagtggggcaaagtgaaggagcccagtattggaagatcggctccacatgtatctctgcgaggagactgcaagcgagctcgtgtggaccaggcagaggcgagggctgagtgaggccagcagtggcctgggcacaggaagacggtgagtgagaagccactggagctcctgtgcaggagcgcaacacctttactgcttcattcagtttggcttcacctgcttaaaactgtaactctctagaaggctgaacagcaaaagcctccctcctgcccagccgctcagcatccccaggcaccagcactgctcccagtctccaacgtcctccagggctcttcgcttctgggctagaagcagggaaaccagagtgtgctggggaagaagaggaggaggtggaggagggctgatgatggggccacatgctgct

SEQ ID NO: 166354 - DNA, 404 bp, Homo sapiens
tgcctcctctgacaccacctcaatgggaaggggagcacctcattactgctggataggagtagaagtccaaggtggccatgtggtctccactgaccactgggagaagagggagctcattaccagctttcagggatgagcttcatatttggccacctttaacaccactccagcatgggtggtaggatgcctcattacaccctatgagggtggaattctaggtagccattaggttttctctggcatgagtaggtgtgtggcggaagggatgggggtgatattaggctatagtagagcagttttgtctgaaagatttctgtcttgctagactgccccttttctggtcctttggttacagagagtaggcttttattgggtctcttcgtctgcaactgtcggttttctcc

SEQ ID NO: 166355 - DNA, 496 bp, Homo sapiens
cacacacttgagaggaagtgcacaacacacacctgaggagaatgtgcgcaacacacacctaaggagaacgcgtgcaacacacacctgaggagaatgcacgcagcacacacctgacgggaagtgtgcaacacgcacctgaaagaaggcacgcaacacacacctgagagaaagcacacaacgcacacctgagagaaagcgtgcaacacgggcctggaagcctcagtaggagtcagggaggcctaagtccaaaccctcagaaggaaccagtcttaacttttttcacatctgaagcatgaagaatagtaatattcaacactggtaagttcagaaagaacagactcaaacataggtgggtggagagggaactgctcaacctcttggacggaagtttggcagcttatgccctttgacccagaagtgtctgtttgggaaaccaattcataggaataaaagcacatatgtgtgcatgcttatgtgcacgcaacgcacacctttg

SEQ ID NO: 166356 - DNA, 335 bp, Homo sapiens
gctcggggttcttctattttactgtttcattgtgaatgtcttccaccctcaaggttaactcatggtccaagtacctgctggagctccatattccaactagaagaaagggagaaggattggaaggacataccacctaccctcctttttaaggatccataccagaaattgcacatattatttttgcttataattacaatggctacaacttagtcctatgtatgcatctagtagattacagaaaacttgcatgtggcaggtccaagacatgaaagagactgaaaaatatttatactatgtggccacatgcccagctaaagggcacagaagcatagaag

SEQ ID NO: 166357 - DNA, 326 bp, Homo sapiens
cacggacttgccggctaggcactgtgtggccggcagggtcagctggctgctcgtggtgtacaggtccatctgacccatcttaagatgggtcagatggacaaaccttcactattagaatgtaaaaggtttgtccatggaccttctaaagtcatcgttatcccaccagaagtacatgtatctctctttgggaaccctcaacggggtaaccagtgtctctctgagtcctaggatcttctgattatggctgggtgatgggtttttcagctctcaccaccctggttctcatgtacacccagcaatgggcgtgcgtccatctgacccatctt

SEQ ID NO: 166358 - DNA, 234 bp, Homo sapiens
ggtgcttcctggggctgccacaggtttggtgttgggcttcttcaaacattcagttctggccgggcgccatggctcacgcctgtaatcccagcactttgagaggccaaggcaggaggatggcttgagcccaggagtttgagatcagcctggtcaacagagcgatatcctaaactctacagaaaattagacaggtatggtggcacgcacctgtagtccctgctagtggggggctga

SEQ ID NO: 166359 - DNA, 257 bp, Homo sapiens
tcccttttccaacccccccgccatctatcacatggcagagatagaataaaaacagaaaaatggcgacggtcacgttgtggcgagccttgctgcgtcattagataatcctcatgcaaatagcgggaagaacaaaggaaggggagcccgggacccccgggggcccaagtgggtgtgggggcggcggccgggcgcgggggcggcggggcgcgcggggccgagcgcccgcgggaggcgggctgcgtggggcgtgcggccgc

SEQ ID NO: 166360 - DNA, 354 bp, Homo sapiens
attttaaatattaccagtgtagttaattgtgtgaagaatattttgaaaacctttttatgactagatatagtggtagatcaaatgaaattgccataaaaagacaactcaaagatattcaagattaagtaaataaccacagggtaatgtgtatactatgggctcataaatagttttaagtttgtgtacagataaatagacacagaattgtgtaacaatctaaaataacacatgataaactgttaacaataatgtaattatagatgggcaggggaatggaatagacagttgaaagggaaccatttcctttaaattctatgtatatatctctgttgccctacctgaatcaaacatgaa

SEQ ID NO: 166361 - DNA, 531 bp, Homo sapiens
cagcgcatatgcggccactgtcttacgcatggaccgagagctgcatttaaaactcaactcaaactattgcaagaaaagtaaggctttggtggaaactgaatgtgatggtgcctgacagacagccccagtttgcactagcccccacctgcaaaagaactgggctgggctctgggttgggaaagaggagtaaagcagaagagagccaggaggaggtggcaggaggcacacgcttcccccacgtcgcacttgggagaggagtgctctggcgcctctgggaagaaactcctcggtgctccccagggaagcctcccctgggtcgagagtgccctggggaggaggatgggcctccccagggtgttctctgcctgttccccgctctcccagcacattcccaagatccacacacccacctctcttctctgcaccctgaggatgcactgatagccacagcgagcctgtttctagtgggaacagagagctgaaggtggaaaagaaagagaagcataacccagccttccccgcagtgttccg

SEQ ID NO: 166362 - DNA, 284 bp, Homo sapiens
ctacagacttatccccaagaaatataagaataagctactggtcctttaactatatcgtttgaagaagttggatctacacctgtggcttagtaaagcattatggcaaaaacttccctttctttagcaatgtggagagagggaggaaaaaagaagacacagtttctgcccttgttatcctgctgctgaatttgttacaagatggttaaattttatatagtttaaaacttgtaaagaatctttcaataatgaagaagcaaagtttgtaaactaggcccctagaggtg

SEQ ID NO: 166363 - DNA, 523 bp, Homo sapiens
  misc_feature (24)..(24): n is a, c, g, or t
gagctcggtaccctccactagtgnaggcattcaggtgtctgccttatttagtactgagtcaggccctctaggttgacttagaacctgagagtgtatagcaaaattcttgccccaaaagggcctctagtttagttgggtacacctgatttccgtaatcatatggggacattgcagtccagagaagggaaggaacttgtctaaagttacccgtctcattagtctcctgattttcacagtgccactccagcaccctccctcctacagactcactcccacacacacctgaaacaacagctggccatctagagaatactggcaactcccaacttcatcagtcctgtcacaatggtttgtcgttagcttgcttatttagaaaacaaacttctttccccattaaaagtattgatagaattgcattgaggtatggtgggaaaaaattagatgtttccagtgagacttgagttttagtggttctgatatttaccacctgtgggactctgggctggtcatttcctctcttttg

SEQ ID NO: 166364 - DNA, 274 bp, Homo sapiens
cagttccttatttaaccaacataagaacccaataagggtggttctattattaactccattttagaaaaaacaaaactgaagcttagagaggcaagtggcttgctcaagatcccacagacactaagtggtgagctgatattcaatctggcactcatctatccaaaaaaaaaaaatcttactttccaatagcctgaggtatgtgccagcaacccagagctgaagataattagtcaacaaaatttgtcctcagaaaaagtatttcttatttgattat

SEQ ID NO: 166365 - DNA, 669 bp, Homo sapiens
atactagtcatgacatggtgaagaaggcgtgcatgtcagaggatgagcgagaagccctcagaagttctggagcctgccatatcagtgacattctcaggggtgcagcgtttgagggcaagccagggacaagttattgcatcctgcatccttacaaggaagaaagaggcacagcattgaggcacctctgtgttttggagtcagcatgcaccgcgctagaggatacctctctgacccctttattgggtaacgggaaaactgccagctttgagtggggcccagagaaaaagagggctctgctaaagatttggattgggagatgggcttccctgctgcatagatccaatgggttaccggggggcttatttggggtaggaaggaccctatatggcatctctggcaaactccaacggaagagttgcagtacactgtcctagagttcctggacaagaccatgccttctgcagcagagaactactcgccaagtgagagcagtatcaggcacactaccagacccaggtagagaccgagcacctgctggtgggacatcagcgaccatgcgacagggtctgcccaagcgaggtgttgtcagatcctccaagtcagtaggtcagaggctcagtagcaattgatggtacaatgaaaaaggaagccttgggcttggacccaagc

SEQ ID NO: 166366 - DNA, 83 bp, Homo sapiens
tgaaacagagtttcattggttgctcacagtggagcacagtagcgtgatctcagctcatgcaacctccacctccctggttaaag

SEQ ID NO: 166367 - DNA, 146 bp, Homo sapiens
ttcctaggtggtcttccttttttccaaatcagacaatcagaacttctacatctgtgcatttaaatggtagtagctgtgcagctgttgtcatcttctgggttttttgtttaaagcaaacttcttgacccaatctagttagcaagttt

SEQ ID NO: 166368 - DNA, 483 bp, Homo sapiens
agtcaacctgtgggagggattttgcagtgaagtttgctgtgaagcagcatggggaaatggagtggtggctataaacagataaagggtatgtggacttttaaaagtttatattaatgattaaatatgcatctttgttaaaaattttgtatcagttttctcatctgtaaaagaggcaaatttaacaatgatgcttcaaatggttgcaatgaaaatgaagagttattgcgagtaaaggactaacaccatacttggtgctttatatgttctaagtggtcattattatcaccaggtactgtagaattccttaacactcagcatatttactcaaattatttttctttttcgctctttactgcctcagatataagaagttatctttaagtaaggtgctatggaagtggagttcgaggacaagaatgaacagttaagttgttaatagaattaaatcattattcaaccatgtgtcctaaactctgcgttagg

SEQ ID NO: 166369 - DNA, 422 bp, Homo sapiens
gcaaactccctaattctactcaaacactgagacattatctcattccaagcctaagacacgtgctgtttctatgctatgttcaggggtctttagaagacactaggcaaccacaaaaaccatcccgagaaatgcttctatatcaagagacatctatatcaaaaaaagacatctaaatcaaaaaagagacattctgtataaaaggatgagtcattacttgggtagagtaaggaggagataagtatctccaaggtgttccacctttgcaaagcttggcttataacaatgaccgaattcacgataggaaaggaagagatttttcagattcatataattcaggtcagaggtccaaatgacaggctgatgttataatcaaaggctctccagaacggggaattggacattccaaaatgatggcaggcaga

SEQ ID NO: 166370 - DNA, 327 bp, Homo sapiens
caaaaagtcaaatgctatagctggactaactggtactagaattgcaaagttataatcatattaaaagactaactttagattttttatttgcaatgacaacataatacaaagtcagtagctcttgattttcttgctatattatatccagtgactactgacgctaatgtggaacatttcctgctagttattcattgattaaaaaaaaggagtcattttttttttttccagagactgggcaggagataagatgtcaagaagtaataagtagtgaaatgaaagaggagaatgcaaaggaaccaaaagagaaaacattaaaatgatgttatt

SEQ ID NO: 166371 - DNA, 540 bp, Homo sapiens
  misc_feature (376)..(376): n is a, c, g, or t
  misc_feature (383)..(383): n is a, c, g, or t
atctactgagatagggaaaaaccgccttaaggctggaggtgggacatgcgggcagcaatactgctttgtaaggcattgagatgtttatgtgtatgtgtatctaaagcacagcacttaattctttatcttttctatgatgcagagacctttgttcacgtgtttatctgctgaccttctctccactattatcccatgaccctgccacatccccctctccgagaaacacccaagaatgatcaataaatacaaagggaactcagaggccggcagcatcctccatatgctgaatgcaggtaccctgggcccccttatttctttctctatactttgtgtctttttcttttccaagtctctcgttccacttaacgagaaacancctcacnaggtgtggaggggcaacccaccccttcaccacaccaaggtcttccgaccaggctttgagtaccattattgcaaaggaagctcatcttaggtaacttattactagagcagaaatcacctaatgtaaagtatttcatgtatcgcatttaaaactgactt

SEQ ID NO: 166372 - DNA, 277 bp, Homo sapiens
tgatagggatttaaatgggcagaaaatggagaagaatttttacttctcataagatactagataaaataaacttcctaaaaatgttggatgcaattctttttaaaaacctgttctagggcacagctgagtttgcaagacaataagaaaataaaggaaatcctaaaataatagaaagcaagagcaagaatccaagatgggaagcaggctctcaatccagcagctacctcgaggcagttgccagcttccagtaacctagatggaaatagtctacaggcaa

SEQ ID NO: 166373 - DNA, 143 bp, Homo sapiens
ttggtgactctatgattacctcgcgcccatagcacatagcaggatgtatcatgggttaatcattttaacatctattatttctgggacatccttattgtcaaaattggttgacagcgtattttgagagtggaagccatggttaa

SEQ ID NO: 166374 - DNA, 724 bp, Homo sapiens
ctcttgtccgtcctgtctgactgccctgagcgtctgctatttgctgaattgtctgcctttggctgctgagagtgtgggcgcagcatcccccactctctcaactcgggggttggcagagcgtgggattacctggactgaggctgagcgcgcttcctcctggcatggcttcagcagtgggcagcagcaccgggggctctggaagcttgtgctcctggcttcagcctggaggaggggttggaaagggccagggaggaagagctctgtgtccattttgaggtgggggaagtgtaaggcccactggggcattgggggctcacacgttaggcccctgcacctgccgcctcctggtcctgcacttgacagtgactgccccagaattggtaactcctgactcaggtggtgggcggccaagttgattgtgaaggtggcgttgccttctaaagcttggctccaggggcgctgcgcactcccaggaggctggcggcgtgcgtgtttgtgcatgttcagaagagcacgggaaggattgggtttcatcaatcggtgttttcccaggacatgaaggcgtgcttctgagggccggctcagccatgctggccagctcgcctacccaactgcaccacacagccaggagctggagagacaggaccctccttcctccctgtccccttcgtcgggctgtggggcattgccacacttcctctgacatgctcactgaagtggggcc

SEQ ID NO: 166375 - DNA, 388 bp, Homo sapiens
cctcttggttcatcttcacaccagtcccggggaatggatggagtccaacccactcctcaagctcaggactgcctatccacaccccagccacagcccgattcccacactgcaggcaataaagcagagaggaattggcgcctcctcctaggtgccaggcatgcagatgtgatctgtgtggcagatcctgactggaggaagcagacagagaaggggagaggaaggcccactcctcaactgcagccaccatggttcatggttgcgagtataccatttgcgcttcgggtaatcgaccagcgttttggaagtcagtgcatcccagacgatgcgactaaccatgaacgaggccattcgacggctagcagggccaccgtatatatcactcatcggg

SEQ ID NO: 166376 - DNA, 263 bp, Homo sapiens
aggctggatctccataaaccctttgctgtaatgaggaatgtataagttaaacattaaagcagaagtagaaaacaatggataacgaactggggtaactggtgcctgagtaagaaagctcgaatgcaaaaacaaacctattaaaaccttacctggacttcctcaacctcaaacctgattgagggatcaaagcgtgcaccaagacccacttaagaaactttcctacccacagacccatagttaaaattagattaagaaacactccc

SEQ ID NO: 166377 - DNA, 246 bp, Homo sapiens
caaagtggtaggattgcaggcgtgagccaccacgcctggcccccagctgcttaatttcatataatgtgcaagcctgaaatcctgctgggggtaaggaatatccaagtcccgccggaggacagcaaacacgcttggttaggacacatagccacctgaccagggcagaagtgaggtgctggagtggggggtggataatggctcagagacacaatgagaagagaaagaatggtctagaggccaaagcag

SEQ ID NO: 166378 - DNA, 140 bp, Homo sapiens
tggaacgtggtgagcagtggaggaagaatcataatgacccagggcttccaaatgccagcctctggaaagagaggggaaactgaggcagaaagggaggttctggaaagatgagaaggtttgcaagtaagggatcattaatt

SEQ ID NO: 166379 - DNA, 340 bp, Homo sapiens
cacctttccgggtctttgcctaagagctgtggtgacttcctggttcagtgcaaagctcccagcttcttgcctgctcttccagtctctgctgcttccactgtggcgcttccacaggctctggtgcagaaggaaatctggctctgggtcagttagaattttaattaaaaatggaaatgcaggctcatgtcaccagtactacattctttcagcccagtgatgatttctggcagggataaaaataacagacatagccctttggcactaatgaagaaaggggtatatgtgtgggtgtgttttaatgaattaaaaatttataacagaaaatttagatataataagt

SEQ ID NO: 166380 - DNA, 588 bp, Homo sapiens
ccaagtagctgggattacaggcatgtgcccccatgcccagctaattttgtatttttagtagagacagggtttcaccatgttggtcaggctgctctcgaactcctgacctcaagcgatccacccgcctcagcctcccaaagtgctgggattataagcataagccaccgcgcctggccccttgggtgttcttgctacattgctctgtgcgcgtaccttgatggttgatgaaattgcttcttctgactaccagtaatcacatcctctgaaatcctgcctcaaaaccagcccatcttcaaacacatctacacagccacctgaccctaaatgtttgctgtggtccgtgctagatcaaacccaggcatgatttttatctggattcgccccagagctgtctcccagaccctggcatttgctggctccattcattccctggagtttcctcgctcctccaccctccacaattgcaccagcaaacctgcgcagctggtttgccagggaggagcaagacctgttttcccatcttagggctcttctcgcttctgatttcataggtggtcagaaagtacatgtagggtttgaggtggggac

SEQ ID NO: 166381 - DNA, 218 bp, Homo sapiens
atgggacgcagagggacacaaagaggcggggcaagagctcaagtataatagcaggggtggaaagtggagagagaaaaggacagagatgggatttgagggaaaggggataaggaggaaaggaggtctccaaagttgggagaaaggaggaaaccctaggatgtgtgtcgcccctccaggaccagcctaaagcacagaggcgtcaggagggttttggaaag

SEQ ID NO: 166382 - DNA, 659 bp, Homo sapiens
ggtttttggtccttgcgatagtttgctgagaatgatggtttccagcttcatccatgtccctacaaaggacatgaactcatcattttttatggctgcatagtattccatggtgtatatgtgccacattttcttaatctagtctgtcattgttggacatttggcttggttccaagtctttgctattgtgaatagtgccacaataaacatatgtgtgcatgctcacacagatactttttaacaacatgaccactttctaagttcattaccctttgaaacaaaataaaacaaaactcagctacaccatttctaaacaaaggtgtaaaaaaaaaattgaagatccagttagctaaggaagccactaaaagagttggaacaaaaggctctctccaaatggctatgaatttaagcctttataattcataaagaacatatgaattcaggaagaaaaatgtgcagtttatagttttatatagcattaaccctggaagttgctctcagatcttaaaagtcttcaaactcttctgttacttttacatatgaagatagcaacgtatttggttgatgatggctaagaaaacatctggcacagccatattaacaagggaatagtttgttttacgacagaagaggaagcttctgttctcggctaagagccatgt

SEQ ID NO: 166383 - DNA, 404 bp, Homo sapiens
aaactttctattttcactttaatttaaatatataaaggctctgcttcaactcttgagaaattctagctgtaggaacaacctttccaaatcattttcttctttaaaaaattctagttttggcaaaagcatcttcagtttatccacaaaccatttacttttcataatccataatttaaaccagaaagtgcttttcttttttaatagagaaagctaatttatctgacattgtcatcatggaatagtgtgttgcaaacaagctagaattctagaaagtgcgattttttttattgagacagacttttgctcttgtggcccaggctggaatgtaatggtgcaatcttggctcaccacaacttctgcctcccaggttcaagcgattctcctgcctggctcaagatggatgg

SEQ ID NO: 166384 - DNA, 180 bp, Homo sapiens
cattcattattggattgtggtctgttctagattgggatgatctagaatattcctggggggagaacagggtagctaacagttaagccttaagagaatcagtacaactgttgaaagtacccccaaattactctattattattattactattattacttgctatctgttacatgccagtattt

SEQ ID NO: 166385 - DNA, 511 bp, Homo sapiens
ccaccatagggggcttgctaggtaaactcaggtgcattcagagccgaaggttacatgggaaggaatgaggttggttgcgtgtccatatggaacagtctgtaagatgatgcccagcaaaaaggggtacagggtactgccatgtgtgtcatggagaagggaaaatggaaacatccactcccgggaggttctgagaaatgcacatatatggccacacaaagacttgtacatgaatatttatagtagcactcataataagcaaaaatggaaccaatccaaatatccagcaagtggtaaatagataaacaaaatgtggtggatgtatgcaacagaattctatttagcaatgaaaacgaacaaataattgatacatgctatgacatggatgaacctcaaaaaaattatgctgggtgaaaaaagccaacttgcaaaagactacttactgtacgattctatttatatgaaatatctagaataggtaaatctatagagacagaaagttgattagtggttg

SEQ ID NO: 166386 - DNA, 593 bp, Homo sapiens
ctttcttgaaggggtgaggtcttcttaccccctttaattggggtagaacttcgttactgccatgaccagtagattatatcagaagtgatactttgtgacttttgagtctagatcatagaaatgccatgcaattccaaattattatttatggaacctgccacatgctgtgaggaagcccatgctgtgagacagagatagaacattcatttaaaaaatgattggaggaggagccaagatggccgaataggaacagctccagtctacagctcccagcatgagcgacgcagaagatgggtgatttctgcatttccaactgagctttgaagagagtagtggttcttccagcacgcagcttgagatctgagaacaggtagactgcctcctcaagtgggtccctgatccccgagtagactaactgggaggcatcccccagtaggggccaactgacacctcacacggccaggtactcttctgagacaaaacttccagaggaacgatcagacagcagcatttgcggttcaccaatatctgctgttctccagccaccactgctgatacccaggcaaacagggtctggagtggacctctagcaa

SEQ ID NO: 166387 - DNA, 356 bp, Homo sapiens
gggagggggaagggggaagggggagggaggagggagaaaagcagaggcattaggggaggaagaagggaagaagacaacttctctgggaagattcagataccagtggctgtatgttgccttgtggccagttaggcctttccaccactcaaggcaaaagaataccaaaccatgggccataaacagatagcaccactcctcctgacttaccctaaaagctgaatgcagtggagagcaaaagtccatggggaacgggatcgtgtctaccttgcaggccctctacccccattcctggcacatggtaggtacataataaggattttgtggacagagccctgtctcttctgggagctcagaga

SEQ ID NO: 166388 - DNA, 209 bp, Homo sapiens
aatggagttccatgaccatgctgattgacaccatatgaagtcagtctatctgatttgcgctaagtctttggtgcttcatgaaatccctctgctctcctcggttagctaccttccaatccctgatggcagcacatccaaaatgagctctccctcaccctgtgcaggttgtgcagaaaatcttccctcatctttcacagagagagaaaaaa

SEQ ID NO: 166389 - DNA, 242 bp, Homo sapiens
tgatgcatgaactttttgggtttttctaggcccagcaacattggaaatcatctggcattttcatcttaagaagtatgaaaaatagaaatggcatcttaattctgtatgttgacattttaacaattgtccaccaggccaactgtccttataagtaatttgtgtttcttttttctggcaaataagcgttcactttctctactaattttctagcagttattctcagttgcctcactggtttctac

SEQ ID NO: 166390 - DNA, 620 bp, Homo sapiens
caacatgtttagttggaaaatttcaacaataacaaacagtcatttcaaccagatgataaggtactgatttctaacagtattggcgaatcctttctgttcatcaacatgtatatgaaaatctcaaaacagttttattttctagttattggtatttgctttttgctattttgcccacaacataatttttaattattgtttatcactcataagtgctgactagttaattataagctcatttctatttatgtatgtatgttagtgtacaattaaaagaagcatgtgtaattatagactgtaattcagtaacatttttgatgagtaattatataatccttgttttaaaagataaggaccttgagaaattatatattctgcaggcacgctttttaaaaatcattaaggcaaaataggggacttctgagatgaaaatagcagatagaggtatttcaaccccgcttctccccaaaaaagttcagatccccaaataacaagaacaagaatcagaaaaatcaaactctatgatgaagctatattcaacattctgtaacttgaatcacaatatgaagtgtgaaggtgaaaagcagattgaagaaaaatgataagttattgagtagaggaga

SEQ ID NO: 166391 - DNA, 536 bp, Homo sapiens
tcagtgtactcttctgctttgtaggagtgagatgaccgggaggaagaggaggaggatctggacgtgcctctcgctctccggtgcttcttctgcttctttgatcctttataagttttctgttttctcagctgacctttccctcgagtggctggagtctcgggaattcactgattctctagatttacctcgctgaagatctctctccttatgttttttatgacgttcaatatcaaggcggagatcaacaggatcatctctgtattttccctcagccttgtagccaggttttctgggacttttcatttcatcacgagccaaaccatgttttatgaaagtactgcgggaaatgtctattgtcctgtaacttgtttttggctgcctcttgctcagttcctctatttaggtatttagtaaagtgtttatgtaatgtcattcctgaggacccaaagtgatgctctttaacatggtgaacaatggtcactatatgttgggctaacagttctgagggtctacgctgagactgagctgactgtatg

SEQ ID NO: 166392 - DNA, 463 bp, Homo sapiens
cttggtgaacactctcctccccatctgggattgccacttcccttgtttaaaacaccagacacaggcagagattctcttcttaactctccagtactatcttcccaagaagtgcgatttccctaggtttgctcaccattagagcccaaattctgaaattagctggtattgtctgtcagcaaaatggtaactaatatgaaatccattagaaaattatgatatttgagaggccgagatgggcagatcacctgaggtcagtagttcaggaccagcccagacaacatggtgaaaccccgtctctaataaaaatacaaaaattagccaggcatggtggcacatgcctgtagtcccagctacttgggaggctgaggcagcagaatggtttgaaactgggaggcagaggttgcagtgcgctgagatcgtgccattgcactccagcttgggcaacaaagcaagaccccatctc

SEQ ID NO: 166393 - DNA, 399 bp, Homo sapiens
tcataactgccaccatagtggcatcaagtgcatcacttgatgcactcaagtgatcatttaacaaattaatcaaattactcacaacggatacttttaacgagagccaccatttttgccacaaaggagatcatgactgtaagcttatctagcaagctatgtaaaaaaccaaataccatacacaatcaaaagcccagtaaaaatggcacatacacatgtgaccgaagctgagagaaatacgttccgtcgctgctattaagtattgcagaaattcctcttaaggtcatgcaataaacattactgaatacccaatcaggcacttttctagacaatgggataaaaaaagacacgatctctatccttaaggagctcttgcactacaatgaagaaaacagaagaaag

SEQ ID NO: 166394 - DNA, 354 bp, Homo sapiens
ttccaatcacaggcattatacaagcattcacatggccttgatgcacatattagggaagtacatggttagaagaaataagattttggaccaagaacacattagatcatgttagcctctgatgtggtgaatggtacatgaatggagatagttaggtcttgtgctctaaactctcctcactcatgtacacacacacacctgcagctgtacacacacacacactctcacacacacacatccctgcaggtgttccttgccttccaataaaacttatctttgggaagctttaaccagaggcaagattgacagatgtctcatatttaaggtagtgtttgtcaggataagtctcagactctt

SEQ ID NO: 166395 - DNA, 515 bp, Homo sapiens
gaaggcattgccctagggacaagaggaggcctgcaggcttgcagtgctttctgcaattcagctggtgagaccccaggaaaaaagctggccagagccaacgcagaggcgggaaagagggtgacagtgtcatgtgggaaacacaagagggaaaggggccagaggcggagcaagaggaacaaaggcttggaggataggtccctgctgccctgtgacttgggcatgatcgggacagcagctagaccctctgtcactatgtgaaagttgccctgttggggaaaggccccgggctctcaggatgaactgaatgtcatcagattccggagcagggaggggctggaccggagacgaagcattgctctgcataaagtcagggctgcctgcctgttcggggatactctgagccctttgatggcttcctcaaggctctggattttaggaacttgtgatgtcgctggcttatatttgtgtgaatttgacctgtgggttgacctgtgggttttcctttgcttgactgc

SEQ ID NO: 166396 - DNA, 313 bp, Homo sapiens
aaatttgctccagaaatagctagtcattatttagaaatgaagtagaatctgtagagtagaatgtagagtattgttttacacagttctgtcccatggtgattgttacaagatgaaccaagaagtgaatgagtggctcccagaaggaaaagcattgtgcgctcatggttatctgagccagttgtttgaaaacaaacattttatgaatataaataattcagttaattccagagaaaacccattatcctataaagtctctcaaagatgttctttctgttaagttacactagttactgttactgtttaaacatcaatg

SEQ ID NO: 166397 - DNA, 189 bp, Homo sapiens
ccagcctgggcaagaagaatgaaactctgtctcaaaaaaaagagtaaagtttaaagttccagtggtccatccagatgttaatatatgtcggaggcacttggtatggtatgtaagagaaagatttgtgtcatgctgtatgacacaattgagggttatgtaccaagcagagtttgtgttaactcatttaat

SEQ ID NO: 166398 - DNA, 405 bp, Homo sapiens
ctcgagctggccgcggtgcagcttgtaattggctggtgccatagacgacgctctgtgaatggagagagacccggccactcgcccaactcacaccaaggcagttacctccagtctcggggaattaggatctccccagggaatgcgttttatagctaagggtccacgagaagtcttgaacaatgaaaagagcaaagacaaaggcacagaggggttaaaataactggccattctcttcacgcccgtgaagccgagcagtggcggggcctcctggtgtgccgcagatggcgggttctgcaccacatgcttgctgccctaattcctaagccttttaccccctggattagccaaatatcagaaggcagccccaggctttaacgccttaactttcacacactgacaagacaa

SEQ ID NO: 166399 - DNA, 239 bp, Homo sapiens
cgagggcgtctgtgtgggagtgatggcgactgcccgtggaatttacgttgggtaaaggaagaaagtgaagacctggggcaggcaagggaccgggaaaaggaaggaggagccagcgatggaggtcgcagtgggttgaaggattaccggaactgaggtgctaggggaagagagctaaaaagagagcgggcggaggtcagaaagagggctgactgaagtggaggtggaggaaggctggcagg

SEQ ID NO: 166400 - DNA, 248 bp, Homo sapiens
gatttcagtcctcccccacccaggcatgtgaagattaaatgaggctgtgccaagacttggaaaggtgggggaagtgcaactcgtgtggaaagataggactgccccctgggctctgggccaccattcagacaggtcagtgccttggccttttcagcctaggctgctctttaaaaagaagaccttcagccactatccaagagtaaaaatgtcacattttcaacattcagctcatcttgagcacctcctct

SEQ ID NO: 166401 - DNA, 267 bp, Homo sapiens
actcaagtgtgcacatttagaacttagggatgactgcccaacacagggccaggcacagtgcagtgactcagaaaacgtttcctgaagctgacagagcacgaacaattgtaaggctcttttatttacttattttttaagagatgaggtcccactttgtcacccaggctgctggagagtagtgggcatgatcatgagttgctgtagcctcaaactcctgggctcaagggatcctctcagctcagctccccaagtagctgggactacaga

SEQ ID NO: 166402 - DNA, 121 bp, Homo sapiens
aattttgtttgtagaaatggaccctgctgctatatacaaaacaaacacaaaaattttgaaaacctgtatcctacactatttgggaaaattctggaagggagtggacagggttttgtggggg

SEQ ID NO: 166403 - DNA, 206 bp, Homo sapiens
tatacaccctataccactctgataccacgctataccaccctataccactagctataccaccataccaccagaattttgtaggtaaagcttccagttgtaactaagtgatatgctttgggctgggcgcaatggctcacacctgtaatcccagctacttgagaggctgaggcaggagaatcagttcaacatgggaggtggaggtttca

SEQ ID NO: 166404 - DNA, 537 bp, Homo sapiens
aacgtcgtctcaaaaaataaaacaaaagtccgggcgtgatggctcacacctgtaatcccagcactttgggaggccaagacgggtggatcacgaggtcaggagttcaagaccagcctggcctagatggtgaaaccctgtctctactaaaaatgcaaatattagctgggcatggtggcatgcacctgtaatctcagctactcagaagtctgatgcaggagaattgctaaaacccaggagggagaggttacattgagccgagattgcgccactgcactctagcctgggcgacagagcaagactccgtctcgaaagaaagaaagagaaaggaaattccccagggaagtacctcggcttatttcataaacaggtactgaaggaagcagaggcatgtggaggacttccccacctcgtgcagctatttgggccgtggcatctgaaatttcttatttcagagtcacccctttgatgaccttggcagtgaactgcagtcatctgtttaggcctttccatggcccacgtcaatgccggtatttctgt

SEQ ID NO: 166405 - DNA, 669 bp, Homo sapiens
acaaacactgacaaataaaaccagcatgtcttcgatataaatgagagcacactatctaaggagatgcttcgttctcaggatgtggttgaaatcctgttatgaataaggtttacatccttgccactgaaataatatttttgtactgtggaaatcaatggtaaggaaaaaaatgaacaggtcatctaatatgtaaacaatttaactttgatgtaatctcttgtttgctggatttggtcctggggaaagtcaaaggactttcttagttacttagttgaatctctcaccttttctctgtcttctcatttaacttctcttctcttaccttgcagagcattttgatgatgagtccagctgaaaatagtgttgtgtcaggaattcagacttacggcctaaccctttctcttgtggggaaatctttaggtgtataggacagtgctaatggtgatttaaagtagaaccagcagaggtttggtctgagggaaggtgaaagcacgtattttatcaagttgagaacctgtagagaatttgtgggttctatgtttcaaacagagctcaaatcttttgaggctcaagttccatttgctcttggcaaaacacaatttcctggttcaaaagaaaataagcacataaaaaaagggcccccaggcttcttggacatcaaagcttacg

SEQ ID NO: 166406 - DNA, 500 bp, Homo sapiens
  misc_feature (130)..(130): n is a, c, g, or t
gaaatacatcatatgatttctcagtggaccatacatcacagcaggaacacctttacaacctgccaggtaaacacatattaaagttaattctcagaggcttttgttgctttaaagaaatcatatgcagtangaaaattcctcctgttttcacaaccaggaccaacagccagttaatcagttgaagtggtgaatctttaccaaaacaaacaaactacatgttttaagcatttttagctgaaaatatagaaatgtgcattttgagattagccaaggcctttacttaagtatggatggttgtgctcattaaagttctgacttcttacatataccacaactgtgatgtatcaccaagattttcacctcttgctgctttaaagtgaacctggaacttagacatgaataggttgagtgtagaatcatccaatcctccaatattttgcatttgtcttgcccacaccatgtgaaagcaggattgtttttgttttttttttaagggtggg

SEQ ID NO: 166407 - DNA, 597 bp, Homo sapiens
tctgtagagtcagatagtaaatcttcttggcttttgaggccatgctgcctctgtagcaacttcttaactctgccattgtaaggtgaaagcaggcatagacagcaagtgaatgaatggccatggctgtgtttcaataaaactttatttacaaaaacaggtgcaaagccaaatgtggtctgtgaactgtggtttgtcaagcctgatatattgcatttcctgaattgggtgggaataggacctaaacatcaagccagtcccttccaaatctaagatttcagtgttatatgattctttggtagggtgtaggaaggcatagatatcatttgctaaaatatccctctaggaggagctatccatacccatccattattcactgtgcctgcaagcaactctaataaaaaaaagttctgttagatgaggtttcaactacatgccactaaatactgggaatgttataagcattttttaaaatggaaacctgtgcataaactgtgtgaccctaaaatgaaattagggtccttttgagtgcagcatttttctacctttttttatgtatcatttacaaataaaaattatatatatctactgtgtacaaga

SEQ ID NO: 166408 - DNA, 177 bp, Homo sapiens
atgaccagtaagcagaaaaacaaacgagatcacttaagagagcaaccaggagtgttgggcatctcacagccattagctctggtgtgaaggacaaatctaaaagcaaggggactgtgtgttcattttctggggtcacaaaactaaggagcaaagccagtattcaaactgcatatatta

SEQ ID NO: 166409 - DNA, 584 bp, Homo sapiens
gttgaaagaacgcagaatattctacagctctgcaggtgacttctctttccataaaatctcactaactaggatatgcttttcaaaatttaccagcctagtacctttcttttcaacttgctataaaatgcattctttgagtaataaggcatactccacaaacgtggctgtgttctgtcttgtattaatattatacttagctatttgaggtttgtcactcccacgagagagtgagccccttgatggcaaggacaaacatcttttaattgcttacagtgcccaaaaccaggcttcatacaaaacaaaccagtagtttcaaacttgaatatacatcaggatcaaccacggagctcattaaaaatacagattcctgagtcccaccccagggactctgagccaccaggtctagggtagggtcagggaatcgacatttctaacaaagtggatctgagtgatgcaggttgtctgcatcctactgagaatgactcaagcagaactcagtgtgtctcaaccatactgagaatgactcaagcaggacttcaacaaaaaaaagtctgaaatgaataagagtacaaagttagctagaa

SEQ ID NO: 166410 - DNA, 649 bp, Homo sapiens
caaaaaaaggtcatggtcactgcttggtggtctgctgctggttgatccactacagctttctgaataccactgcagctgagaagtattctcagcaaatcaatgagatgcaaggaaaactgcagtgcctgcagccggcattggtcaactaaaagggcccaattattcatgacaatgcccaactacacgttgcacaaacaatgcttcaaaagttgaacaaattaggctacgaagttttgcctcatcctccatattgacctgacctctctgcaactgactaccacttcttcaagcatctcaactacttttttgcaggaaaaacgcttccacaaccagcaggatgcagaaaatgctttccaagactcatcaaatcctgaagcatggatttttacgctacaggtataaacacactggtcgggcatggtggctcatgccagcaatcccagcactttgggagaaaacaatagtcaatggaaaaagaatagcatttcaaaggaatgttaaaaaattagtctcttttgaattcaatggaaaaagaataatagtctcttcaacacatggtactgagaaaactggatcacctaataaactttggcttatgcctcattcaatatataaaaagtaactcaaggtctggcacagccttgcccag

SEQ ID NO: 166411 - DNA, 201 bp, Homo sapiens
tgtctgccctcaccatgtgtcctgcacgtgacagctggaggattgtcataatatgtaaaccacactgtctgctccctcatccgccttctgtgactccccacggccttccagttagactcctgagtcttcactcaggcctccaagaccctgtgcattccagttccccctccctgccccctggctttgtctccttcactaact

SEQ ID NO: 166412 - DNA, 432 bp, Homo sapiens
tccatctcaaaaaaaaaaaaaaaaaaaaaaaggtaggcagcaggctaggtctgacctgaagcctatagtttgctgacctatcaactaaactgtcaaattctctagcccttgaattaggactatttgtgggttgcatccctttcacttgtttacgtatacctgcacttaggaaacaaaatatttaatgggaaatgatcatttatctgtgtaatgaattatagaccctgttttatttttaaaaaacaattagcttctcattatctggatctgaaatcaaaatcacttagaatgtgtctgtgaactgctagtacttgtcagtcgtgactatataagtgaaaagtaactactgtgagctgctaatgatgtggatgctattataattttttacccaaggtggattcattaaaataactgcattttttggaaacttga

SEQ ID NO: 166413 - DNA, 280 bp, Homo sapiens
acactggtgagactattcgttgtctttatacagggtataaagaatgtttgaataacatacgtttctgtccagaacgtatttagttgaaagacaatttcccagttcttgatcttctatccacaacacatgcatactgtgaagagttctcttttttttgccttatgtctaccctttcactacctatttcctagaatgacatgtccaggtttatctgctagattgttttcccttttttctttctggattatgaagttgagaataaatgggtttgctcatctta

SEQ ID NO: 166414 - DNA, 477 bp, Homo sapiens
ttaggaagcttagtatttgattagccccaaaggtgaacagatggagggtagggaacaagaagaaaacgtctgcagaagatgatgaggaaaaagatttggagatacaaacattcttttgtggtaagatgaccagaaatccaatagtagggtgaatttgaccgagacagagagaggatgtctaacgagcttctaggcaacagattcatgataaagcaataaacagctcaatgcaatgcaattgctggtggaatttatccatttagatccagactctgtgggtggattgaacatcattctttcccagggcctggagcttctgagaagagcctgacttgggcacaaatccagccaaaactatgaaaaaatacttctgttaagccagaacaaattaaattctgtgacacaatacgtgcacttatcctttaccacctgttgataatttgtgccccaagattaatcatgcaaaagacacttgaa

SEQ ID NO: 166415 - DNA, 414 bp, Homo sapiens
ttgacagacggaatgaataagcaaaacatagtagagtagaatattacttagccttaaaaaggaaagaaattctgacaattgctgtaacatggatgaaccctgagaacattatcctaagtaaaataagccattcacaaaaggacaaatactgtatgattccatttatatgaggtacttagactagtccaatttacagggacagaaagtagaatggtggttggggagagaagaatggggacttgtataatgggtatggagtttctgtttgggaagatgaaaaaagttctggaaatggttaggggagatggtaacaatcgtactcagtgacaatgaactgtatattttaaaacggttaacatggtaacttttatgtcatttgtatttttccacaataaaaattttttttaatctata

SEQ ID NO: 166416 - DNA, 570 bp, Homo sapiens
tgggcctttgcataagccgttccactgcccagactcaggcttagtcagtcccagctgatcttcatctccaccgtctgctcatctttcaggtctcagtttacagggcacttcttctaggtcgtctttctgccccccaccacctgctccccaaataccttctccttcccctgttgtgacacctgtggcaatttattttgatttttgtttgtttgtttctcctctattagacctgggctctatgaaaacagggagagcgttttgctcactgtcatatccagcatgtagagacctgcctggcacacagggaacactctttaaatagatgttgaataaatgttgggagggagggaatgagaatggatccaggtaacttatgaacggattgtttgactatggaccctgagtctcatgacaggaggaaagaaaggagatttcacaattctttagcagtaggagttgttgttttaaaatttgcctctgtgggcccttacttgtaagcaaggcatacttgtatctcagaaattatttcatcttacattatgtttcattaaaggtttatcaactgccaga

SEQ ID NO: 166417 - DNA, 372 bp, Homo sapiens
tccaagaataggagagaacatgcaagggcacacagagagctaaaggagaaacttgagaaacaaaaactaagaagagggaaatgaaaatctgaatgcaccttttgtatgagacactgggaagtgttcgagtgtggaatttgtttgatgatgggtcattagttcattctgttgtagcatgcacttgcacacataacataaacacctggtgagggtgagatgcagagagctggggcccaggaggggaaagggatgtttaattcagacctacacgcgttcgtctaaggctttggtagtgtttaactctagagaacctggaatgggctcactaggagcccattaactggtgaaatgtggaacctcttaggaaaaatt

SEQ ID NO: 166418 - DNA, 145 bp, Homo sapiens
attgatctggtgagggctctcttcgtggtttgcagacagccacctgcttattgtgtctcagaaagcagagagagagagagatatagtgaaagaaagcaagagagagagagagagatcaggcacattggcatctcttctttgtagg

SEQ ID NO: 166419 - DNA, 673 bp, Homo sapiens
tgtgatggcttacgcctgtaatccaagcactttgggaggctgaagtggaaggatcacttgagcccaggagttcaagactagcctagtcaacatagcaagacccccatctccattaaaaatttaaaaattaaccagatgtggtggcgcatgcctgtagtccctgctactcgagaggctgaagcagaaggatcacttgagcccaggaggtggagactgcagtgaaccgtgtttgcaccattgcactccagtttcagcaacagagcgaaaacacgtctcaaagaaaaaaaaaaaaaacttttaagtggcttctcactgctctaaaactctttagcatcccttacagggcccggatgccgtggcctctgcttctctctgttttgccttctccactccagccacaatgaccacttccagttcctcatctatactgggcaccctcctaccctagggcctgttgcttctgcctgaaaccctcctctcctccgccccatttaagttaacccctccttcttcagatctgaaggcaatcatcacttcctcagagaagcctttttaagctatctattagtagtggctatttcttttgtaggactaatcacagttataactttactgttctatgtgacattaattgatcaatatcagcctccctcattagactggaagttctgca

SEQ ID NO: 166420 - DNA, 678 bp, Homo sapiens
ctctgggagttctgtctatgggcagagatccctctgatgaggacagaaaagtctttttagagtgagtagttttgggaatgggtagaatttcagttagtgatataacagcagtgggctcaggggaagggaaagttgccagaaatggcgggactgttcccattgaagcagacgcacctgtgcctagaactgcccccaagcaggtggccagcagttcaaagggccacccaagtgagtatccatttccaagggagccaacttggtgagtagggtttggtagcatgaatttctaggtggaaaccatggatgcttggagttaacaagtgatggaaattgggcagtatattcaggccccagcaaagaaggagcccagtcggagggtggtggggagaaggttggtcgtggagggctcattacagcacacagagggatgggcagcaacacaaagcaatggccgcctcacgcactgctgcctggtcaaacaggcctcagggacaggcctcgggaatgagacagaactaagcctcgaagcagaaagtcctcagtccgtacacagaaacaggactgtgggagttagggaccaacaggcagagagtcagtcttaatactaacaaacaccactaaacagctagcgaggtgcttagccactgcacaagtctgttctggctgagacacaggcat

SEQ ID NO: 166421 - DNA, 978 bp, Homo sapiens
cttgcgtctgagtctttatttggtttttaggacatgctaaggattgagggtcgtgggccttaattgtatagaagacgcagttgcgtttggttgcctggaggcttctctgtgaagcctggtgggacacctgctggccagtttggcccttcttagtgaaggtgatagagacaagggcagaaggtcattgtatttataggatatttgaagcttatcttgtttactttgttaataatacttgagtcatttttctaaacattctttgcataacagcaaagattaaaaagataagtaatgtaatatattaggccctagttgtcattcacctgttcttgtagagctgatacttttttcttgatcaaattttaggtttaatcatatttagcttagaagagtggtctgtcttaagagtattctgattatttaggaacatctagatgaaacttctttgccttagtccatcgtttctcctttaaattcctaaaggcaggaatgagtgtttcttaaaaccaacatgtataaagcaacattttaggcaaactgggatgaggaaaaacatcttgaagggggcttcataatggtgttggagcctgttaaaaatgtggaatggaaagccgatcatgaaaacagatagtactgacttttggcaaaatgagtctttatgaaaacataccttaatgattatctgacaaatgcaagtgctttttgaggttaacagaattataaacaggagactgcagacactaaggtcactactgagcagcacgataattcgtgtggtgtgttctttttaaagattaacaatcttaagtcttttgtatgttatgttgctaagttatttgggggaaagtgttaaaataagtgctcttactttctttctccactgcttttgcacaaaaactttactgttcaaagaatattgtccattcagtttactttttatttttaagatgaagtatcccccaaactggtcatgccagg

SEQ ID NO: 166422 - DNA, 100 bp, Homo sapiens
tgttcctcatttcttcaccctatgaggcaccttaacatctttgtttttagctcactgggaaggaaataggtgatgaaactgaagcacaggaaatcgagtg

SEQ ID NO: 166423 - DNA, 445 bp, Homo sapiens
acaaacattgcgcattttctttccagaatatatgtttaatgctgtttttaaaaatattcaaatcgctaactaaatttatccatactttaatctcttctgtccactttttcctttgttttcttgaaaatattaattgtacttactttagaatcctgatcttctaactccaatatctgaattatttctgggtctgcctctattgtagaatgtacattgcttataaaagaatcacagatgctcccgatgagatgaacttctataccaagagtggtcccctttgttctgttaggcagaaagggaaagggtcagtcattaattacttcaatataatcaggaattgaactaaacctggcctgggtttcagttgtaaaacccagttctaccataaaaataatggttgggtaaaactatctgaaaaatatagaatacttttgaagttctaaac

SEQ ID NO: 166424 - DNA, 401 bp, Homo sapiens
agacagaaggcacaaatggaatgaatacagaaactttttaaatattacagaactttataataaatcttatgctactaataaaattgaaagtactgataaaattattacttcctagaaaaaatatttctgagtaaaactcactcaaaaaacaaataaagccatgccaatctcatcttgttttctgcgcacgttaggttttgtcaagaaagggtgtgacgcaacttagtcatagtccgcctagaagcatttgcggtggacgatggaggggccagactcgtcatactcctgcttgctgatccacatctgctggaaggtggacagcgaggccaggatggagccgccgatccacacggagtacttgcgctcaggaggagcaatgatcttgatcttcattgtgctga

SEQ ID NO: 166425 - DNA, 196 bp, Homo sapiens
ggctcattacccatttttaaattgggatatttgttttcttgcattttccacttttgactgaagtaagggaacaacatagtttactttcctcttaactctgcagtaagaaaacaacagagcaattgtgatgacagaatgacaaccaacactgagccttgggtccagccaggagggttgagggttgaggctccctgga

SEQ ID NO: 166426 - DNA, 187 bp, Homo sapiens
agaccaaggatggggaacaccagcattaagcgatgggtagagacagccaaggagtctgaggaagagcatcaggaaaggaggaaatctagggggcagtggtctcatagaagccaggagaggagagttttaacaaggagagaagtctatctgggagtcaagaactgattacgtgcctattgtctttgga

SEQ ID NO: 166427 - DNA, 340 bp, Homo sapiens
aggcagggacagcatgaccggggctcccccaaacagttccacctctacccattccagttggatgagaatgaacgggtgaaaaagaaccgcaaaaacatgtgagtcatcagtaaaaaaataaagacataagagcaaagggggaaaccaagcaagtcactgatgccaaaacatggacagcagaaagcagaggagagccaggctagcagcccgcacagcaggcacaaggagcggcctccaaggcccagctctgatgcctgcgcccgggagactcggcacttagaatcactaattcccaagtcccaagaactaccacaaacctattgagtaacatttgtaggtt

SEQ ID NO: 166428 - DNA, 551 bp, Homo sapiens
gactagcactgctttctattcatcgacttcagtctagtcctctgaccactccccagactactagttcatgccttacctgcattctcttccttagttatcgttaagtctaggataaactatttcaaccactaaagaatttcaatgtcttgatattctgccattgccccttgcttatcccctgcccacaaatgactaattttagtcaagcagtcaatcacagagtctcaggatttggtagaacaagcactaggacataaatttcccgagtccgaagatgtattcttgggtgttcatgaactccttacggaaatgtatgcaatttgttttcattttgttaacctggaaaaaaaaatctccttgatcacctggatgagtattttataaagtgttgccacacagtaacaaagccagacactgtgagaatatgtttaagcctagagaaggcaaaatgatagccagactgtaatagtttcaacagagaaaaggaatgggatctatgagtcatgatggcataaaccagtgctagagcagtgaggaccactgtcaggtgt

SEQ ID NO: 166429 - DNA, 214 bp, Homo sapiens
tcatccaacctcaaaataacatcagtacagtcccttagtagacgcttctcactgttgcacagcttacagtttagtgagggcagtaaacacataaaagggatgagtacagggtacaacaggggcatggagtgggcaccttgtccagccctgaggatcaagaaaggtttctaggcataggaaaaagcatgtgcaagggcttgaaggccatgtctat

SEQ ID NO: 166430 - DNA, 544 bp, Homo sapiens
tagattttattggtttttactcagaagcactctagattagtgtttcttgaactgcaatttgaagccttctttgggaatgttagattgaggagtatttctcttaaatacaaatgccttttcatctagcaaaccaaaaattatatcttaatattgaatgccatcactcggggtcggggtgggagtaaattctgagataactccagagttttcaaggcatacaaggtatgtggaatagcacagattcagaatacatgatacatacgtataaaatgaaacatttcactttgaagtatttcttcaacaaaacatgtcctgtctgcctacttgctaatgtgaaattatgaaaggatttattgaaatatatgttcagtttgaggtgtaattggtaagaatgccaggtgttgttcttctgccctcttaaagaagtgtacttaaaactattgtgataattcatctctgataaaactttgttctggccttcaaggctcttacagcttaatgttttaaatgtctaaggcatcaaataaattgagggcattttaat

SEQ ID NO: 166431 - DNA, 444 bp, Homo sapiens
ggagatagaggggagagtaggatggaaggaggagagaagtcttggctcttctctgaacagtctgagaacatttaatcaaagaatataagatttcacaacccttttagatgatgggaatgattacttgaactagagagagagtaattctccagatattccctgatgttttagatatggcaaggggatagaaatagtttgaatgcacaaatgtgccttttattagtgcctggaataatgacaaaaagagtgatggctggagttcctaggtgatggatgccctagccttgatagatggtgtgatgagcaccttccctaaagctgtaaagaggcagcaaagtataagagaaggataggagctgtggcagtgtgaccctaaggaaagccttcaagggggttgtcaaaagaagtgagactgaggcaaggaatctacagaggaaaggatgt

SEQ ID NO: 166432 - DNA, 523 bp, Homo sapiens
atttactaattctaggatgcaaagccggaacacgagctgtaaccgctgcgcctgtcaaatctgtcactgcacacatctgtactattcaatcaacaaaacccgatgctaaaaacagaaaagggggagacgcgggagatcggtcagagtggtaggagaaggtatagggaaaggaacagaccttctgaaaggcgggaaggctctggatagcttcagggatgaataagctgaaggcagctgttctcttaccctgaggcagagggcaaggggtaggtaaggaagtataggggaatttggcataaacaggcttgtttacttacattgtccggaaaccgactttgatcatcagggcaggagactgctccctgaaagggggaataataatgttaattacccacagattgtgttggctccaggctttcattattttgtctgtactgaataaaagcaagcagctccagctgttcgagactgctcactcttcagccattagtgctgggcattcctgtagctgctcttacactgc

SEQ ID NO: 166433 - DNA, 708 bp, Homo sapiens
taagaatccagtgtttttatatgtcccaaataggaattgacaggtcaacaagggagactttggtccttgcttttacagacaaacacaggcacacaacacaaaactacacacatttcctccactacagagaaaggagactcaacagaaccggggaggccctgggggaggactgtcagcacgagcaactctccagatttaccccggcagtcccccggagggcgagtcagagaagagacaacctcgacacagcgaaacgcaatcccgccaagttacaaaacacgtcgtgaaacagccgagaagacagagaggccttgaaccaggctctggggatggcatgtcaaggaagccagggtccccggaccacttctgcaaccccaggggtgctgaggtgcacctgctgcccagggaaacctgagttgagaagggtgggcgccctgccccatggaagaccaggccagagggtggcctgggcacactgcagagagttgcaagaacaaggtttctggtggcttgcccagggctcctgggtcccggggcttctgggtcccccttctcaggtgcgcctggccaccttctggcctttccctgcaccaacccctggatgtgagtaggtgccacacccagggtggcacacagcaggcggggcccatgctccacccagggcctattgctccctgaccctctgctgccccctggtgggcaaaacct

SEQ ID NO: 166434 - DNA, 481 bp, Homo sapiens
atcagtaagttggttccattcaattttcagtaagtacctatcatatgtcaggcattttggtaggaacttggaggtgaaggatgaataagacgcggtaccttccattggtgtggaatacaagacatctgaagcaatatataaaattttggacaatggttgtaagtataaaaattaggaagtgcagatcaataaaacaaaggttttataccctttcatccatgaataaagcccccagtacattttcagaaacttttggcctccacttaatacaacgttcaggttagctctgactctcagccaaagtaattttctgcttctgcttcaaagtataaggttagaagcagggagggaactgctaaaggcaattaattatattttcagtagtgtgaagtgattgctgacaacttgacaagaaaggcaaagaaacaaaatacagagagcatagctaagctcagcaatataggtcctacatatatcaaaa

SEQ ID NO: 166435 - DNA, 319 bp, Homo sapiens
ccacagtgtcttttatgacctaacctcaggagtcccaccttgcactgctgtcatactcttttcattaaaagtgagtcactgagtctagcccacactcagtgggaggggattaggctcttcctttggaagggaggaacctcaaagaatttctggccgtattttaaacccaccatagtctgacagcaatgtttattagaagacattctcttataatgctggtgttacttacagaatcaatacgtgactcacatatgctcactcaggctttgcttgtatggaagcatcagtttctgcagagtgtaatgtggctgtgcatacc

SEQ ID NO: 166436 - DNA, 252 bp, Homo sapiens
tgagtagctgagactagcatgccaccatgtccgactaattttttatatttttagtagagacgaggtttcaccatgttggccaggctgaaacttctgacctcaaagtgatctgcccacctcagcctccaccgtgcctggtcccatggactcttatttggcaaagtctcttcataaatttttagaagcctttggattctgcttctaattgaccgagtctgtcttcactgactttgtgactgaaaagttaagctg

SEQ ID NO: 166437 - DNA, 485 bp, Homo sapiens
tgttcatcagctgctcctgagcgtaaaacaagctaggcgaaccgaattactgacaagagctgattccggagagaaaaactctcgcaagaaaacccgaatttgtctatagacggggtggggtttcatatatttagagtatcttagagtgtaataccttagaagtcctctgatcagcctgttcatttgacatatgaggacactgtggcccagagaaagcgtagtgatttggccagcatcatatggttcaaacacaaatttctgtgtgattacaggatatggatctgatggagatgaggatgatagaagcaactaggttacaaaggtccattaattcttgttaggaatttttactttgggctgggcgtggtggctcacgcctgtaatcccagcactttgggaggccgaggccggtggatcatgaggtcaggagattgagaccatcctggctaacatggtgaaaccccgcctctactaaaaatacaaaa

SEQ ID NO: 166438 - DNA, 436 bp, Homo sapiens
tcttacaggttttgtaaccaaaatttaaagtaaagaaaactgaagttttgctagcaaactctttaaaaataataagagactgttgggccgggcacggtggctcatgcctgtaatcccagcactttgggaggctgagtcgggcggatcgcctgaggtcgggagtttgagaccaacctgaccaacatggagaaaccccgtctctactaaaaataaaaaatcagctggacgtggtggcgcatgcctgtaattccagctactcaggaggctgcggcaggagaatcgcttgaacccaggagcaggaggttgcagtgagccgagatcacaccattgcacttcagcctgggaaacaagagcaaaactccatctcaaaaaaatagaaaaaaaaaagatactgttttgaattcaaaataaattattattcaagagattatcttat

SEQ ID NO: 166439 - DNA, 323 bp, Homo sapiens
tttaagattgttatgaagctcattttactgtgatttctaatataaaaatgactggaaaagacggaagaacagagtctagtaggactgaccccaggcaatatccctagcttgtttcagaagtgaaaaggagataaagtaagatttgaaagaataaaaatatactttgtaaagagtaaaaggctggccgggcatggtggctcatgcctgtaattccaggactttgtggggctgaggtgagaggatcgcttgagctcaggacttccagaccagcctgagcaacatagtgagacctccatacccacaaaaatttttaaaaattaact

SEQ ID NO: 166440 - DNA, 217 bp, Homo sapiens
atgaggcatcttagaattctgagtacctgccatatagaaggtactgaaaaactatttggtaaataaatgaaaaaatgaagtaaaccagcagaatggtctttttcacgtacaattttgttttttaatcattttagatgctaaaattgtaaattggcaacttttttttttttttttttggaaaccacagtcctcactctgttgccaggctggagtgcag

SEQ ID NO: 166441 - DNA, 326 bp, Homo sapiens
agacatcatattcatagtagatataaatttgtattctgcttctattcttcaattttagcaataatatttcacccactagatacttttctaattaattccttgcatttacaaactcctcattaaaacaaatttagtggagtaatttatgaggtaataattatgcaccacacacatctctacacccaagttctaagaagtagccaagctcactaaaaagattatgctagatattctggaaggggaagagaggttaggagaactttagtggctaaggaaaaggaggagaaaaaagttagagactaaaggggttacagaagtaggggaga

SEQ ID NO: 166442 - DNA, 459 bp, Homo sapiens
catttccttttgactctttgtctttaaaactgcattacttatatagttataaatttcctacaatagaaaatacaaatctaataatagctgataatatctcaggtagttattagtgccagggactgttgtaaatgctttgcagtcatctcacttgacactcgataataactgtgaattaatactactattatatcaaactgaagtagaggagagcaaggttgatagaggtttactaatatgccctaggattcacaatacgtaataaaactagtatttaatgagtcccctatgacagactgcctaccctcacatggtcctaataatattttatatgatgaggcatttaagaaaatgttttgctttaaattaaccaagattataaaaaaaatcaaacaggccaggtgcggtggctcatgcctgtaatcccagcactttgggaggccgaggtgggaggatcac

SEQ ID NO: 166443 - DNA, 498 bp, Homo sapiens
aacagatggctagatggaaactctgagcttcactgaactcacagtatcagattcacactaaatgactggtaacagcacccatgggcaggaaactgagataagaaggcaagcagctagcacaggaagaactgatacttgtctgcagaagcatatgtgttacccagacttgaagggaaggaagtgggtatccaggtacagggggaggaaaagtttcactagaaaaacagctgtcaaaaaacagggtttcaagagactcaagattgaacatttcaggaaacatttcaggagaatgtctgtttgttaacctgagctggagttgggactgacggtaaagtgatgctgcttccctccactaacttgcattaccaatttacaaacaccctttcttaattctgcccaaatgcataccctcatgaacaaatggcccatgctccgcaatcagaaaattcagtgaggcataggggttagtttcatctgcttgctgtccttccccatctc

SEQ ID NO: 166444 - DNA, 141 bp, Homo sapiens
cctcggcatagtggctgtgggagccctgatggccctgagccaggggtgacccctccccagatccccagagctgattccccacacctccttatttggccagcacagccccaaagggagccaggtcagacacaaccctcctct

SEQ ID NO: 166445 - DNA, 454 bp, Homo sapiens
tacaaatggagaaattgagctttagagaggttaggtaattacagtaagtttacatggctattaagtgttggagctgagatttgaactcaggctgacccgagatttaaacccaaaacacctgtacttaactaccaggcactgatactcctagtttaataaaattgctcataattgggatactaagagcctaactaaacgaagccatgctgaaaggatttatttagatagatgagcctgaaagtgcatactggattgcaaagggtcaacgcggaccttctgcagatcctccgagatacggagttaacagacggtactggagtctggggtagttcagacagaaacatcagcacagcagcagccttggagaagcagtatgtatttagctgcaggctgtatttagtcctagaaggactgcacagaacagagttaatgcattacaactcagggcttagcc

SEQ ID NO: 166446 - DNA, 105 bp, Homo sapiens
actagttaagaaaggctgaagagcagccagccccctgtggattgcttttcccattaactgactggaagaattaaatccaattcaattcagaaaactttcacttcc

SEQ ID NO: 166447 - DNA, 355 bp, Homo sapiens
aaagacaagaggaagttaagaaagtgtgttgataatttgaaaatgaattctgggtacattaaaagattttggaagttggtaggcttggttcttaagtatataaaaacatctagtatttttctacttccttgttgcagatatgacactaggatgaattatttttatgataacactcatgactttttttaaggattcacaatggaatgaagataaggcaagaggaaaggcatgttactattaagtacaaactctgctacccactgttaggtatcttagaaatgtcgcttatttaattatcatagaaacatggtgagatgattgattctcacatatacaatattgattaagaaattga

SEQ ID NO: 166448 - DNA, 373 bp, Homo sapiens
aacttcatacatgaagaaattgctattaaactgaatactttgtgttgaccctaggcttagtttcatttccagaatcagggaatcagatatttatgttaaaagattatgttaattctcccaatagaaagctaattttatattcaggaaaaaagtacacaaggtggtgttggagcttcttgtagcgctagaaagtagtaaggaattgctaaaacacataaaaggtatatatcatccacctgatggttttgatgctgggcaagtgagcccccaaacaggggcttagcctggaagggtttttagattcacctaggaaagaattcaagggtgagctggtatgttagacagcaatttttattgaggtggcagtgtgcag

SEQ ID NO: 166449 - DNA, 587 bp, Homo sapiens
cggaacttcctcccactctctttattaacccaagttgtattaaaatatttcttttctttttatttttttaaatttttactgagaaggggtctcggtctgtgcccaggctggagtgcaatggcacgatctcagctcactgcatcctccgcctcccgggttctagtgattctcctgacctcaactgattgagtgagattactggggaacaagacatctcaaagtgccatgccacagattacttattaattataggggaaaaagggactctacaaggtacagaggtccccagaggatccagcattacaggcaaatagcaagaacacacagctctgtggtgtccccgcctgaacgctcagtttgaaactttctgaggaccaccagggagatccacattgaggagctctgtgcgaggctgctggctcgaagacttccaaaatgtcaaggtcagccaggcacagtggctcatgcctataatcccagctctttgggaggtcaaggcgggcagattgcttgagcccaggagttcaagactagcctgggcaacatagtgagatctgtcactactaaaaataaaaaagttagttggg

SEQ ID NO: 166450 - DNA, 410 bp, Homo sapiens
gttataataattaggtacaagatgtatatccaaaaaaggggttggtattcagagactggaattcttggtataaaagtttttctgggaggaaagtatattgaaaattgaatgcaactggggccaggcgtggtggctcatacctgtagtcccagcactttgggaggctgaggcgggcagatcatgaggtcaagagatcgagaccatcctggcccacatggtgaaaccctgtctctactaaaaatacaaaaattagccaggcgtggtggcgggtgcctgtagtcccagctacttggcaggctgaggcaggagaatcgcttgaacccgggaggcagaggttgcagtgagccgagatcgcgccactgcactcaagcctggttacagagtgagactccgtctcaaaaaaaaagaaa

SEQ ID NO: 166451 - DNA, 399 bp, Homo sapiens
acaactgttattacaacatcttgtagatggaaaaattgccagtgaaagagattaagtaatttgcccctgtagcctctattttatttggttttacttgttatgcttttctgcttggtaattcttctgataagcctctttatttgattacttctttcaggtattttcgtgaggttcatcatcctacgagtatataacattaatgttctctagagttctgatctcagcctacttcttatctgagtctgcatttttcctatataatcttgcccacatcaatgattttacttagcatctgtaacccatgactcccaaatacactcacctatctcctagtcatctctgcatagtatttgtttgtcctccagaataataagtaagcatcttatggggcaatgtcat

SEQ ID NO: 166452 - DNA, 220 bp, Homo sapiens
tggggagcagtgagtgtagcggaagggtacacctgggttctggctccagtttgactcccaatcacttgagtgacaataggctagtgacttcccctctctgggcctcagcttcctaaaccacaaaatgaaggagttgaagttgattatttgcaaagtgtcttctagctcaagaagtgtataatgaggccgggtgcggtggctcacgcctgtaatcccagca

SEQ ID NO: 166453 - DNA, 237 bp, Homo sapiens
gtgaaggcagggtctgtgcaggaaggagccagctgagagggtgaaaagctaaggagagctctgagcagcctcttggggccgacaggggaaagggctctcaaatactcaacaggcttttatgccctaggagtgagtgtgaaccagaaatgcagcagacctcctgagcactggaactccttgtcgactcagccttgatgtgaggaagatgacctgccctgagcagaacaaaggaagtcc

SEQ ID NO: 166454 - DNA, 312 bp, Homo sapiens
acctctgcccacagtctactctcttagggaaatactgaggaagaagctttcatgctaatcattactcatatctcctcctgtccctttaagagatataaacaatgcttggggagaagattggtgttggtgcatgacccagactctggctagttccttctctcagacagagctgcttgcccagaagcagagcacatccgttctggagctcagcatgcagttctccagctgttctgcctccaatggtgtagacacatgaaattgcgggggagggcaggaatgttacaggccccagtttggtcttgggtccaagcc

SEQ ID NO: 166455 - DNA, 346 bp, Homo sapiens
tccaaaaacaccttggccaaaccaacacccactaccttggttcaacagaagctcttacctcgtaaacaggtctggggctaaggtcactgtgggcattttgttggatttcgacagtgtgcccaaggctgtgcaagtctgtttgcttgcctgcatgtctcagggtctctcaaggtgactgatgtttcctggggtgtgcaggaggagggagctgatgagttagccacactggactgacagcagcactgggggagaagtctaagggggttcaagcaagatgcagccacactgcaaagtaatcaaagtaccccaaccccatcatgccaccagccagtgtgtggaaggaggg

SEQ ID NO: 166456 - DNA, 448 bp, Homo sapiens
gagggtgagagacaggcagaatgggcttgtcagggtccatgaccagaaggaataagacggtgttttaagaagacagcccactagaaccgaagtttgaaagctgttatgctagataaatatttcatgaaatgaaacattatgcattagaccatttgactcacatcatgtcccctacacaaaagtttggaaagtggcagaaaatagaaagattgaacaatgatttcagggataaaatggactaagtataattgcatgatctgtctgttcttgcataaatcacttctataagaaggattatatacgtttttgctttagtttgttaccaccacagtctggcatataaactatgcctgcctcttaccctttgtgaactagagatcctgctctgtttttattgccttagactttcagagatcagcaattacaaaagcttccaagacttttctct

SEQ ID NO: 166457 - DNA, 392 bp, Homo sapiens
ggaggtggacaataaaatacaggtaggtttggtattaaaataataggtgccagaggtttcacatcgggtccgctgcatctgttattagacgaagatcaacattggctgagtcccagtttatctccagtccaaattatcaggaagaggaatatttacccttggttacctctgacattagttggattgtaggtaaagcagcctttaaaaatatatatgttgcaaacatctggcgattacccttcactaattcactcgccccagaaagaccaaagatagctgttcaatacaggatttacacagttttgacgcctgggcaacaaactttaaagtttattaggcaagaaatttcaaacgcataaatcgcaggctctaaaataaagccctagaaaatt

SEQ ID NO: 166458 - DNA, 360 bp, Homo sapiens
tggaatggaacctatagcttactttgacccaatataggaaagctcaccaggcctaaccatggttggagaaaagaatggaaaaaggactgatctgacccttccctgcagaatgtgagatctgttgagttggaggggtttagacgacactccaagggcaaaggttttactaatcctcctttgtatctctacctacacacttctgatgccttctcactgagacgcctaaaaggagttaaaatgtatagtgcctggagcaaatccatagagaccgacagtagatttatggttgccagaggctgggggcacgggactgcttcagtttcgtcgacgcggccgcgaatttagtagtagtagtcgacc

SEQ ID NO: 166459 - DNA, 499 bp, Homo sapiens
aaggtgtggacattaatagagtggctgatggcagccatatggactgtttggaatgatgccagagagatatcaaaaattgacactttggaggcctgccggaagtgccaggcatgcgcccaggcataccccagacggagacagctgcccactgtaacacagcgagtgacgtggtagattggcggctccaacagcatcgtagactgggcccacacctacgccgaggtgaccaatgtctccaactgttggatctgcaccgcccttccagcagcagctgcagacagctggccctggcatgtgcatccagcttctgtgaagaaccggacatagctagagacttgaggtcccacagacaatgcgtgggatgcaacacagtgggctttggatgggggcatggcaaaccccatggcgagcctgccccctggctgactcgcagtgtccatgatgaatggggctggttaatgggaaacacatagtgcccccattgcaggtaccatgatgt

SEQ ID NO: 166460 - DNA, 329 bp, Homo sapiens
ctactaaaaatacaaaaattagctgggcttggtggtgggcgcctgtaatcccagctactcaggatgctgaggcaggagaatcgcttgaacctgggcggcagtgagccagtatcatgccactgcattccagcctgggagacaaagtgagactcccatctcaaaaaaaaaaaaaaaagatgtacaaaatacaccttctttttggtcccctttcttatagaagaagttgcaagcagtttacttagggaattgcttagagaagaatttacttagagaagaaattagagaagaaattgcaagcaagaaataaagattgttctcatgttctcatc

SEQ ID NO: 166461 - DNA, 228 bp, Homo sapiens
ctagggcactgggtcctggaaggagccccctgttataaggagagggctttgagcaggctcactgaaaggagagaggatccccactggccagtccttggcaacggatccctagagtaaccacttgaaaaggactgaacagtggaaacgttacttctcctgccttccagggcagtgggagaaagaccctgctagtacggtgactggctgctttatttctcttatgaaaag

SEQ ID NO: 166462 - DNA, 339 bp, Homo sapiens
cttgtgagatctggttgtttaaacgtgtatagtccctccccactctcattgtgtgtctttgggttccacactagccccttctggctcaccttctcctgaaagggctgtcaggctggtgtctgtgggctccacaggaaccactggaaaaagagagttcccaatagcagtgactcatgcaacacagtgtcaaaaccaagcacagggtctcaaaggagaacaggctggttgctggcccaagggaggaaaggggctgagaaagggcttactaagaagagctgttcatcctgtcttaggagtcacttgcccctgttactcctcccagagcacggagtgccctgc

SEQ ID NO: 166463 - DNA, 523 bp, Homo sapiens
ctttgcgtctgtttctttctctcaaatttgtgagactcagctctgagttgtgtgtggctgtcgtcctgtcatttcctctgttgtcacttccatggcatttcactgttacttaggcaagcttcatttgttcgttttactgttagtggacagttggatcatttctcgtttggggctgtggtgaataacactgccataaacatctcgtacttgagccatcattgatttaagagtctttagaaagtagtggaattgctgggctgtagggtatgcggactttcaactctaccacctgatgccaattttttctttgaagaggctggacaaaatcacattcccaccagccacctccttttaggaagctgaggagctctttgtatgttatcagcactattcctacctccacaaccctggacctaatggtgcctgctctctgaccttgagggaccagacaaggttcatgggaccatcgtcccttccagtttgtatcttctcttaaaacaattctcaagtcttaaaaaaaaaa

SEQ ID NO: 166464 - DNA, 151 bp, Homo sapiens
tttagtcattcattcactcactttgcatccgttatccatccaacactggaatatgaaagtaagtaacacacagttcctaccttcaatttgctcactctcaaccagagaagaaaatcagataattaactcttcacataatagggaaagtgcg

SEQ ID NO: 166465 - DNA, 617 bp, Homo sapiens
gtagggttgtccaatagaataacactcagtaaagttacattgggatgaaggcagtgaatagtaatttttaaagcaggttaaaacttgtcaactttgccagaaggtctgtggcttctgtaaagcccactcatgctcgtgtatatatgaagagcctttttcatgttctgttaggagtatggatttcaggcaactttttcactgtgtcatcctcggctattaaatctttcgagctacttattagccaagcacattgattgacacttattacggaaagtgaacctgtaatagatgtaggtcttaaaccaactttccgatttggtaacaggttgacctaaattcagtgtattttgtgttttcactaagtagcccattgttacctttccctccagcaaggctctgaaaaaagtggctccaatactcagcttcaatactgtcatcatttcttaaatagtagtatcagttgtccttaacttaatggatgttttattggcctgagggattaaggtgtagaaaggttggagttttgttggagtttgaaacttggtctgtagatgttggcttctctgccagtttcttctaatcagcagatatttttatgaaggaagagttcctgggta

SEQ ID NO: 166466 - DNA, 174 bp, Homo sapiens
ccactccacgaaaccacataaggactttagtctcttcaagtacatttttctaacttcagcaaagcagagtacaatctgtataattctcacattgctcaaaggtccctctccaaggatgttgtaacaattaatcgacatccaatttgattatcccttaaagtgttctcaataata

SEQ ID NO: 166467 - DNA, 197 bp, Homo sapiens
ttatgacgatatttgggatcactgcaagtattctgaattttaaatggcattcagtgatttgataaaataggaattttgttactctgaactgggtagtgtttcagcaactggctactgtgtcattatttctataaattcaaaatgtagaaggaacatttaccttttaacaagggagtatcccaggtctcagttctcaa

SEQ ID NO: 166468 - DNA, 178 bp, Homo sapiens
acactttatttctcaaataaatgatggagtaggttccagcgttgtttcttccttgctgtccatttctaaggatgagtaaagagttaacgtattgaacttgaaaggagagatttttttccctcttgtaataaatcaaacttttctgaatctggaaaagtgatggatgaaactatgtgag

SEQ ID NO: 166469 - DNA, 177 bp, Homo sapiens
gctttgcaccagccagactggcttatgaggaccatcttgatatacttcattctttcctgccccaatatactttataaatttggggggagctttttattttgagattattttaaacttacagaaaagttgtgagactaatgcaaaaaattcccacagatgcttcacccatattcccca

SEQ ID NO: 166470 - DNA, 362 bp, Homo sapiens
gcagaaattttggttgaaaggataggatgagatttacattaaaatactccagcaattagaagacgaagaggtgttggtggtgatggagataatgaaacagaattgataaaacctgttgaggctgggtggctaatttctcccttttatataaatttgaaagtctcagccaggcatggtggctcacgcctgcaatcccaacactttgggaggtcgaggtgggtggatcacctgaggtcaggagttcaagaccagcctggccaaatggcgaaacctcatctctactaaaaaaatacaaaatcagccgggcgtgatggtgggcacctgtaatcccagctactcaggaggctgagtctacgcgtgga

SEQ ID NO: 166471 - DNA, 216 bp, Homo sapiens
tgttaagcaaagtcacttgggttttgctcttatggagtttgtattttaagaataatacataactaaaaggagatgctttgggatctcagatttgtgatatgaagctttcattcaattatgacgaaaaataagaaactgcaacaaaaattactatctaggaaaggggagtaaacaccaggacgtcaccatatcaacatatggtactaggcagggatg

SEQ ID NO: 166472 - DNA, 165 bp, Homo sapiens
gaacccgggaggtggaggttgcagtgacccaagatcatgccactgcactccagcctgggtgacagagtgagactatgtctcaaaaagaaaaaaggaaaacaaaaaagaaaactaagaacccaattacctctgccacatacatgggctgtctttggttaatgtgat

SEQ ID NO: 166473 - DNA, 638 bp, Homo sapiens
tatctagaaggatcccacagacagtctggggtcaatctacattaaaatacaaataacaaagatcccaacgggtttgatataatgattctggtaattaagcagccttactgaacctgcaaccagaatactacttctcatggcttcacattggctaccaacacttgaccccgaggaatacaactttaagcatctgtagaagaaagtaagacaaatagggctggaacgacaagcttataatctaaacccgcataggttgccattcaaagactttccaaacttacccttctagacttttctgtcattactgtccttgatttcggctcaaatccttaacttggaattatgttcctccaatccaaatctctaccactcaaaatccaccttattcaaaataagagacacagtctcacatgttgcccaggctggtcttgaactcctgagctcaggtgatcctcccgccttggcctcccaaagtgctgggattacaagtgtgagccaccatgcctggcccctgttcaacattttctatatgtctcttcctgatcccagaccttctgtacatatgacattatagatgatttagtcttcaataacttgctattttttcctagtaacttttcaaagagatatcattcaca

SEQ ID NO: 166474 - DNA, 249 bp, Homo sapiens
agaggggtgtgcatgaggccaagggcagtgtcatcagttcagtgcatgatgctgggaggtgatgtgcgtcaccaggtcagtgcatgcctgtgtgtctccacaggagggtttgatctgtgtcggagcgtatggtgtacagatccatgagtggctcgtgctgcgacacatggagatgtcctatgttgtgtgttgctctgagagtcaccgtgcacattccacactggcatttgctgtatctcacgtcagggt

SEQ ID NO: 166475 - DNA, 395 bp, Homo sapiens
acagagcaagactccgtctcaaagaaaaaaaaaaaagaaaagtactgtaccctatagggatataatataccctagggctgccaggaggcttgaagtgacccagactgtgcccaagggcttcgttttaggccctttccttctctgcttccagcttacctgccttgtggcaagaatttttacttccttaatctatcagatctttcccagctgaagctagaggcggaacagagtgaagacctggttgtagagatgccttatttttgtttagataacttgggccttaattttctcactcagaattttgagcattgtatacttaaagcagaatactgaaaaaagctcaaaagccgagtttgagctggctgaaagatggctacattgaagtcatttccttt

SEQ ID NO: 166476 - DNA, 197 bp, Homo sapiens
ttcttaacttataaatgttaatataaaattttaaaaaataattccacagggtaaatgatatcaatttggaatcaagttgtgattaaatcccagattttccttagaaattatggttgtgaattttgcaatagtaacatcctatttccctataagttaatgaatagtgtattctgaacatacttaaagcggtggtgttt

SEQ ID NO: 166477 - DNA, 413 bp, Homo sapiens
gacctcagatcagaacctaacttcaaaacttcaggaactaaaaacaggacaaactgaaccaaaagctagcagaaggaaataataaagattagagcagagattaacaaaatagagaatagaaaaaaacaaaacaaaacccacaaaacccaaagctggttcttttaaaagatcaacaaaattgacaaacctttagctggatgaatttttaaaaagagagaaataagacttgaattaccaaaatcagaaatgatttcgctaccaattctgcattaaaaaaaaaaaaactataagagtgtactataaacaagggtacgccaacaaagggataacctagatgaaatagacaaattcctagaaacatgaaatctaccaagactaagtcacaaagaaacagaaaatctggaggtatcgag

SEQ ID NO: 166478 - DNA, 307 bp, Homo sapiens
ctcaagatcacacaaccagtagagccagggctagagcccagacagcctggctccaggggtaaataaaaactcatattgttaatagcaataacgttgactgagcacatgctgtgtgccaggtactgggctgaggtccatatatattaactcattttaatccccaccctacccttagaaattgagggatgtaggtcgggcatggtggctcatgccagtaatcccagcattctgggaggccaaggcaagtggatcacctgaggtcaggagtccaagaccagcctggccaacatggtgaaaccctgtctct

SEQ ID NO: 166479 - DNA, 774 bp, Homo sapiens
agtccatggctactatgtataaagccgggataacggcgggcgcggtggctcacacctgtaatcccagcactttgggaggctgaggtgggtggatcactggaggtcaggagttcaagaccagcctggccaacatagtgaacccccgtctctactaaaaatacaaaaattagccaggcatggtagtgtgatcctgtaatcccagctactcaggaggttgaagcaggagaatctcttgaacccaggaggcgaaggttacagtgagctgagatcacaccactgcactccagcctaggtgacagagtgagagattccgtcttaaaataaaataaaataaaacagcaggtgtctttgagagctcgctatgtgccatgctctgttagaattactttacatgggctgggcacggtggttcatgcctgtaatcccagcatttgggaggctgaggccagaggatcacttgaggccaggattttgagaccagcttgggcaacttaggaagaccccgtctcaaaaaaaattaaagtaggctgggcacggtggctcccacctgtaatcccagcacttgggaggccaaggtgggcagatcatgaggtcaagagtttgagaccagcccagccaacatggttaaaccccatctactaaaaatataaaagctagccatgtgtggtggcaggaacctgtagtcccagctacttgggaggctaaggcaggagaatcagttgaacccaggaggcagagtttgcagtgagccgagatcatgccactgactccagc

SEQ ID NO: 166480 - DNA, 395 bp, Homo sapiens
tttgagggccctgcagctggagatacagataggagctgatgttgtagtttgagggtcttgcagttgaagattcagggaggaactgctcatgtagtttgagggtcatggaactggaaacccagagaggaagctgatcttctagtttgagggtcgtgcagctgaagtctcggggatgagctgaggttctagtttgagggtcgtgcagcagaagactcggggaggagctgaggttctagtttgagggtcgtgcacctggagaactggacaggagctgatgttctagattgagcatcgtacagctgaagacttggggaggagcttatgttgttcactttgagggtctttcagctggagactcaggcaggagctgatgttctagtttgaggatctcgtag

SEQ ID NO: 166481 - DNA, 275 bp, Homo sapiens
cgttgagggtctttcagctggagactcggggaggagctgatgttctagattgagggtcatggagttggaggcctggagaggagctgatgttgtagtttgagcatcttgccagctgcaaacccggagagaagctgatgtagtttgagggtcttgcagctgcagacccagagaggaactgatgttctagattgaggatcatgcagctgaagactctgggaggagctgatgttctaacttgagggtcatgcagctccatctgttattgggagcaattc

SEQ ID NO: 166482 - DNA, 934 bp, Homo sapiens
cgttgagggtctttcagctggagactcggggaggagctgatgttctagattgagggtcatggagttggaggcctggagaggagctgatgttgtagtttgagcatcttgccagctgcaaacccggagagaagctgatgtagtttgagggtcttgcagctgcagacccagagaggaactgatgttctagattgaggatcatgcagctgaagactctgggaggagctgatgttctaacttgagggtcatgcagctgaagactcggggaggagctgatgttctagtttgagggtcttgcagctgcagacctggagaggacctgatgttctagattgagggtcgcacacctgaagacttggggagtagctgatgttgtttgcattgagtctttcagttggagactcagggaggagctgatgttctagatttagggtcatggaactggagacctggagagaagctgatgttctagtttgagggtcttgctgctgcagacccggagaggagctgatgttctagtttgaggatcttgcagctgcagacgtggagaagagctgatcttctagtttgagggtcgtgcagctgaagtctcggggatgagctgaggttctagtttgagggtcgtgcagcagaagactcggggaggagctgaggttctagtttgagggtcgtgcagttgaagattcagggaggaactgctcatgtagtttgagggtcatgggactggaaacccatagaggagctgaggaccatcgttgagctgaggaccatcgttgagctgaggaccatcgttgagctgaggaccatcgttgagctgaggaccatcgttgagctgaggaccatcgttgagctgaggaccatcgttgagctgaggaccatcgttgagctgaggaccatcgttgagctgaggaccatcgttgggctgagaccataattg

SEQ ID NO: 166483 - DNA, 501 bp, Homo sapiens
tgtaacggcagctttgcaaggggtgtcataggagattaaggcaattgagcaccttactgatgaccccctacagagatggtgggcgtcttttgggctctggcctatgttgggctctcataatcataagtagcatagcaggatattcctggtaggttgttgctctctgtgtggttgctgtggcctatgggtccagggtactgccatatgtgcacaggtccccaccaagaggatccccttggcctagaggatggagtgtaaggaacatggctgtgctgtagccaagcaggcatagggcagcaggcataggccaaggtaaacagcctaaatgactcagagggattggggtgcacgcgcacactcccatgtctcatacaatcatagccatgtagacacaacatagagaagctccccacctggctctcagtcactaatgtctgtgtaggtataaatgtaacactgaccctgtgaggggctgctgaataaagccatgtctcatctacc

SEQ ID NO: 166484 - DNA, 988 bp, Homo sapiens
agaatatacattcttttcatcagcacatggaacattctccaagatagaccatatgataggccacaagaagtgactcaagaaatttaagaaaatcaaaattatatcaagtactcttgcagaccacagtggaataaaattagaaatcaacttcaataggaacccttaaaagtatacaaatacatgaaaattaaataatcttctgaatgatcctttggtcaacaacgaaatcaagatggaaattaaaaaatcatttgaactgaacaataatagtgacacagacagtcaaaacctctgggatacagcaaaagcagtgctacaagaaaagttcatagtattaaatgcctacatcaaaaagtctgaaagagcacaaacagacagctaagctcatcacggttcaatgaactagagaaacaagaacaaatcaaacccaaacccagcagaagaaaagcagtaacaaagatcagagcagaattaaataatattgaaagaaaaaaatacaaaagataaatgaaacaaaaagatggttcttttgaaagataaacaaaagtgatagaccattagcaagattaaccagaaaaaaaggaagaagaccctaataagctgaattagaaataaaatgggagatattacatcccatagcacagaaatacaaaggatctttcaaggttgctgtgaacaactttatgtgcgaaaattagaaaactagagaaggatacattccttgaaatatacaacccccctaaactatgaggaaatataacttttgaatataccaataataagtagcaagattgaaccggatagcttgccgcaagctatccggttcaatagtgttcaactgaatctcacagatgaggagagagaagaaacggaagaggaagtttatttgttgaatagcacaactctttaacctgagggagtcatctacttttttttcctcctttacaaaaaaagataggaaatataagagccgggtttttgcaacatg

SEQ ID NO: 166485 - DNA, 935 bp, Homo sapiens
agaatatacattcttttcatcagcacatggaacattctccaagatagaccatatgataggccacaagaagtgactcaagaaatttaagaaaatcaaaattatatcaagtactcttgcagaccacagtggaataaaattagaaatcaacttcaataggaacccttaaaagtatacaaatacatgaaaattaaataatcttctgaatgatcctttggtcaacaacgaaatcaagatggaaattaaaaaatcatttgaactgaacaataatagtgacacagacagtcaaaacctctgggatacagcaaaagcagtgctacaagaaaagttcatagtattaaatgcctacatcaaaaagtctgaaagagcacaaacagacagctaagctcatcacggttcaatgaactagagaaacaagaacaaatcaaacccaaacccagcagaagaaaagcagtaacaaagatcagagcagaattaaataatattgaaagaaaaaaatacaaaataggatttagagtaagatggccaataggaggcagtaccaacttgcagctcccacttggatggacagagcagtatatggagattcacatcatgaacttttgctccaagaactgctacagaaacataccagtgatataggagttaagaagaaatcacttaggcagagagtaaggttatgggagtcctcggtaaggcttttctttttaacgaaatgaaaagcagccccaaatcgtttcctaacagacggcagcctgtaaagtcaaactgcagacacagacaagcaagctgggaacttatatgggtactagggacaagactgttcaagatggcagctccaccttcccttctctgccagccacatgtacagtaaggagtagacaagatggctctggccaatgaaagttcatttgcataatatgtaaatgtcacacctg

SEQ ID NO: 166486 - DNA, 316 bp, Homo sapiens
tgaagacacatggggcagtgggattgcctagcccagtgcagaagtggcaggcagggctgagccaggacctgggcaactaggcttcagagtctgtgctcttctccattatgctctaagtttttccctcagaaatttaagaatatacgttggtgtttagagtccaactgcaaggaactgggccacttagaatggtctacaaatgtatggaggacctgggaaagcaaatcaaaatagccttggaacccagggaagagaggccagcagtcccaggtgtggaagtcgacgcggccgcgaatttagtagtagtaggcggccg

SEQ ID NO: 166487 - DNA, 460 bp, Homo sapiens
aatgagagcagggctcctgactgtccctagagctgactcatcatggccctgctgaagagtgaggtgtgtgtgtgtgtgtgcgtgtgtgcgtaagacagagagggagggagaaggaaggaggcgggggaacatggagagaaggagccaggagttgggataaacctggcccctggtcatatgtttcatcagcagtggctcctaactccacgtgccatctctgctgctgccctccacaagcaggtgagcagagtgccagttgtgttgaaggtgatgatgtcgcctaactaaactcacaaccaacccgcaatctctcttggggggacactccccataagcaatacaattaaagaagaccaggaaaggaaaataaattccttagcttatacatttaaaaagtatcccttgaacctattttaatagaatgaaatgctaaaaataaagaccaatataacataaaaaa

SEQ ID NO: 166488 - DNA, 407 bp, Homo sapiens
tattctcatcagcaaaatattgctcctacacacaaggtacctcttctccttttttcacttgctaataataatagcaagtattaatataaggtatttgttgagcaattattaaatatgtcatctctaacacaacagtccaaaaagacaggcctaagttcttctactttatagatattgagactcatagaggcataaagtcctacagtataaatgagaagctgggatggccctggatgtgactgcctgtaaagccagttcttcactcatactatttgttatttttcaaaacattcaaccattctcttccctttgagagtttatcatttttctccctaagtcctggagaatctttcttggcaatgtcctgatattctattcattattttcctaccctagttctttctttt

SEQ ID NO: 166489 - DNA, 605 bp, Homo sapiens
ctctagagattacaatatgggtcttcaacttatcacaatctacttagagttaatattatactacttccatacaatggaaaagttttgcaacggcataattttatttaacttctcacccatcctttttggtactgttgtcatgtattttacatttacatatattataatccccacaatataatattataattttttcattaaactaccaatttttattgtggtaaaaataaattataaaatttatgatcataaccatttttaagtgtatagtttagtagtgttaagtatatataggcagtttgtttttttttcaagaaattaataaaagatggaaaataccatctgttaaaattatctatatatttatcatttccagtcccctttatttctctttatatgtttgaatttccatctggtattatttctcttcaccagataacttctttggcatgaagtgtgtgttttttcaagataaatcctctctgcatttgttcatatggagatgtctttatttcactttcatttttgaagggtatcttaccaagctatagaattctaagttgatagtttttgctttttattttttaaatgtcttactttcctct

SEQ ID NO: 166490 - DNA, 615 bp, Homo sapiens
tagctgggattacaggcacatgccaccatgactggctaattttttttagtatttttagtagagatggggtttcaccatgttgaccaggctagtctcgaactcttgacctcaggcaatctgcctgcctgggccccccaaagtgctgggattacaggcgtgagccatgtgagccactgcgcccggctttgggctttgtgtagatcttaaacatgcgaattaaaggtaatgggtttgttaaactcagttagttcataggcatggtagagctactctttaatcaggagccctggctgccaatgagaattctggttgagaaaatacttaatatcccattaggggaagctacttttcactgcagagtgaatgtggatgcagcctctctgagctgtggtgctttactctcctttttattgagagaccaacagccagagagagaggggagagtgaaagtgagagcaagaatgagagagagagaccaagaaataactgtttggagacacatctggtgctccttagatcagcaactttgacacagcaatttgtaaatactttacattggttttgaggattggaaagtttcatttttcacataaccacacaaattctgtgggccac

SEQ ID NO: 166491 - DNA, 401 bp, Homo sapiens
tgtactgcaagagactcaccccaccaagaagcatatcttggcatttgattcattttgaggaggtggccctctttgccatcgcattcacagccctaggggtcaagaaagaggatcctggtattgttggcttctcctatgccaaagtcaaagtgctgagtgttttcctgagccagcattaaagagccagagaacttttcagaaggttcagtgatcagtgagtggtgcaggatttcttcccattgtggttgagtttgatctgggtgcaccacagtaaaaaccagcccagcttcctatttcattgtgtgtttgtctgatggtgactcataccgagaggtatgtttatcccaaactggcaggagctgtgtattcaagggcaaattttgttaacagtggggagagcg

SEQ ID NO: 166492 - DNA, 466 bp, Homo sapiens
cataaacaggtgctcaatgttcacagagtgaacaactttagcaaccctcaatcttgcagcaaacagactgggtttgtatcttaaacagttaaacataaggatgagagagtaaaatagataacgtttctcaaactttgtgactgtgacccataggaagagatacaccttaccatgtgacaccgtccttccctctcccaactatgtgtgcaaccctggacaatgcggttcagttttgcctgcatcaggaaccccatggacatggaagcattcttcatcacattgtgcagattcctctgagcgctgctgcttttgttcaatcttttatacttaatttttgaataagtatttcacttacataattcaacactagcttataaaaaagatagttactgtattgtgtgcttaaaaatttaagagggtagatctcaagtgttcttatcataataaaaaatatgtagacagtgaa

SEQ ID NO: 166493 - DNA, 299 bp, Homo sapiens
cttctagaccttcaagctatccggttcaatgtttccgtttaggtcatgagctcggcaacaaattaagtaaagtgtccccagtaaatgctgataagccccaggaggaaacaggggcatccccacgcataccaaatgcactcattagcatccctgctattatgaagaatagcaaaatgaccttgcaatcattagaagcttaaaatgctatgacttaagtttagaaggacacatattacattgtaaaacctaattagtgttacctttgctaattgctgcctggcattgaaccggatagcttc

SEQ ID NO: 166494 - DNA, 207 bp, Homo sapiens
agattatgaaatatggcaaggtagatttgaaaactgcccaaatagaaagtctaaaaatgaaatacataataatttaaattagaaacacaatgatggatgatgtagcaaattaggaatagctaaagagagatttgctgaactggaagatagatccaaagaaattatatgtaatatagacagaaaacagtagaaacaaaggttaagaga

SEQ ID NO: 166495 - DNA, 386 bp, Homo sapiens
ctaggtatgctttcaaaatagtgttaaaatgcagagtaagtgcggactaaatagacaaaatgaaaagaactggcgtgagagagtgatgacttagaaatagagaaatttatacaaggggaaaatgtcagatttaaaatgaggggtgtgttaaaacaagtgtataagtgctagacctaaaaaaaataaaaaattaaagaattagcgggttaaatatttgtggtgtttctctcattgctgtataggcattgtttgctcatatactctaggtattttcatgggaaatcttactttctcattctgtataattttagaacaagatatggctgaatcttgccatggctaccaaacagtatccagttgctacctaggaggcagcaaaatcacag

SEQ ID NO: 166496 - DNA, 227 bp, Homo sapiens
tgaccccgtgctgccttctccaggcaggcctggcctctgccctgggactggggcacccagggcctcgtgccttctctcttggcctagcctggcccactcaggacctgcccagcctctgccagctcctctggcatccgccctcttctccctggggctggggtgggggtggcagggagctgggacctggagagacgactcctgtaaataaaacactttatttgtagagc

SEQ ID NO: 166497 - DNA, 473 bp, Homo sapiens
tgatttcttaccaacctgacaagtatattctgcggttgaatttggatttaggaacctcctcctcattcagatttctatatctttgctctacactttgccttctctcaaagattaggtgatggaagctgcccattcttcatcaccccttgctattcattcccagtttaattcctaggaaggtgggttatttttattttttgaagtgatatcagtctggtcagtcaggggtttcatggaataaaatgtcttaattagaacatttagggttgtatcattgagggcatgtgctatactctgtgtcttagtcaaaagtaatttttgtttgaaaaatataagattacaaagtacataatgagtattttatgataatattagtaaacaatatgaacatttagaattttgtttttgaaaatttatatacgattgtacaaagattcatcaaaatccaatacagaatttataaaaggaagagt

SEQ ID NO: 166498 - DNA, 944 bp, Homo sapiens
  misc_feature (671)..(671): n is a, c, g, or t
ggaaaaaaactcataatgaaagcataatacttaaaaagaatcagtagatttaaaaaataaccagagaaaatttctagaaataaaaaagatcttaagtatagagaacataacaagcacagctcaaaattaatgaacttaaagatatatctgaagagattacctataatgcagcacagagataaaaagtgaaatacagatgagaaactgagacatggaagaaaataaaagggcccaagacacatctaataaatgtcataaaaggagaaaaaggaggagaagcatcagaagaaaaagtggtttacaacttttcaaaattaaactcaattttaagatgaggaatcaaaatgagtgtcaagtaggataatgaaagtggatctaacacctagacacatcacagtgataatgcaaaacagaaatcttgaaaagaaggaagggagggaaggaaagaaaagaaaaacagaaaagacatgctacctaaaaggaaagatgattgggcacaagatgtcagaagacaggagaataataccttcaaactgatagaggaaaagtagcaattaagagtggggcaaaataaagacattttcagacaaagataaggtttttttcatagactcactggaagaatttctaaaggatgtgaatcagcaaaaaaaaaaacccagaaagacttnatcttatttcctatatgttgggggtttcagtcctgatgtataattggaccctagttagaagggttatctgaggaaggggccggtaggatttctggctttttaaaaggtggtggctccctttcttcatggataaaggtatgattatttttataaatggtcccagggcagggggagaaggggattctcggtcacatcccacatctgggatcagttcctccccatttggtgggcaaatccggatctggccatatccggcttatctcctcgggggat

SEQ ID NO: 166499 - DNA, 334 bp, Homo sapiens
tggaagaatttctaaaggatgtgaatcagcaaaaaaaaaaacccagaaagacagaatgagataaaattttaaatgatgagcaaggaaattggtaaatatgttggggattctgtttactaagtaatgatgattactttttacggaatttcaaaacaaattagatcaaaagcaccagacaaaaatagaaagaggccggatgcggtagttcacacctgtaatcccagcactttgggaggccaagatgggcagatcacttgaggtcaggagttggagaccagcctggccaacatgctgaaaccccattttcactaaaaatacaaaaatcagctgggtg

SEQ ID NO: 166500 - DNA, 488 bp, Homo sapiens
ctgcaagttgaagccaccgtgagatgccgtgtacccacccgtgctagaacagccgaaataccagcaacgtgaaaggctggggagggtccagagcagcagagactccccttcactgctagggtgaagggagaatgatacagcctcttcggaagacagtttgggcatttcttacaaaggtaaacatgtatttaccccatgacccagtagtcctgttcctaggtatttctccaagagaaatgaaaacttagattcatactaaatcctatatatgaatgttcacagcagcactgtcataactgccagaagctggaaacaaccttgtgcccttcagccagtgggcagaaggatgtctccgtggacagggacagcccatgcgtggatggaaggacatctccgtggacggggacagctcccgcgtgatggaaggacatctctgtggacggggacagcccatgcgtgatggaaggacatctccgtggacagggaca

SEQ ID NO: 166501 - DNA, 508 bp, Homo sapiens
gacactgcaaaatgagctagtagcaggatttttaccacaggtacccataagcaacatgtggcatggttcaccatggttttacattgttgtgtaaataacttaaaattatgtgaataatgtaaaagcatggtgaacaatgccatgttttgcttatgggtacctgcggtaaaaagcaaaaatcatgaccctgaaggggtgagcaggcctacaggtgctgggcaggcactgtcttgcaaagagcacaaaatgtgcaggtccctctgggagtgttatagtgggtagctagtcagaaagagcagggcaggagagggctccccataccccacacaccaggagtgtcaggtgaccatcaggtgatggtctggcggttgttgactgtctttctaaagtaataattggtcacacccggcaacagggaaaagccggctcctaatagatagaaaacactcgaaactggtgagcagtagtttccctataagatctcaggagttgagccagtgggctcagg

SEQ ID NO: 166502 - DNA, 331 bp, Homo sapiens
aatgggttgtgggtgaggaaagatactagaaggagagaattttggggcccactgaaaggtccttcttgctgtctttgtagtttttattgtcgtacagtggcttcttgttctagctgatccccagctggtctcttgacttcctccacagcctcctttatccttctcccagctgggccctgtgttttgcgtgtgtggttgtgtgtggacacacatattcctgcaggcggacaccgttggggaagtttggagtttgtgtgtggatggcgtgtacgtgtacagctagtccctgacttaggatggtttgatttacaatgatgtgaaagtgctatgc

SEQ ID NO: 166503 - DNA, 203 bp, Homo sapiens
agaaatccttagcattgccctcttcctcacctacacatctcatcacctcgaaatgttcgttttgtctcgaggatatgtcttcagtctttccacgtctctccatctccaccctccactgctccggtagtctattcgccaccacctcttcctgctccaggagcctcctaagcactctcctttatccattcttgttctttccaatg

SEQ ID NO: 166504 - DNA, 100 bp, Homo sapiens
cacttgttgtgaaaaactttagaatattataaacatgttaatcctgtatttccatttctgtgaattcatccaaaagaaataaccatggatatgggtagag

SEQ ID NO: 166505 - DNA, 447 bp, Homo sapiens
cagaaaacatgagtaggtccaccagcgtgtggtagcagaggaaattctcaggcaccagttgaaagtaaaagcttggtattttatagtttccttttgtaagaactcaagtttttgttgagttgcatattttatattttctggaattttggtgtcattttatccatagttaataatattgtttcaccataactcctctttgattatgtaaccagcaaagtttctaacaataaagcatattttaggggtacataccttcctctcagtcaatgtatagaaagtattacattatgtattaaaacctcagtgccatgacaagatagtcaacatctttagtcatcagaaaaatacaaatcataactacaattgtgtgtgtgtacttatcaaattgtgtactttatatatatgtaatttattttatatcaattagacctcattaaagctattttt

SEQ ID NO: 166506 - DNA, 154 bp, Homo sapiens
aagctccttgattctttatggctttgcatctcggcagaatggagctagctgacttgggttagcggcaacaccagaacgggagcgagctggctgggggagtcacaaccacctgagccgggagcagaatcaccaagggcaaagcactggtcagggg

SEQ ID NO: 166507 - DNA, 699 bp, Homo sapiens
cctaggtaaatggaagagccatgggatggagtagaatattaaagcagtttgacaactgaggacaaaggcagtcatacttccagaagaaaaccagaggccccattctatggctcctcagaaacaagagccattaggcctcctaacaagatggaactagatgctgtcagaggtaagaaaggcacacgcataggggcagagaacacctgatgcagcaggtgtaggacaacgtcaaaagggtaatacagtgtgacagaccacacctgacaaaaacatcttataagcccaataaatactgaccacatctgaccacacagctgagtggcctcctgaaataaaactccatgggtctgaccttttaagccactctaagccccatgcctgtaaggcccagggtgttccagggaacacaggatgtagcagcctcatcactattgactctttaggtaagcacaagagtcaaagggtagcaaaaggtggaatggaggcccctctcatctctcagcatattggtccttctcacacactccctccaagagcccttccctgagtcattcgtagaccacctgcagaggaatgagagttggctattacctgaagactgagggcttctggtgtgtattatactctacagtaaaatgtaacatgcctcaaagaattaggatcccgtaagagacataacatagtagttactaaacctaa

SEQ ID NO: 166508 - DNA, 445 bp, Homo sapiens
actaattgattccgccactgctaatggaaaatgtatctgcaagtaatagattaattggccacttgtgatcagctctcaaccagaggatcactggtggtcatgctagacccactgagtcagtccttctggagccaggaaagggaaccagaggttagactcaaagggatcatgggggtgtccagagttttaccaactatcaccctcacaaaaggccagccagctggttccatcccaaaggaggcagattctgcatcctaagtcattaaaatgcaagtgcattaacttgaaaagaatggaaatcttaacagcataatgaaccacaaaatatcagaacactggcacatcagcttcccttacccccaaatgagggaaggggggttgctttcctcagaaggtttaaagtcattcgtcataaaataacagctaccagtttgctcactgacta

SEQ ID NO: 166509 - DNA, 467 bp, Homo sapiens
atggccatagcagcagcagagcagggactgaatcccaaggctgatgactttgacttcggtgctccagcattcgtcttccctggatttctcagctcgcaggctcgataactctcttctctccccagacttgttggcaggcaagaggaataactcatgtgagtcaaaagcaatttgcaaacataaataattttcaatgccaggagaggagacggtgggaagatgcatggaaggttgagaggaacacagccagccccaagtctccctcgccctgctgggcacttcctctttccacctcggcgctggtgggagagtcggagtgcgccataaacaaggcaggaaacggctatcatgatgctcacttccgctcttcctagaagggattctgctcggcaatctctccactccccaccccctgccatgcacaggattttgtactcccagctcctctggaggctcagaggaggaga

SEQ ID NO: 166510 - DNA, 359 bp, Homo sapiens
cggacctttcgattggcgggcaacttaccaaagtcaaacacttcctttgagaaaaataactccataaatcattagaaacgaattaacttcatttgactcctggtgagtgttcctcaattcttccagtacagatcaggacatcacaaagtcaaacatccagctaatgtcctaattatgctcctcgcatctaccaagacttcatgacaggtacacaaggtcctacaccgagtgcttccaccccctgactacatgacgctgagcatatacatcctttctctgggtcttggttgatttgtaaaaagggcctgggttctaatggtttctaggtttctaagtgcccgccatcgaaggtaccgcca

SEQ ID NO: 166511 - DNA, 312 bp, Homo sapiens
cttattggccggctttcagaggctgtggcctagagtgactggctagatggcaaagctgagggtgtcacttgctggctggctttcagtagcatgttccctgaagcaagctgtcagtaatgattagactgagggagctgtcactggtcaagcaggcttaaaaccatttctcctttacataactggccacagtcttcccctaggggtatttggggaccatgttggtgcttggacttatgagcaatgaggagtcactgaaggcttttatgaagagtgataagatttgtaacttgaaaaggctattttgacctgagt

SEQ ID NO: 166512 - DNA, 984 bp, Homo sapiens
acattcaggattgacttctaaagactcttggtacgtgaggaagaaacccggaagaggaagaggaaagcaaaggagtcagggatggctctttctcagggtctattgacattcagggatgtggccatagaattctctcaggaagagtggaagtgcctggaccctgctcagaggactctatacagggacgtgatgctggagaattataggaacctggtctccctgggtgaggataacttccctccagaagtggggatgtgcccttgtgtatctttgtattttctcttttttctcttgggagttgcatccttgcttgactaaaatggaagctgtattgatttgaaatgaaaagcttcatgatgtaggcaacaaagcaaaaaacaacgccaccaacaacacaacaggttgtggcgaccgtacgcaacacgacgacaaagatcttcgcagaacaacacgtgtgggcacgacgtggcacccaagtcgggatacagctaacacggtaggacaaggggacccacaagaggacaaccggggcgaccagacagacgcgtggagaatgctaaaccaaagcaaaaggcccgggaggtacacactacggtcttggacacaaccacgcgagggacgtgaggccaaaaagggacaacaaacgaggaccggggcggcatacaatatgcccggaccggggacggaagcaaacaaggacaagcagagacaggcgagaagagcagcgaagaaggagaacaagacagaaaactaaggacagaaaagcagaaacggggacaagtgcaagaagcgaagacaaaaacacaaaacgagacgcgagaagaaacgaagcacagaaaaaaagaaagcaaaaacgaacgcgaaagcagactagggcgaaaggaagaagagcaagcaaagcgagataacaaagacagcaagggacagccaaaagacagtagaaacaacacaaagaggaggaacagaaaaagcaaagagacacag

SEQ ID NO: 166513 - DNA, 510 bp, Homo sapiens
cggcctgtactcctcagcttgtgctgcccttctcgaatgactcgcgtttcctgctttcatcactacacctcccaccgctctccatcacctgctctgctcttataaggatccagttttcagaaaaatggaatagtcgtatcactgatctacgtaaacaagttgaagaattgtctgaaagaaaatacagtgtgtctaaactggaaaagtcctgtaatagtttgttcatgagcatttacacaatggagttgctgtttcatcatgggggtactgtggacaaacccagggctgctggtgagtcatgccatccttacacgtctttccttgtaaggtactttgtagtgtctgtctaaatattagaaagtttctttgtttctagattacttgaaagctaaggaaaagttgtagttctctaattatcaattagcatttcttttatactttcagtgtggatatttgggatttctttatatatttattgcaaagccctagatcttagggatttgactgaaa

SEQ ID NO: 166514 - DNA, 531 bp, Homo sapiens
tgacattacagaatggaaaaagataccagaaatttaggaaatgttaaagtgtgggaccaatgcatcaatggatgggtctagcagatcagacacagctaaattagtaacctgaaagattaagtcagaagaaattatggacaacaaagcaacgttggtggggaagagggtattagacacagtggatacaataaatatgtctaaaatatgtttaactggagtcacaggaagagaggtgagggagaatgggatagagtcaatatgcatgtgttagaggctgcaaatcacacagaactgattttaaaaaccagttcactgattaaagaagcccaaggaagcccaaacgggaaatccatacctagaacctagaaatatcctagtaaaactagagaaaaaccaagacagtctgaaagaataaaaataatatattttctaaaaaaccacagaagtagcctgagggaatatcctcaaagacagacagctgatttcttacctgcaacattaaaagccaggaaataaggggaagatagatac

SEQ ID NO: 166515 - DNA, 443 bp, Homo sapiens
tacgccttaaatttagccttttgcccaagctcagtgttctggaacattttctattgtcttgtttttcacaattactggtagtaatttaacttgcatgtatacgttcccactaacgttgggattttgttttttatctgagcctagaaatgatcaattcttttaaaatatagatgctcttttttttaataatgccacacttattttcattgcccttattactaaggtgaccatgtaattgtattcatccaaatcaggacattgagatgaaaagggagcattagtaatttcaccaggacaacagatgtaaatcaggactgtcccagacaaactgggatgtatgatcaccctgctcctaaccagatcttacatattttcatgtttggatatcattcttaataaagatgaaaaagatgcactttctaccaggcatctgtcatctttga

SEQ ID NO: 166516 - DNA, 351 bp, Homo sapiens
agcctttccggcggggtgagtgggcctctgagtggtgaggagggaggtaacagcactaccacttgactcgccaaatgccagcatcctggcactaatgctcaaattccagtttaattttcacaatttgattcactcattaccatcagcattaaacaatatttcttgcttaaggatagacggttgcaggggcactgtgggcgagtgttcagatggttaatgccttttattaccgcagtagatttttactattctcttccctccagctgctgaaggaaggttgggggctactgagctggggagaatgctggggtcagggaccagggtggggagtacatgcccgccggaaaggct

SEQ ID NO: 166517 - DNA, 569 bp, Homo sapiens
cacttttatcaaaaaataacaggccttggtgaaataaatactaactgttggatctgagtgacgggtacttggggattcattctattactctacttacacatgtttgaaacttcctatcataaaaaatctaaagtagattaaaagtaccatgaaaattattaagtattggaaggaatgatttacaacacatgctatgacttgaatgaatcttgaaaacattatgctacatggaaaaaggcagacacaaaaaggtcacatataatgtaattctttttatatgacatgtccagggtaggcaaatccagagtagcagaaagcaaattagtggctgccaggggatggagagatgggtagtggggagtgacttcttaatggatacagggtgtgtttctgagatgatgaaaaaattttgaaactagagagagatggtggtcatacaacattgtgaacacaccaaatgccactaaatgatagactttaacccatttatgcctagtgttccattattggaacgctaagcttgcaggagttatttatatcctactgttcaaggtcatcaccaaggtttg

SEQ ID NO: 166518 - DNA, 438 bp, Homo sapiens
tatttggaaatagtattctcgtctccagactaaacactcatccatttgtgcaacaagtattctttgaacattttctgtgaatcaggattgtcctagatgctggggagatacaagagagacaggcagggtacctgctgggatgtcctaggggggatggctagatcataagcatgtaaatgaacagaaagtggcagatagtagttagaagagaataaaacaggctagcagcatggtaggtattggctggaggtgccacactagataagagatcagataaggcttctctgagaaggtgacactgggactgaggcctgcaggacaacagagagccaccctggagggagtgttccaggcacagaatcatcaaggccctaaagcgggttgagctggatgtgttcagcaggcagaagggaggctgccggttcacgccatgaggcc

SEQ ID NO: 166519 - DNA, 404 bp, Homo sapiens
tgggagccaggaaaaagttccacctgcccaaaaaggtgtggccacgcgtttcatgctgctagagtgaggtgctacgaggtctgagaagtgaggacacagccagacagctggacttgcagacacagcagcctgatttcaggggccaaagaatgtgtccgagacccagaaacgaagccagcaaatgtaggtcgggaggagagagagggagagtgagcccgccagagggggtaggaggtggaaaagtttcaggcgcaaaactcttcaataggctgaaaaagattgagtgagggggaggactaggaaatacaggacaggtagaggtcccgagaaagcaagaggggacaggatacaaaccacaagtaagaagtagaaataatgaattgagatagcctcagagcttgggg

SEQ ID NO: 166520 - DNA, 506 bp, Homo sapiens
cagtcagaggattttcaaaggctgatttcagggttgatgcactcgactccccacctgctagacccggtgtggttacaagagtacaactatgaatgttacattctgtcaaggaaacaaaccgtgcaaagaaacgaaaaagaaaagaggtgctgggggttaggaagagggaggggagcgggaggaagtgccttgtggccgctactgtgattcggaggggttcaaactcatttcgctgacctggttaatataatccctgccgagttgacgctcgcccttgcaagaaacggctccgagcccgcagtcgggtttctcttcccctgaggcaggttcaaggctcccgcccctcccagccgcctcccctctgggctacctggagcctcagggaacctgcgcggccccgccccgcgggggcggccgagacctcggggcgcggagccgctgccgcgcctcctcccagcacccctgcccgactccctcctcctgctgccagtttcagctctcgaaaa

SEQ ID NO: 166521 - DNA, 291 bp, Homo sapiens
attgaaagagtacacattatgccaaccagctcttaccttcaatggagaaattcaggccagggcagcagcagaagtagaaagacctccactgtcactgaggtagagactctgaagggcgcgagattctgattgtgcctgtcctcacagtggagggaggcctttggagggccttttttgcctttgtagcaggcgggaacactcaggtctgtgactgtcaagcggaagctggtgaaggtcctccaactgtagatggctcaggatatagtactgaggtcattatctttagatttt

SEQ ID NO: 166522 - DNA, 298 bp, Homo sapiens
ggtctggccttccctctcagacttcagaggccccaaatccagcctgaaagtcccctctaagtatatttcctggtgggggtgcacatgtctttgaccttcacccatgaggagagtgatggttatcagcaagagcaaccttttaagcatttcaaaagcacttacagaaggaaaagcaagtgattctgaaagatgagaggactccaacttgctgttgaattctgggagtagagaccaggcctgagtctgcagatggctctggaggcaatgtggaggcagaatccttacttaggggtacagt

SEQ ID NO: 166523 - DNA, 518 bp, Homo sapiens
  misc_feature (24)..(24): n is a, c, g, or t
tcagaggatccccgatgagtaaancttggcaaatcacagtgggcaggtactctcaagccagaaatgccacaaagcagacacttttatttgacatccatgcaatgggaaaaagaactctgagcatcagataggagatcactggagagctggtgcaccagagcctacccacaatcagaagagagtgacgggaggagacagctgattttcaacatctcatcaagcctcatgaatgccctaaatcaggggtcagcaaacgtcttctgtaataggccagacagtaaacattttaggcctggcaggctttaaactgtgcccttgtactgcgaaaccagccatcgatgatatgtaaactaacgactgtagctgagttccaacagaactttatttacaagcgttaaatgtatattttacataattttcatgtgtcatgaaacattattctttgtagattttgttttctccacccatttaaaaatgtggaaactattcttggctcttgggccaagatttactcatcg

SEQ ID NO: 166524 - DNA, 598 bp, Homo sapiens
tttagagaaaatagtaaaagagcaaaacatggaggaaattgggagaaagttgaatactataggtgtttagtatctctaatgaaagctactctgttaacatttttaaattatgaaaataagagacttttataaaaaagtcaagcagtacaaaagggtgtaaagtgaagttactgtccttcccctccataaaccccctgaccttgggaaactgttgttaacagttactagggtaacttttcagatattttgtatgcatgtacaaatgtgagtatctaatgtaaaaaaatcaaaccaagataaagtgtaaactgctatgatggaatcctgccttgttctgctattagtcttctgtttagtaatcagctttggtattaggacagtggtaggaagaagccagtatgtcctgcaacataatttgtggttctggactggtcaggatttcctgaatgcagcctttatctggaagctctgcccttctccatctgggatacgctttttcatccatcaaaactgtcatctccctctgtgaagccttccctgactattctctgtccctctttcctctcttcccacaaacacaactgtgtacgcgtgtcac

SEQ ID NO: 166525 - DNA, 417 bp, Homo sapiens
gtggccaggggcccagagctcatcaaaacctgctcagtccaaggccttaggctgagcctgacatcgtgtcatattgtggaaacactcgttccctcattcagccaaatgctttttaaagcgactttttggccgggcacggtggctcacgcctgtcatcccagcactttgggaggccgaggtgggaggatcatttgaggtcaggagtgtgagaccagcctgaccaatatggtaaaaccctgtctctactaaaatacaaaaaaaaaaaactagcagggcatggtggtgtgcgcctgtaatcccagccactcaggaggctgaggcaggaaaatcacgtgaacccgggaggcggaggtttcagtgagccaagatcttaccactgcactccagcctgggtgacagagtgagactccgtctcga

SEQ ID NO: 166526 - DNA, 876 bp, Homo sapiens
ctgaccagcaccatggcggttggcaagaacaagcgccttacgaaaggcggcaaaaagggagccaagaagaaagtggttgatccattttctaagaaagattggtatgatgtgaaagcacctgctatgttcaatataagaaatattggaaagacgctcgtcaccaggacccaaggaaccaaaattgcatctgatggtctcaagggtcgtgtgtttgaagtgagtcttgctgatttgcagaatgatgaagttgcatttagaaaattcaagctgattactgaagatgttcagggtaaaaactgcctgactaacttccatggcatggatcttacccgtgacaaaatgtgttccatggtcaaaaaatggcagacaatgattgaagctcacgttgatgtcaagactaccgatggttacttgcttcgtctgttctgtgttggttttactaaaaaacgcaacaatcagatacggaagacctcttatgctcagcaccaacaggtccgccaaatccggaagaagatgatggaaatcatgacccgagaggtgcagacaaatgacttgaaagaagtggtcaataaattgattccagacagcattggaaaagacatagaaaaggcttgccaatctatttatcctctccatgatgtcttcgttagaaaagtaaaaatgctgaagaagcccaagtttgaattgggaaagctcatggagcttcatggtgaaggcagtagttctggaaaagccactggggacgagacaggtgctaaagttgaacgagctgatggatatgaaccaccagtccaagaatctgtttaaagttcagacttcaaatagtggcaaataaaaagtgctatttgtgatggtttgcttctgaaagaaaaaaaa

SEQ ID NO: 166527 - DNA, 625 bp, Homo sapiens
ttgctcaaggtgtaaggactgtggcctggggacactggcttatccctctgcaagacaggaccgctgaatggcaagacttatcaggatgtggcggccctgcttttattcttgagagcacggaagagaagcctctgagtgaactgctctagggacacacaccatgagtcacgctcagacccacggacgtgcacacaggaatgtgtcggggagcggaagtcggcacctctgagggctgccgttagcttcataaccacacggtgacgtccacgcactctcttcactgctggtcaccaacacaagtgctgcacacaaagaaaacggagcgggacctggggtcagctcccaatccccgaccctctggaaaagactgtcagctgtccgattacttcactgccggtggcaagtgctccaacccctgttctcacgttagctcagctgatgatgtgctccctaccaaggactctagagaagtgagaaaagccattccaagaagacattcctgcaatcagagcaccactcccatcttggaaatcactggcacagtacagagtcaaagagcccgtgtggcctgctgggctccagggcagggcacctgggagcaagtctcattatccctctctcccgt

SEQ ID NO: 166528 - DNA, 423 bp, Homo sapiens
ccggtttcacaaacctgaaggtaaatgggtaatttgtctgttgaatgagttttattaatagaatgcctttctgtgtgaatgctttggaatgtggattagtcttgggtccgtcctttccatctacctgatccaaatggaaaaatgcaaacacttaggtgtacacagcctctttttttttctttctccctttaagtgctttgtagtctaatgattccttcatatacttgactggtgtcatggactcctttgaagatttcaaatttacattttcatttatgaagtccctattttgcccttggttattgtttttgtttatatgttgaggccccatttcaatttctgtttaggaatagaaagatccatggtatattcacttaactgtaaatttgcttttagtaaaacataattcagccagaagaagga

SEQ ID NO: 166529 - DNA, 693 bp, Homo sapiens
ggctggccatggacgaggcgggactgagtgtcctggggtgagttagcagggcacaggtgtttgagatgggggacccttaattttaaactgaataggattcttttgggtgtggaattaatcctttctagatgtggaagagacctagaatgggaagaagctttagtattgcctggaaagcttccctcagagtttagttgctgggaccccaccctaagaacttgcttcagcctgtcgtctctcagtacgtatccatcacccggtctgagtaatgttatctccctgtgatctctcaagtcagtctgtttctctccatcttcactgccacagttcagcagcatcttcagctggagtactgcaaaagccccctacatttgtttcccatcttgcttccatcctccatgtcaaaaataatgcaaagagtttatgcataggagtttagacaaggatgtgtttactctaatttttcggttaaattcttagctcctaagtaaataaagtttcaaatttttcagacgtgtacttttctaataattgaatagcttctcaaatgtgaaatgacatataaaaaacatgatattcagttgcaaaccagaaatgcagttttttgtaggtagatgttcttgtaacactttttagaaaatgtaaaatataaaaataaagaaaaaaaagaccaaaaaaaagaacatgtaaaat

SEQ ID NO: 166530 - DNA, 305 bp, Homo sapiens
gcggccgcctactactactaaattcgcggccgcgtcgacataggagtttagacaaggatgtgtttactctaatttttcggttaaattcttagctcctaagtaaataaagtttcaaatttttcagacgtgtacttttctaataattgaatagcttctcaaatgtgaaatgacatataaaaaacatgatattcagttgcaaaccagaaatgcagttttttgtaggtagatgttcttgtaacactttttagaaaatgtaaaatataaaaataaagaaaaaaaagaccaaaaaaaagaacatgtaaaat

SEQ ID NO: 166531 - DNA, 408 bp, Homo sapiens
agatttatgggaagaaattagataatcaaaattctcctattaggaattttcccacccatcaaggtgagaaagagttgctgggaagctggaaaataaggatgttcaagttaaagtcagacagagacatcgaggtacatgctgtgtgctagaacagtctggcatggtggaagcctagggcacttgaaagggtgcaataataaatcaggctagaaggcagaacaaggcttagaatattaggttttttaggccattgcagtgtggacacttgaaagattttacacaacttaataagataattcaacctttatctgataaaggcaactgcagaaatatgtcagtctaaaataagaaagtctttctatttaacgtattaaaaaggaaatagggcgattgtcaaaattttataaa

SEQ ID NO: 166532 - DNA, 249 bp, Homo sapiens
gtattctcgctaacagtgctaaacggaactttgcatagtatatgcactaaagcttacttactcaatgaaataaacaacattagtaaggctggatgcagttgctcttgcctgtaatcccagctactcgggaggcggaggcaggagaatcgcttgaacccggcaggcagaggttgcggtgagctgagatcgtgccactgcactccagcctaggtgacagagtgagactctatctggaaaaaaaaaaaagaa

SEQ ID NO: 166533 - DNA, 502 bp, Homo sapiens
tggactccctgtgggtctaggtaggtaggggctgggtggacatgcagcctccgaggggtcctctagggcaactcctgccctctacagcattcccacagagtcaccttctcactattccaaggaacgcttccctcccactccgggacacagaccccagtcttctcagggacctgacaggagtggccaagggctcaaaatggcactggggtgggggcccactaaagaactctctaggtttctgggaacatgtaattcaaggacagcggccagactaactccttccacctatttttcacaacaaccctgcagagcaggaatttgtatctctgttaatcggatgagaaaactgaggctcagagaggtaaagtgacttgctcaaggttaccccaatagtaaacagtgtcgtgggatttgaagtcaggtctccctgatcgacaagtggtgtctcttgggtgtctggaagtagaaaagaagggcatccggccaagcctagctgcaattc

SEQ ID NO: 166534 - DNA, 483 bp, Homo sapiens
gtttaatatacccatgtaacaaacttgcacatgtaccctctgaacgtaaacttttaaaaaaaaatttaagaaaaaaaataataaataaataaaagaaggtggtggttgtttttcattctgcatgtacctatactaatttttttaaatctctccaggtctactgacctgaagttttaagatagtattagccatgattagctgtatttttaaaatcctattaatatatatctagtgggttacttttctaaataaaggaatagaaacaatattctgaggcttggaacagaaaaaagcaccacagagcctatttgtaattctagtcccccaaataccatattgaatcagttatatcagtaatatttggatgctcatattcaaccaatgctacatgttacaacctcagaagaacttgtatattaagagtgtacttttcagcccattaaggtgaagccacagtatgatttagttttgatctcacctaaa

SEQ ID NO: 166535 - DNA, 292 bp, Homo sapiens
tccctccctcctgtgcctgtccttgttagcctacattggtgagatgactccgcagcatacgatggctaatataatagtacaaactgaagaggagagaatggtaaagatgctttctgattctacaaatgcaaagaaagggcgtatgacacaataatgcagtgtgggcatgttttagcgctttctggtgcaaggggccaaggccacccaagattccatctttgcatttagctgacctcagaaattctattcaaatcaacaaatacccactgagtaaaggctgtgtcaagttcag

SEQ ID NO: 166536 - DNA, 346 bp, Homo sapiens
ccttcctgcagcacttctatgcttgaaggggaaggggctggcacacatcttctctgtgtggcctcctcctcctggccacacagcctttttcctggcccctttccttacactgttgacatgacaagggatctgaaaagggaataagtccaggttaaagcctcaaatggcacagatcaaaacccactctttctacaaaaatttgccgggcatggtggcgggggcctgtaatctcagctacttgggaggctgaggcaggagaatcgcttgaacctgggaagtggaggttacagtgagtcgagatcgcaccactgtactccagcttgggcaacagaacaatactccatct

SEQ ID NO: 166537 - DNA, 216 bp, Homo sapiens
aactaaaatgggcaaaatgatgaaagaatgagtgttttaattatgggtaagctgtgtccaagttggagggcagctttccactcagtgagagagatccaaaaaatgattctggctttgcatccatgaaaaattggcatgcacagtcacctaatctggaatcaactttttaatatgattggttttccatattgaaagagcattatatctgttaggtat

SEQ ID NO: 166538 - DNA, 330 bp, Homo sapiens
ctggaggaggctgtggaggctgtggtggctggtcacagccatttctcataggccatgctcttcgtctgtccctgacccatttgcaagtgtgtcaagcccctaactgtgtctcccagccccacctcctcctgcagtgactttcaaggctttagcttgtcccgttaccaattctaaagggtctaacctggaacccctcaggaagcctgttctcactttcctgcccgcaacccgcagggcctcatctcccagccccaaagtgtcaggcttcatggggaagccctaaccaccccctcccgacttgtacaccttggacttgacactcacccacag

SEQ ID NO: 166539 - DNA, 246 bp, Homo sapiens
ggttgagtttattatatctgaggcttgccctatcgctatgatacttaaacagtgtctgcttacgttgtgtattttgtaaaacaatgcaagtagaatttaaaaggacttagggaaatgaatgaagaaggtctacagtgatatggaaagacttctaccacaatgagtgaaaaacaggaggcaaacaaacaatgctgtgtgtggcttactgctatctatgtgcaaaagggaggaaatataaagtatagt

SEQ ID NO: 166540 - DNA, 710 bp, Homo sapiens
  misc_feature (2)..(3): n is a, c, g, or t
gnnacatgagcaagtattgcttatctagaaagacgtataataaagttcttttggggagataaactatgatccattctatgtttcatgtaaatcaggggcagccaatcttctggcttccttgggccacattggaagaattatcttgggccacacataaaatacactaacactaatgatagctgatgagtttttaaaaagaatcacaaaagcaatgttttagcaaagtttatgaatttgtgttgggctgcattcaaagctgtcctgggccgcaaggtggaaaaaacttgatctaaagtatttgatttttttagaaaagtttttgaatggccaggtgtggtggctcacacctgtaatcccagcactttgggaggccgaggcaggcggatcacgagatcgggagatcgagaccatcctggccaacatgctgaaactccatctctactaaaatacaaaaaaaaatcgaagacaagcagacggttggcgggcgccgtcggcccgaggaaaagttgtttctcacccgcattcgtgtgtgggccggggcgggccaccagatgggtgatcgtcacacctgcgcccaagggggtccctagggaagatcgcgcgcagaacacggggggggttcccccccataaaaaaaccgcgcgggggaacgcgcggttggaccaacacaaggggtccgggcatacgggccacacagggccagagcgaaa

SEQ ID NO: 166541 - DNA, 491 bp, Homo sapiens
gagaatgattttatttaagtaatttctactttttacatagctagttttaaagtagataatacatagtcttaaactttatttcccctttatttctttcttttctgttagagaatttcttaaacttgtagaattatccaaataaaatgccagtcactaaaaaggaataattaaccaatagtgggaaaaaattaaattcttcaaatgaagagtactgtattcatttcatatggtcccagagataaaatgtttaggattcatttttagttttaaatgtttatgaatcagagcttcaacactcttccaggtttctttaagaaaggaatttgtctatctacggattaattaattagcagagcctctctgtgtcaccaagactggagtgcagtggtgcggctgtagctcactacagccttgaactcttgggctcaggcaaccttcccacgttagactcccaaatagctagaccatggtgcatgcaaccatgcccagct

SEQ ID NO: 166542 - DNA, 332 bp, Homo sapiens
agggcggggccaggtggagataattgaatcataggtgaggtttcccccatactgttctcatagtagtgaataagtctcatgagatctgatgattttataaatgggagttctcctgcacaagcctttttgcttgccaccatgtaagacgtgactttgctcttcattcaccttctgccatgattgtgaggcctccccagccatgaagaactgtgagtcaattataaattacccagtctttggtatgtctttattagcagcataagaacagacaaatacaattagcaataaaaataagaaaatgaaatactaaaaatagtaacacaacataacca

SEQ ID NO: 166543 - DNA, 241 bp, Homo sapiens
gaaaataaaaaaagaaaatgacaaagacatcacatgacaaactgataaagagcatgctgctgctctttgctacagggaacatctctgttttagtatgtgttagtagaaccgatagtcactggaaatgcaaaataccgaacaatgagtttatctattaacatgggtttataggggccaggcacggtggctcacgcctgtaatcccagcactgtgggaggccaaggtagacagatcacaaggt

SEQ ID NO: 166544 - DNA, 137 bp, Homo sapiens
tttgctttataaagaattttgccagaaaggggggaaaaatgttttttgtctggagacctggccttcttcacctaattcataatgtcttctaattttagtggaattattccaaaagagatgatatctggctggagcat

SEQ ID NO: 166545 - DNA, 409 bp, Homo sapiens
ggaatcaggcaggtgtatggagccgggtgactcatggaggaggaggggttccacctggaagggacactccctggtctctctccacatagctaatgtgagtcaccacattcctggctccctgcctgacttgcttccgggtcaaccacggaaccccagggccacctggggttgggcctgctccagctgttcccttcggagccttgccctgcttgctttgcacttgttagaagagggagcaggtacttccccgcagggacctgtgtctgccttcagctgtctaaattccatggagaaggcctggagatccatggggaaaactcctttcattctgggatggtctggcctggaagcccggagcagcttcctcaaccccgccgccctccccttttccctgccttgtacccaagga

SEQ ID NO: 166546 - DNA, 326 bp, Homo sapiens
cctggtctgaaactgactttgaaaagggaaatgtatggcttttgaattgagggatggaatctcctagcctggagataattaaataaggcttagatctccctctctcccttcacgcatttcctgaatacctagaacatgccagacactggagctacaaaatgaattaaataaaacatgtctatctttttctatctccataatgttcatgctggaaactgccctttttctgtttcattggatcaagttcaaatcttagcaggtcacttgtaactctgactctgggcacattgtgccacctttctgagccctagttttcttatgcatac

SEQ ID NO: 166547 - DNA, 123 bp, Homo sapiens
taacaccgggactctggccggtgggattcccgctgtatcctgtgtgtgtacgtgtgtgcatgttgcatcccctgcatacagtcaccctgccgacctcatgcgaacacaccctagagcggcaat

SEQ ID NO: 166548 - DNA, 95 bp, Homo sapiens
cctccccagcaggccaccctggggacagcactcccccaaggacctgaccagggaacccttgtttttgcagcgcacatctcagcagctctatttcc

SEQ ID NO: 166549 - DNA, 384 bp, Homo sapiens
ggtacataaacagtgctggctactggcattgtaactctgtgttatctattcctaatacaaaattacagagctactgcttaaaaggaaataaggtattgattatatctaaaacaaggtatttaaaaaccgataaaacattgacctaagcacaacaggataagaagctaccctctgcactgtctgattaggttgagaaaataggtctttccacacctcttgctaaattagtaagagacgacagcgagctcagagggaactttgggccctggatgttagtaacagggaaacagggagaaacaaaatcaccacagtgacatttggttgccaaagatgcaatattatgaaaatgaacaatgttgagggtctcagaagtgctttttcttg

SEQ ID NO: 166550 - DNA, 397 bp, Homo sapiens
ccagaagggcctggagcctggacccccactgtgaagccagcacctcctccttgctgggtgacccagactcagttacctaacctccctggacctccattgcctcacctggaacacctgcttcccaggcgaagggttaagcgggcgctccaaagcaggtcctgggcaaagagggaagggattcctgcggtgcccgggaacgtggggcattaggggaaagggtgtgaagtttgacaccggagatcccccacgggggccgacttcgggcgtggcattccaggcaactcacagatcctgggccttccctcgcctcagggtccgggcctggggcggcgctggccggggcgggcgggcggcgggcaagacgctacctgcgcgcgtgccgggcattccagccgcc

SEQ ID NO: 166551 - DNA, 287 bp, Homo sapiens
gaaatgtccagaataggcaaatccataaagacagaaagaagattaagggctgcttagggctgggggatgagtagaggaggaaatgaggagtaactgctcatggatacaggatttcttctgggcataattaaatgttctgaaattgcagtgatgattgcacaactctgtgaacacaaaaaacaattgaattgtacaatttaagtaggtaaattatatgatatgtgaattgtatctcaataaagctgttataaaaccaaacaaaaggccggatgcggtggctcatgtct

SEQ ID NO: 166552 - DNA, 408 bp, Homo sapiens
gggagttgtgtttgtattgttaattttggaagtagtgttttatatcagcaatttaaaaggagaaggttgggacagaaagtgagagagtgaaagagagaaagtggtggatttgataaggagcaaggtaataatgttgcataaaaatgtgatgtcccttctcttcaaccctctaccctctggcctttatgattctcatttatttaatcacttgttttatttgcaatgttgaaatatccctattcccttcagggttctgcagaaaacttttgaacttatttatgacctgttaacttaaaaaaaaatccgagagctcagagtacttccgtactccagtctgatcaggtcttttaaaagataacagaagcgagctatttataaatatacatatgaggtgctgatttaaaatct

SEQ ID NO: 166553 - DNA, 124 bp, Homo sapiens
tctttcctgcccaccagcctgggctgtgggcccccaaagacaatagaccagctggtgaccgttagcagctgatacagtgccctgcctgcaatccctaaccctcaatttctgggataactagggg

SEQ ID NO: 166554 - DNA, 231 bp, Homo sapiens
agcaaggaaaggcaatgacagccagtgagatgccggcgagaagctgaagggagcccaggcagcagcatatatgtggcaagtccagacttggtagagtgagccggtggaggcaggagcagttcgtgggactggcccagccttaagcttggcacagtgactacacccagaagccatgccgggagcttaccgtcttcctggaggagaggaaggggtaggcagtagagaaaatgg

SEQ ID NO: 166555 - DNA, 323 bp, Homo sapiens
ttactaagaaagttttgtggttatcattttgacaataaacttcagctagcatagtccctactattcatgttaataatatcttgacttgaaccatcatattttccccacatcattcacaatgcatttcaatgctgtaacccactgcaccatccccagcccttttatcttcacaacgttctctaataaggtaaacaggatcatacatcatcaaacatatgtcacagacagaaaagctgacacacagacaagttaaataatttaagtcaaaccaaaaaaaaatcataactgggattagagcttgagattccctattttcttacagt

SEQ ID NO: 166556 - DNA, 1349 bp, Homo sapiens
cctctccccccgggctccgcccaccccacgccgggaacccacgcgggccactacaagcccgccctttcctacgtctggtccagtcggtcttcctccggcccgggccctggcccagctagccggccatggaaggtaatggccccgctgctgtccactaccagccggccagccccccgcgggacgcctgcgtctacagcagctgctactgtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggattaccatgttgttttgcttcatgtttcaagtggaggacagaacttcatttatgatctcgatactgtcttgccatttccctgcctctttgacacttatgtagaagatgcctttaagtctgatgatgacattcacccacagtttaggaggaaatttagagtgatccgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggtacagttggcttggaattatgtctttctcttttaatttgattgagtggaaatctgagtgaatacaaatataaatgaacaacataaaaacttttgttttgacatgtcaaattgaaacttgataaagtgcgtacttgctaagatattcctgtggctcatgcgttacaacacgaggacttaagccagtaatcgtttttgttcagatagaggtgtggaggtagagccagcccctcatgtctgttttggatgttttgtgtctctccagctacattgtaagttccttgagggcagggccatggcccattgctctgtgaatctcaaatgcccataaaaggtgcccataaaatgttttcttgaacatttgaatgtgctgttgtctggaaaggggtaatattgtgagctgaatcagcaataagtattagtctttttggactatggtattgttaaaaagactgcagccctctcagacttgagcgttaattggcttatttatttatggctttaaataaaatcgatttaacgtta

SEQ ID NO: 166557 - DNA, 599 bp, Homo sapiens
ggaagtgtgtgtgccacttacatgactgacctgtgaaactcgtgcccactccttcacacctttgcctactttcttaccagatgaaatggtgatgactggagtgacctcggaagctacttatcaaaggcagaagagccaccatcagcctggattcctgataactctatggagccgagttgcatgcctgcctaaatagtatattgtggaactctttcataggagacaaacttatgtattttttaagtcacagaattcttgattacgaagcggacactcaaagaggtcccccagctagtaagtggccaaagtgggattcatttgactgtttgactccagagctcatgcattcatgggcatggctacagtttgaaagcaagttgcagatatcatgagacttcacctataaatacttcagaaggatttcctaagaaagatattcttctgctttatgatgatattattatcacgtctaagaaacttaacattgatgcaacaatgatgtctaatatgtggtctgtattcaaacttctccagatatccccaagatgttctttattgctttttttggtttcaatccaaaataaattttgtgttctctt

SEQ ID NO: 166558 - DNA, 1229 bp, Homo sapiens
tggctgtacggcgagttttagatcctacgtctggtccagtcggtcttcctccggcccgggccctggcccagctagccggccatggaagtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggattaccatgttgttttgcttcatgtttcaagtggaggacagaacttcatttatgatctcgatactgtcttgccatttccctgcctctttgacacttatgtagaagatgcctttaagtctgatgatgacattcacccacagtttaggaggaaatttagagtgatccgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggtacagttggcttggaattatgtctttctcttttaatttgattgagtggaaatctgagtgaatacaaatataaatgaacaacataaaaacttttgttttgacatgtcaaattgaaacttgataaagtgcgtacttgctaagatattcctgtggctcatgcgttacaacacgaggacttaagccagtaatcgtttttgttcagatagaggtgtggaggtagagccagcccctcatgtctgttttggatgttttgtgtctctccagctacattgtaagttccttgagggcagggccatggcccattgctctgtgaatctcaaatgcccataaaaggtgcccataaaatgttttcttgaacatttgaatgtgctgttgtctggaaaggggtaatattgtgagctgaatcagcaataagtattagtctttttggactatggtattgttaaaaagactgcagccctctcagacttgagcgttaattggcttatttatttatggctttaaataaaatcgatttaacgtta

SEQ ID NO: 166559 - DNA, 1410 bp, Homo sapiens
tggctgtacggcgagttttagatcctacgtctggtccagtcggtcttcctccggcccgggccctggcccagctagccggccatggaaggtaatggccccgctgctgtccactaccagccggccagccccccgcgggacgcctgcgtctacagcagctgctactgtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggattaccatgttgttttgcttcatgtttcaagtggaggacagaacttcatttatgatctcgatactgtcttgccatttccctgcctctttgacacttatgtagaagatgcctttaagtctgatgatgacattcacccacagtttaggaggaaatttagagtgatccgtgcagattcatatttgaagaactttgcttctgaccgatctcacatgaaagactccagtgggaattggagagagcctccgccgccatatccctgcattgagactggaggcatcaatccagttgataatttcctgacatttaagaagataaagggtccttcaccctattactattgtttggcattcatatgagtttgaagtattatttacgtttattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggtacagttggcttggaattatgtctttctcttttaatttgattgagtggaaatctgagtgaatacaaatataaatgaacaacataaaaacttttgttttgacatgtcaaattgaaacttgataaagtgcgtacttgctaagatattcctgtggctcatgcgttacaacacgaggacttaagccagtaatcgtttttgttcagatagaggtgtggaggtagagccagcccctcatgtctgttttggatgttttgtgtctctccagctacattgtaagttccttgagggcagggccatggcccattgctctgtgaatctcaaatgcccataaaaggtgcccataaaatgttttcttgaacatttgaatgtgctgttgtctggaaaggggtaatattgtgagctgaatcagcaataagtattagtctttttggactatggtattgttaaaaagactgcagccctctcagacttgagcgttaattggcttatttatttatggctttaaataaaatcgatttaacgtta

SEQ ID NO: 166560 - DNA, 1305 bp, Homo sapiens
tggctgtacggcgagttttagatcctacgtctggtccagtcggtcttcctccggcccgggccctggcccagctagccggccatggaaggtaatggccccgctgctgtccactaccagccggccagccccccgcgggacgcctgcgtctacagcagctgctactgtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggattaccatgttgttttgcttcatgtttcaagtggaggacagagcttcatttatgatctcgatactgtcttgccatttccctgcctctttgacacttatgtagaagatgccattaagtctgatgatgacattcacccacagtttaggaggaaatttagagtgatctgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggtacagttggcttggaattatgtctttctcttttaatttgattgagtggaaatctgagtgaatacaaatataaatgaacaacataaaaacttttgttttgacatgtcaaattgaaacttgataaagtgcgtacttgctaagatattcctgtggctcatgcgttacaacacgaggacttaagccagtaatcgtttttgttcagatagaggtgtggaggtagagccagcccctcatgtctgttttggatgttttgtgtctctccagctacattgtaagttccttgagggcagggccatggcccattgctctgtgaatctcaaatgcccataaaaggtgcccataaaatgttttcttgaacatttgaatgtgctgttgtctggaaaggggtaatattgtgagctgaatcagcaataagtattagtctttttggactatggtattgttaaaaagactgcagccctctcagacttgagcgttaattggcttatttatttatggctttaaataaaatcgatttaacgtta

SEQ ID NO: 166561 - DNA, 937 bp, Homo sapiens
  misc_feature (815)..(815): n is a, c, g, or t
  misc_feature (822)..(822): n is a, c, g, or t
  misc_feature (825)..(825): n is a, c, g, or t
tggctgtacggcgagttttagatcctacgtctggtccagtcggtcttcctccggcccgggccctggcccagctagccggccatggaagtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggctgacccccagaagcctcctttgttactagtttggagcagatccttgcagacgttttcctctgcattcacatgcatgcaaatgtacttctgaatgcgcacgattaccatgttgttttgcttcatgtttcaagtggaggacagaacttcatttatgatctcgatactgtcttgccatttccctgcctctttgacacttatgtagaagatgcctttaagtctgatgatgacattcacccacagtttaggaggaaatttagagtgatccgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggaggggtgnaatatgnttntcttttattgtagaggattggtgtatcaattactgaaactaaattgttgactggcatcgatgaaacgggtggaacgcgtaggaagagaaagcatgtgaataggggcaccttg

SEQ ID NO: 166562 - DNA, 1152 bp, Homo sapiens
tggctgtacggcgagttttagatcctacgtctggtccagtcggtcttcctccggcccgggccctggcccagctagccggccatggaaggtaatggccccgctgctgtccactaccagccggccagccccccgcgggacgcctgcgtctacagcagctgctactgtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggattaccatgttgttttgcttcatgtttcaagtggaggacagaacttcatttatgatctcgatactgtcttgccatttccctgcctctttgacacttatgtagaagatgcctttaagtctgatgatgacattcacccacagtttaggaggaaatttagagtgatccgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaagatgaaatggtgatgactggagtgacctcggaagctacttatcaaaggcagaagagccaccatcagcctggattcctgataactctatggagccgagttgcatgcctgcctaaatagtatattgtggaactctttcataggagacaaacttatgtattttttaagtcacagaattcttgattacgaagcggacactcaaagaggtcccccagctagtaagtggccaaagtgggattcatttgactgtttgactccagagctcatgcattcatgggcatggctacagtttgaaagcaagttgcagatatcatgagacttcacctataaatacttcagaaggatttcctaagaaagatattcttctgctttatgatgatattattatcacgtctaagaaacttaacattgatgcaacaatgatgtctaatatgtggtctgtattcaaacttctccagatatccccaagatgttctttattgctttttttggtttcaatccaaaataaattttgtgttctctt

SEQ ID NO: 166563 - DNA, 1269 bp, Homo sapiens
cctctccccccgggctccgcccaccccacgccgggaacccacgcgggccactacaagcccgccctttcctacgtctggtccagtcggtcttcctccggcccgggccctggcccagctagccggccatggaagtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggattaccatgttgttttgcttcatgtttcaagtggaggacagagcttcatttatgatctcgatactgtcttgccatttccctgcctctttgacacttatgtagaagatgccattaagtctgatgatgacattcacccacagtttaggaggaaatttagagtgatctgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggatgaaatggtgatgactggagtgacctcggaagctacttatcaaaggcagaagagccaccatcagcctggattcctgataactctatggagccgagttgcatgcctgcctaaatagtatattgtggaactctttcataggagacaaacttatgtattttttaagtcacagaattcttgattacgaagcggacactcaaagaggtcccccagctagtaagtggccaaagtgggattcatttgactgtttgactccagagctcatgcattcatgggcatggctacagtttgaaagcaagttgcagatatcatgagacttcacctataaatacttcagaaggatttcctaagaaagatattcttctgctttatgatgatattattatcacgtctaagaaacttaacattgatgcaacaatgatgtctaatatgtggtctgtattcaaacttctccagatatccccaagatgttctttattgctttttttggtttcaatccaaaataaattttgtgttctctt

SEQ ID NO: 166564 - DNA, 303 bp, Homo sapiens
ctcatttaatcctctttgatatgagtcctgttatcattcccacttcacagattacgaagcggacactcaaagaggtcccccagctagtaagtggccaaagtgggattcatttgactgtttgactccagagctcatgcattcatgggcatggctacaggtacccttctcttcactccttccccaagcatgcccccaattcaccagaattgaaactcaagattttgacaccatagagagcaaactggggaacaggaactacactgttggttaggacttgggagaagataaattaaaaagtctgac

SEQ ID NO: 166565 - DNA, 1305 bp, Homo sapiens
tggctgtacggcgagttttagatcctacgtctggtccagtcggtcttcctccggcccgggccctggcccagctagccggccatggaaggtaatggccccgctgctgtccactaccagccggccagccccccgcgggacgcctgcgtctacagcagctgctactgtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggattaccatgttgttttgcttcatgtttcaagtggaggacagaacttcatttatgatctcgatactgtcttgccatttccctgcctctttgacacttatgtagaagatgcctttaagtctgatgatgacattcacccacagtttaggaggaaatttagagtgatccgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggtacagttggcttggaattatgtctttctcttttaatttgattgagtggaaatctgagtgaatacaaatataaatgaacaacataaaaacttttgttttgacatgtcaaattgaaacttgataaagtgcgtacttgctaagatattcctgtggctcatgcgttacaacacgaggacttaagccagtaatcgtttttgttcagatagaggtgtggaggtagagccagcccctcatgtctgttttggatgttttgtgtctctccagctacattgtaagttccttgagggcagggccatggcccattgctctgtgaatctcaaatgcccataaaaggtgcccataaaatgttttcttgaacatttgaatgtgctgttgtctggaaaggggtaatattgtgagctgaatcagcaataagtattagtctttttggactatggtattgttaaaaagactgcagccctctcagacttgagcgttaattggcttatttatttatggctttaaataaaatcgatttaacgtta

SEQ ID NO: 166566 - DNA, 1330 bp, Homo sapiens
tggctgtacggcgagttttagatcctacgtctggtccagtcggtcttcctccggcccgggccctggcccagctagccggccatggaagtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggctgacccccagaagcctcctttgttactagtttggagcagatccttgcagacgttttcctctgcattcacatgcatgcaaatgtacttctgaatgcgcacgattaccatgttgttttgcttcatgtttcaagtggaggacagaacttcatttatgatctcgatactgtcttgccatttccctgcctctttgacacttatgtagaagatgcctttaagtctgatgatgacattcacccacagtttaggaggaaatttagagtgatccgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggtacagttggcttggaattatgtctttctcttttaatttgattgagtggaaatctgagtgaatacaaatataaatgaacaacataaaaacttttgttttgacatgtcaaattgaaacttgataaagtgcgtacttgctaagatattcctgtggctcatgcgttacaacacgaggacttaagccagtaatcgtttttgttcagatagaggtgtggaggtagagccagcccctcatgtctgttttggatgttttgtgtctctccagctacattgtaagttccttgagggcagggccatggcccattgctctgtgaatctcaaatgcccataaaaggtgcccataaaatgttttcttgaacatttgaatgtgctgttgtctggaaaggggtaatattgtgagctgaatcagcaataagtattagtctttttggactatggtattgttaaaaagactgcagccctctcagacttgagcgttaattggcttatttatttatggctttaaataaaatcgatttaacgtta

SEQ ID NO: 166567 - DNA, 1406 bp, Homo sapiens
tggctgtacggcgagttttagatcctacgtctggtccagtcggtcttcctccggcccgggccctggcccagctagccggccatggaaggtaatggccccgctgctgtccactaccagccggccagccccccgcgggacgcctgcgtctacagcagctgctactgtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggctgacccccagaagcctcctttgttactagtttggagcagatccttgcagacgttttcctctgcattcacatgcatgcaaatgtacttctgaatgcgcacgattaccatgttgttttgcttcatgtttcaagtggaggacagagcttcatttatgatctcgatactgtcttgccatttccctgcctctttgacacttatgtagaagatgccattaagtctgatgatgacattcacccacagtttaggaggaaatttagagtgatctgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggtacagttggcttggaattatgtctttctcttttaatttgattgagtggaaatctgagtgaatacaaatataaatgaacaacataaaaacttttgttttgacatgtcaaattgaaacttgataaagtgcgtacttgctaagatattcctgtggctcatgcgttacaacacgaggacttaagccagtaatcgtttttgttcagatagaggtgtggaggtagagccagcccctcatgtctgttttggatgttttgtgtctctccagctacattgtaagttccttgagggcagggccatggcccattgctctgtgaatctcaaatgcccataaaaggtgcccataaaatgttttcttgaacatttgaatgtgctgttgtctggaaaggggtaatattgtgagctgaatcagcaataagtattagtctttttggactatggtattgttaaaaagactgcagccctctcagacttgagcgttaattggcttatttatttatggctttaaataaaatcgatttaacgtta

SEQ ID NO: 166568 - DNA, 1295 bp, Homo sapiens
cctctccccccgggctccgcccaccccacgccgggaacccacgcgggccactacaagcccgccctttcctacgtctggtccagtcggtcttcctccggcccgggccctggcccagctagccggccatggaaggtaatggccccgctgctgtccactaccagccggccagccccccgcgggacgcctgcgtctacagcagctgctactgtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggattaccatgttgttttgcttcatgtttcaagtggaggacagaacttcatttatgatctcgatactgtcttgccatttccctgcctctttgacacttatgtagaagatgcctttaagtctgatgatgacattcacccacagtttaggaggaaatttagagtgatccgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggtacagttggcttggaattatgtctttctcttttaatttgattgagtggaaatctgagtgaatacaaatataaatgaacaacataagatattcctgtggctcatgcgttacaacacgaggacttaagccagtaatcgtttttgttcagatagaggtgtggaggtagagccagcccctcatgtctgttttggatgttttgtgtctctccagctacattgtaagttccttgagggcagggccatggcccattgctctgtgaatctcaaatgcccataaaaggtgcccataaaatgttttcttgaacatttgaatgtgctgttgtctggaaaggggtaatattgtgagctgaatcagcaataagtattagtctttttggactatggtattgttaaaaagactgcagccctctcagacttgagcgttaattggcttatttatttatggctttaaataaaatcgatttaacgtta

SEQ ID NO: 166569 - DNA, 1175 bp, Homo sapiens
tggctgtacggcgagttttagatcctacgtctggtccagtcggtcttcctccggcccgggccctggcccagctagccggccatggaagtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggattaccatgttgttttgcttcatgtttcaagtggaggacagaacttcatttatgatctcgatactgtcttgccatttccctgcctctttgacacttatgtagaagatgcctttaagtctgatgatgacattcacccacagtttaggaggaaatttagagtgatccgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaaggtaggatggggcgccgtctacacactatccgaatttacacatcggtttggcagtaaaaactgctgaacttggtctcaagatgtggaactgtggagaaattctaggacatgaacaagctatcctttcatcgaggacagcaaacattatggtacagttggcttggaattatgtctttctcttttaatttgattgagtggaaatctgagtgaatacaaatataaatgaacaacataagatattcctgtggctcatgcgttacaacacgaggacttaagccagtaatcgtttttgttcagatagaggtgtggaggtagagccagcccctcatgtctgttttggatgttttgtgtctctccagctacattgtaagttccttgagggcagggccatggcccattgctctgtgaatctcaaatgcccataaaaggtgcccataaaatgttttcttgaacatttgaatgtgctgttgtctggaaaggggtaatattgtgagctgaatcagcaataagtattagtctttttggactatggtattgttaaaaagactgcagccctctcagacttgagcgttaattggcttatttatttatggctttaaataaaatcgatttaacgtta

SEQ ID NO: 166570 - DNA, 892 bp, Homo sapiens
tggctgtacggcgagttttagatcctacgtctggtccagtcggtcttcctccggcccgggccctggcccagctagccggccatggaagtgaagaaaatatttggaagctctgtgaatacatcaaaaaccatgaccagtatcctttagaagaatgttatgctgtcttcatatctaatgagaggaagatgatacctatctggaaacaacaggcgagacctggagatggacctgtgatctgggattaccatgttgttttgcttcatgtttcaagtggaggacagaacttcatttatgatctcgatactgtcttgccatttccctgcctctttgacacttatgtagaagatgcctttaagtctgatgatgacattcacccacagtttaggaggaaatttagagtgatccgtgcagattcatatttgaagaactttgcttctgaccgatctcacatgaaagactccagtgggaattggagagagcctccgccgccatatccctgcattgagactggagattccaaaatgaacctgaacgatttcatcagtatggatcccaagatgaaatggtgatgactggagtgacctcggaagctacttatcaaaggcagaagagccaccatcagcctggattcctgataactctatggagccgagttgcatgcctgcctaaatagtatattgtggaactctttcataggagacaaacttatgtattttttaagtcacagaattcttgtctgttgtccaggctggagtgcagttgcgtgatcccggctcactgcaagctccgcctcctgggttcaagtgatcctcagcctccctcagctggaactacaggcatgcaccaccatgcccggctaatttttgtatttttagtgagatggggttccgcc

SEQ ID NO: 166571 - DNA, 738 bp, Homo sapiens
tggctgtacggcgagttttagatcctacgtctggtccagtcggtcttcctccggcccgggccctggcccagctagccggccatggaaggtaatggccccgctgctgtccactaccagccggccagccccccgcgggacgcctgcgtctacagcagctgctactgtgaagaaaatatttggaagctctgtgaatacatcaaaaaccatgaccagtatcctttagaagaatgttatgctgtcttcatatctaatgagaggaagatgatttgattgagtggaaatctgagtgagtacaaatataaatgaacaacataaaaacttttgttttgacatgtcaaattgaaacttgataaagtgcgtacttgctaagatattcctgtggctcatgcgttacaacacgaggacttaagccagtaatcgtttttgttcagatagaggtgtggaggtagagccagcccctcatgtctgttctggatgttttgtgtctctccagctacactgtaagttccttgagggcagggccatggcccattgctctgtgaatctcaaatgcccataaaaggtgcccataaaatgttttcttgaacatttgaatgtgctgttgtctggaaaggggtaatattgtgagctgaatcaccaataagtattagtctttttggactatggtattgttaaaaagactgcagccctctcagacttgagcgttaattggcttatttatttatggctttaaataaa

SEQ ID NO: 166572 - DNA, 474 bp, Homo sapiens
gcccagagtagccgtggataatctattttaaggtcagatgattagcaatcttaatgccatctgtagccttcattctcctttctccctttgctaattcacatattcacaggtttcacagataagcacacgtacatattgtgttgtgggggtattattctgcccccaggtcttatagccaaagcctccaatagagtgttgattaggaacttctggtatttattagtcgtcttctggacattcacgaaaataattttacaaatttatcattcttaaggtatttgtcatagataccttttggtagttatatattattatataagttttctacttctttttttttttttttttagtagagacaggttttccccatgttgcccaggctggtctggaactcttggcctcaagtgatccgcccacctcagcctcccaaagtgtgggattacaggcatgagtcaccacaccgtggccagaaag

SEQ ID NO: 166573 - DNA, 1219 bp, Homo sapiens
attgacttacatcctcaccagcagtgtgtgggagctccagcagctccacgtcttggttagcacttggtgttgtcagtttttttaatattggccattctggtggtacccaggaatttgaatccatagttcctgacttgaaatcagggcccttcttacttttagcatgctcaagacaggtttgaattttgtagcctcgaatggcctcagaaatcaatacccaggacccacaatacagcaggcaagcatatgagggagcccctgctcatggctccagtgcctagggagggtctcagagaggcatcagctctggagaggcagtctagcgtagtggcgaaaactcaggttctgggaagcaagcagctaaggttcagatcccagctctgccatcgcaaagctgcctcggggtggaacattagtacctacctcacagggtgatcatgagaattaaaagaataggtggatatgaaataatagtgccttacacatgataaatgctatataaatgatagctgctgctctttctattgttgacctgaagtaagccctgagtccccctggagcgggggtaaggccacaagcagatggcatctggcatagccccatgtaataagattcagtaatccggtctgactgaggcggggggaaaagtagcatagtggctagaagtgattctttactggggcccagcgaaaagtcaccctccactactggggagcccctgcttatcccaggcccaaggctctttggccagtgacactactgaggtgtcacacctgaggggaagaaatggaatcatgcatgaaatggaaccaagaggaagtggaagcatactcttagcccagagctagatgcaaagcagctgtttgaatataacaacccaccagtgcagacacagatctagacatgtacctgtatagcagccaatgaggggtggcatgagggacaagggcctgggattcaggagccctaagtgttggtctgagcactgccaccagctatatgtgacctgaggccttgtgaagtggaagttagaagaaatcacagttcccagctcaaatcctgaagaagtagcaatgaacaggtagagtttcctcccagagccctaagccaggtgtggtgcacgtgcctgcaatcccatctgctcgggaggctgaggcaggaggatcgcttgagcccaggagttcaaatccagcctgggcaacataatgggagcctctta

SEQ ID NO: 166574 - DNA, 530 bp, Homo sapiens
tgcatggctcatgcacctagaaggtcacaaaataaggaaacagaatgtagacgaggggtcagcctctaaaagcgaagaaagtttcgttattgggaaatcgaaacttaagtggggaaggggaccagggtataaccttataaggcggataatgagacttaggtgacatcagagaagattgtaaccccagagtactcgaccaatggggaactgggggagggacttgtgtgctaggagataaattatctgttgtagctggcctgggtgtgcctgcccaccagacaccccatcttgcaagatcgctattaaaataagtctcacttttgctgttctttgtgcctctaagtccattctttgggtttggatgggtgagtgtgtttctcacagacccatctgatactcaaaaatattttaaaggtattagtaaccatgagcatttataaaaaatctgattacttacctagtggcaagacaatttaaacacattttgtaaaaactgagactttatgatgcacattctcacatcaagattc

SEQ ID NO: 166575 - DNA, 236 bp, Homo sapiens
ttgctcttgaagttggagaatgcaagaaaatgtattttactagagcctgcagaagaatgcaaccttgccaacaccctggttgtagcccagtgagacccttttcagacttctgacctctagaactgtaagataaatttgtgttgttttaagaacccaaaatatgtgtaacttgttatagtagcagtaggaaactaatagacttactgaggtgccaaggttgctgtggcagatgtggc

SEQ ID NO: 166576 - DNA, 416 bp, Homo sapiens
tcagtctctcccacgctcaagccatccttaccttaccaagccatgcccattccagcagatgcagtccagttccagtacctccccctcactgtaatgcataaaggctctgacttttctaacaactgcccaaaggggctgtgtacataatccagaagtgtatgcggttaagcctcatagaatatgggctcctaaccataccctgcctttcactttcattggaaagagaacaggcaatatggagcctaataaactctcagtggagattcccagccagtacacttaccatatcaattaacaatgaataattactgttcactttcactggaaaggcaggatatggtcaggagatcataaataaattccttgcccttcctcttccaaacaaacttttctgagacacagtgatcccaaacagt

SEQ ID NO: 166577 - DNA, 364 bp, Homo sapiens
cctttgcaagaaaacccctttgccttacacaaagtaaatgcttaataaatagtagctgttattaaatttgaatgaatgaaaggaagcttagagtcgtaacacaaatgcaccgtggatctcaggttgagtgtaagttacattttctatcctggcaagtgacatgacttattctttcttcttcccaaatcatggtagcatttttaatctctctttctctacttgctttttctcatgtatctaaaacctaaataaacctttcttctgggccatgccacaccagatgcccacctgctaggttatctctcctccactgcttattctctcgaaataatacacttactgcctctacttctgactaactcat

SEQ ID NO: 166578 - DNA, 208 bp, Homo sapiens
ggatcacttgaacccaggaattcgaggctgcagtgaactatgatcatgccactgtactccagcctgagtgccagaatgagacctcatctcttaaattaagaaatacttggattagcaaaaacgaataattactgcataatgcccatgagatagagtcacaacaccttttgcctctctttttagtttttctgattattttgctagttta

SEQ ID NO: 166579 - DNA, 219 bp, Homo sapiens
gagcactgccccagaatgctaggaacagagccttgaaatggttctgcccccaacaccctgggccttctgggcctgtgatgggggtgacagcccccacatgccttctgtgccccctttctttttcttttattttgagagatggtgtctcactctgttgcccaggtcggagtgcagtggtgccctgagagctcacggcagccttgtcctctcaggctcaag

SEQ ID NO: 166580 - DNA, 178 bp, Homo sapiens
ccttcaccgtctcagtcctttccccagaggcaaccctttttgtaaatttgttgcatattcactgtgaggcagtatttctgctgtgttgtttagttttaaggctcacgtctccttcatggtgatctgtttttcattttaacttcttcctttatcattgggttgtctatcacctctgtcc

SEQ ID NO: 166581 - DNA, 605 bp, Homo sapiens
attttattttctgttgatttttttttcgaaggtaggattatgaactactttaaggccctctgaaactaggaaggatgtgagtaaagtacaatgtcatatcattatttttatttgcattttttaaattactaatgaggttgaacacatttccacattagtttcaaggtacttagctagaacttgttttacaattttaattggttactgtccatctggtatcttctctactatgccatgagcttccagagaacagagcctgagcagcacttgtcttggtatcctttgtgtggtgcagtaaacaaagcatctcacacagactggatgctgtagaacagagctcctgccatgtgccagccactggtgctggggatagagggatgggagctctcagaggtacactctttaagtccagggatacctacaatttctgggccactcactgagtggagaagaactgattttgtttgaaactgaagttcaaagcccagccgtgccacttactggttgtgtgaccttgggcaaagttgcttcatctctttgagcctcagtttctttagctgtaaaataaggacaagctccaagatccctccaaattcttaccatga

SEQ ID NO: 166582 - DNA, 321 bp, Homo sapiens
gtggcttcatctctttgagcctcagtttctttagctgtaaaataaggacaagctccaagatcccgtctatccactggtgctggggatagagggatgggagctctcagaggtacactctttaagtccagggatacctacaatttctgggccactcactgagtggagaagaactgattttgtttgaaactgaagttcaaagcccagccgtgccacttactggttgtgtgaccttgggcaaagttgcttcatctctttgagcctcagtttctttagctgtaaaataaggacaagctccaagatccctccaaattcttaccatga

SEQ ID NO: 166583 - DNA, 1143 bp, Homo sapiens
tgcctacgattcccgcactgcccatggggaacgaatcctatatcgctgagcgcttggtagggaatgtggactgtgaccctgagagtcgtccttccctctgcctgagtccttgagcgaaaatattgaatagacagcaattcctgaagtctaaacgcctcccaggactacggaggattattggaaagagaacaagcgaggagatacaatcttcaaggactaaatggggaatgactttttaggggtcagtagatgattgatgattgattactataaactgataatatgaggccaaaactaaaagttggaagagtgagcaagtacaatggtttgggagaggcaatgaagaacaaagaaggtgccagcccctactccagacgctgtggtaccactggtttggcaggaaaaacaatcatcatttgagagggccagtggggaagccctgtcctcatggaaaagctatcttctttcgtttacacttttcatggtattatgtctactgaagaggtaaaaacaccaaatttcagagaagctcttaaattgcccaatacttcaaagcaagtataactggtgaagcgcttggcattgatgtcagacacccaatgcctatgatttatttaatgcagtagcattaaggaggatcctatacgtgaaggaacatattttattttcttcctttatattttttggttaaaatatcgtcattatagttagcaatttggaatctggcttacattggttgatacaaataaataatagaataaagcaaaatcagaaaacaacccatctaaaatctttcttcaagataaccaggggtgggattacgggcatgagccaccctgccttgccttgaatcacttcttattttcttttgtgcatgtttcattgatattttctttatagtcaccaaaagtatatgtaacatcctaaagttataacagtcttttaaattgataccaacttaacttcaatcagatataaaaaccctactccttcacagctctttccttcccgcactgttactgatctcatagtacatctttacatatcgtgtacttatttacatagattggtagtcatttttatgcatttgtcttttacgttgtatggaaaataaaaactgggattacaaactaaaattactat

SEQ ID NO: 166584 - DNA, 267 bp, Homo sapiens
ctgtaccctattagctttgatgacatgacacttttcccttctgctgactctgagtctagtactcttttatttcagtggaatttaataatcaccttaatatggcaaatatttaaacaaaaatctgaatccagtccagcctccggttttgttttataattcaaaatttgaaatctcaattattttatctcaatttcttttttctgctctattaccattactcttctggttgagttatttcctttattactgccattgcctcttgactcg

SEQ ID NO: 166585 - DNA, 120 bp, Homo sapiens
cagtgcagcatcacgtggcatattccagagacccctggagaccaggcaggtgggaggctggcctgagaggcagggtggggcctgagggtgggcaggagtcccaaggaaggcgctgggggg

SEQ ID NO: 166586 - DNA, 248 bp, Homo sapiens
tcgccagcgtctttacaagagggaggtaggagggtcagagtcagagaggagatgtggcagcagaagcagaggccggaggggtgcggggccagaagccaaggcactcaggcacctctagaaactgaaaaaggcaaggaatggattcttccctggagcctccaggtggaacacagtcaggtcaacccctttttgactcctgacacctccaggatgtggtgagataatacatttgggtggtggtttttttt

SEQ ID NO: 166587 - DNA, 279 bp, Homo sapiens
agggagaacagttgaaactgtggagttcacgtagcgtaaactggcgaggctgtctctgctgctgtcattaaaagttacgctgctggcttggcacggtggttcacacctgtaatcccagcattttgggaggccgaggtgggcagatcacgaagtcaggagatcgagaccatcctggctaacatggtgaaaccccgtctctactaaaaatacaaaaaattagctgggcatggtggcgggcgcctgtagtcccagctactcgggaggctgaggcaagagaat

SEQ ID NO: 166588 - DNA, 732 bp, Homo sapiens
gcctcggcctcccaaagtgctgagattacaggacaataaggagcccactgcaacctgggccctggcactatttggcaccgttaatatctgcacaagagaacacagtccagcagcagcagccacggtctaagggatgggggacagccaggcatgggaatgggtatatggcccaagagaggctccacccaggggttcgggcccctgaaccatctggaacttggctgtaaacctccattagcctttggttacctgccagcccctcaggaatctcctggggcagaatccaggtgctcctaaagtcaccatttacacaaagtacttattgagcacctattgtctacagacatacacaaaaagagcaataaaaagacacaggccctgttcccatgaaactgatgggctgtcagtccccaagtccaccttatttctcaagtaaatcctaaatataacacattttcaaaaaggaaaaaaaaactgtcagaaattactcaaacagatgtccctgtaccttcacgttcaaatgattcatgctttttgttattgagccaattcatgagcttcatggagtctgaacaacccgagtgtgccttgtaaggggccctcaatgaaaaaacaactggtcccagactcccactctgcagcacttgggacacagccagccagcccacaaacagcagtgcatttgcttttctcttcaccgaggaactcatttacatagacttgatggtgtga

SEQ ID NO: 166589 - DNA, 419 bp, Homo sapiens
ggtcgactactactactaaattcgcggccgcgtcgacgtcggtcctctgccctggacctgtcttggttcctgaccctgtcggcggctgcctggtgcctgccttgccacctgtacctctcctctatggaaggatggccacagtattccatggtgcctgagtcctccctaacccatcactcgtgtccttggctctctcctgacccctaaggtgagggtcaggtgcagagccatgaccttctgtgcccaatcccagctgggcctcatgtacccccaagtagaagtttctgggacctaccacaagaagagagtgtgctccttctgtacggtataaagtagtcattctgcacaaacatcagcatcaaatggagactgttccttgcctgccatctcattgactcccccagattcttttctctgag

SEQ ID NO: 166590 - DNA, 759 bp, Homo sapiens
ttaaaagaagtattagcggccaggcgcggtggctcacgcctgtaatcccagcattttgggaggccaaggcgggcagatcacctgaggtcaggagttcgagaccagcctgaacaacatggtgaaaccccatctctactgcagtacaaaattagccaggcatggtggctcatgcctgtagtcccagctacttgggaggctgagacagaactgcttgaacccgggacgcgaaggttgcagtgtgccaagatcacgccattgcactccagcctgggcgacaggaaaacaaaaaacaaaaaaaagaagcattagccattctgatcttgtgtgcacctgcataatgatagagccccaaatgactacaaaacaaaaaagtgtcaagaaaaggaaaaatgaataaatgagcacattctccacgcaggaaattataccacttctcactggaactgctggtttaagcagactcaatgagtaagaatatagaaaaattgggccaggcatagtgtctcatgcttgtaatcccaacactttgggaggcgaaggcaggcggattacttgaggtcgggagtttgagaccagcttggccaacgtgctgaaactaaaataaaaaatacaaaaatgagccagatgtggtggctcatgcctgtaatcccagctactcgggtggctaaggcaggagaatcacttgaacttgaggtttcagtgagctgagattgtgcccctgcactccagcctgggcaacagagtgagactctgtcaaaa

SEQ ID NO: 166591 - DNA, 320 bp, Homo sapiens
aggagaactaagattgatcactggatattacaacatgaaaatagttggtgactttgtcaggaatatttccctactatatagtgctggaggcagaagctagattctcataggctgtgcagtatatgggaatggaagaagtggttattgctggggaagtgatgccttgtgaaagcttggctataaaaggggtggatattgacagggtgttaatagctgggtgtgttgtcaagggagtgtgtattttaatctatgagagacctgagttaattgatatgctgatgagaagaagtttatagagataggaagtcaggaaacaggaa

SEQ ID NO: 166592 - DNA, 517 bp, Homo sapiens
atcttctagattgaaagcggccctgacaatgactgagaaagaccccacagcaaagcttatcattgtcaagtgtcagaaccctgaggataaagaaagaggggcttctgaatctctaggttattgtaaatacttgggaatacaaagagcaaacaaacatgaacagctaggagacaatggaacaactgatgactccagaaatcagttaaaaaggcttttcggcctagaattcttttgtttttgaaaccgggtctcactgtcatctgggctggagagcagtggtacagttgtcttcatctcgtgggctcaagtgatccttctgcttcagcctccccagtagctgggactacaggcatgtgccactgtgcctagatatttttttttttctttttctttccccacccccgagtcagagtctcgctgtcgcccaggctggagtgcagcggcgtgatctcagctcactgcagtttccacctcctgggttcaagcaattttctgcctcagcctcccgagtagctgg

SEQ ID NO: 166593 - DNA, 309 bp, Homo sapiens
tgattatttcctttgctgtgcagaagatttttagtttacttaggtcccatttgcctattattatttttgtttcatttgcttctgatgacttagtcataaattctttgtcaaggctgatattcagtaaagttttcctaggttttcttctaggaattgtataggtttttacatttgagtatttaatcaatcttgagttaatttttatatatggtgagatataggaatccagttttactcttgtgtatacggatatccattttttctagtacaatttattgaaaaaggtatcctttccacattgtttatttg

SEQ ID NO: 166594 - DNA, 286 bp, Homo sapiens
gactcaaatgctaatctcctttggcaacaccctcacagacacatccaggatcaatactttgcatccttccatccaatcaagttgatactcagtattaaccgtcacaactgttctttgataactcaaattgtgtctttttcccatttagaatatacatctttttttttttttttgagacagtgtgtcaagcccaggttggagtgcagtggcacgatctcaactcactgcaaactctgcctcccgggttcacgccattcttctgcctcagcctcccgagtagctggga

SEQ ID NO: 166595 - DNA, 545 bp, Homo sapiens
tgtaccagtgacatcattttgtggctcttggggatttggggagggacctccccgaggccactgtgcagcagcctcatgcccagggctcacaggtcccatatgtgtttcctccaccaaagcaccctgagctgtcctaccttcctcacatccccacaccccgcgggtgtccctctgcttagcagctatttattctgcctgtatttgggccaactgcacaggctgtctgagacctgacagtatgctagaatgtacagggcatacaatattttgtgtaatatcatggaaaagtgtgccgttctttcggttgacggtggttgcagataagactgcagagacagcttgtggtgggttggagtgtgactcagtctcccgtgggtctgctccccttccagactgcatgtggaattctgtatagagtaaggcatattcgtgtatgtgggagggaggcttagaataaaatttattttttttcttatggaagcagtacatgttcattgtaagaattaggaaacatagatacaaaataaactttatgaaaaagcaaa

SEQ ID NO: 166596 - DNA, 605 bp, Homo sapiens
gcacgttcctgcagtcccagttacttgggaggctgaggcaggggaatagcttgaacctgggaggcggaggttgcagtgagccgagatctcgccattacactccagcctggtgacagagcaagactccgtctcaaaaaaaaaagaggggagatggactattacattttttgtcactttagtctttttgcatcactttaatggacacagtttttttattcagcctggattacagagcaagtcaagttgattgaattgttggcaattagctggcttttgtgatggttccttggataagtctatgaaatcgcccaggatcttaaagtgtctaagagtttgaattagataatctctaagatttgtttagcccttcctttgttccccaaatttcatacacttaatttctagttgcttaaagaaaaatactttgttgtgaggttatagttgtgaggttataggtgagaaattaaaaagaaatatttgttgccgggtgtggtggctcatgcctgtaagcccagcactttgggaggccgaggtgggcagataatttgaggtcaggagttcgagaccagcctgaccaatatggcaaaaccctgtttcttctaaaa

SEQ ID NO: 166597 - DNA, 295 bp, Homo sapiens
tagcttcagggggtacacgtgcatatttgtgacatgggtatattactggtggggattgcgcttctggggttcccgttacctaaagggtgaaccgcgtaccccgtaggtcatctttcacccctcgccctctcccgcctccctgcttaggagtcccagtttctcattgtttcgatcttcctgttcccgggtacccactgttcagccactgcttgtaagcaagagcaggcgctgtgcggtattgtttctgagttggttcacttgggataagcgcctccagctccatcgcgttgctgcc

SEQ ID NO: 166598 - DNA, 719 bp, Homo sapiens
gggttttaatctcaagaaaataactgctatcagttagattttgatgtatattgtattagccttttgacttacacaaaagttataatggtaaaattgatcctctgtgtaatttatgtaggaaattgaagtgcttgcataagccgtacttgcatgtgagagctaattgtaagggattaaagacattagcaactgtgtcctcagctttgttatacttgagtcatacttaacagccaagatcttcagtcatacattaacagctaagatcttggtcagaaatgcagcctccatttatgacattctcttgggaaaataagtctcttgtttaacaaggtgatttagtttttactttgatttcaggaatattgtctaacgtgagtagggcgagaaggcagggcggcttgtactgagcctaatttagcctgcacctataaggatcaaggtgttgtttctgagcctcctgggatcccagggctcacttgggtgggagagtgggttgtccctgagccaaaaaactgctggacacaccctgtgtgctcaggattgctgtgtgagcatcctgacagcttttgaccagtagcggttcatggttactgagatgaggtggctttgagattcttggttgccaggttgccactcacccccgttccctgaagtaacttcccctaggtcttcatgcgatagctatcctaagtgtcaggttttattttttttattttgag

SEQ ID NO: 166599 - DNA, 431 bp, Homo sapiens
ggggaaaccccatctctactaaaaattagcagggcccgtaatcccggctactccagaggctgaggcaggagcatcacttgaactggggaggtggaggttgcagtgagtcgagatcgtgccacttcactccagcctgggcacagagtgagactctgtctccaaaacaataaaaaaagatatatggtttgtaaacattttctcccagtctgtagggtgccttttgattgtgttgattgtttcctttgctgtgcagaagctttttagtttgatgtagtccaagttgtttatttttgcttttgttgcctgggcttttggtatgccatccaaaaaaatatcaaggaactagtattaacctatacaattcagtagtttttagtatatttacagagctgtgcaactattgcacaatcaattataaatcattttcatca

SEQ ID NO: 166600 - DNA, 221 bp, Homo sapiens
attgcagtgtcattactaagattgactttggagtcagatctgggttccacacagattccaataagaactagtagcgtgacttggaaacacaattcaacctcaatctctattttcttactaaaggcttactcaagtttacaaaatagaattgaagtgatgattaaatgagatcattcatgaaagattatccatatatatacccttgcacagggcctggctca

SEQ ID NO: 166601 - DNA, 742 bp, Homo sapiens
ggttctcatagcacaccgggctggcgcggaagggagccaatggtccggcttagacacctgcctctgctcctgcccaacgccctgagacaccagccctgctttaaggcagtgtttggagacaaggcatgaacagttcctagagcagtgtctggcacatgttctgtaatccaagatgtctgtaaagagctgggatatcactaggaaatcatcttcatccagacttattcctgagtggaagaacttgaagttcctcataaataagatcctgaaggacataaagaatgatgaagaaccaaagaatgatgtggttctactgagtgactggcctgagactctataccgggagtctcaccatccacagaacaagccttttgtctgcttctactactccatcaaggtcaactgttttgtctccttaaactggatggaaccctgtggaaaaatgcaggcaagaaattatcggagaaatcactctgggccaactgctgaatattcaagctgaagatatacagtccctgcttattcatgtggagcagcagctaaatgaaaacttgaccttgttacaaagagaaaagtcatttactttttcttttgatataccatggtctgaagaacttaaggtcttttctgaagacatgtgcatacctttgtcagaacctgtaaagatcaccaaaccaaagaaaagaaagagacattttcaagcaaggagcagaaagcttagtatgtatagggtgatatatgg

SEQ ID NO: 166602 - DNA, 359 bp, Homo sapiens
ttcttttttgaattttgttctatcactagcttagtactgtacttcttttcccttgacttatataggcaagaaattatcggagaaatcactctgggccaactgctgaatattcaagctgaagatatacagtccctgcttattcatgtggagcagcagctaaatgaaaacttgaccttgttacaaagagaaaagtcatttactttttcttttgatataccatggtctgaagaacttaaggtcttttctgaagacatgtgcatacctttgtcagaacctgtaaagatcaccaaaccaaagaaaagaaagagacattttcaagcaaggagcagaaagcttagtatgtatagggtgatatatgg

SEQ ID NO: 166603 - DNA, 253 bp, Homo sapiens
atagtttaaacttcagtgctttttcggcatcagttaatatgaccatgtggtttgttttcttctttactctgtcaatgtggtgtactacactaatagattttttaatcttgaactggcattgtgtccctggcataacccccacttgatcatggtgtataattatttctatataatgctgtatgtgttctactcactaattttttttctttcttttttttttgggtagagaaggggtcttactgtgtatcccagg

SEQ ID NO: 166604 - DNA, 453 bp, Homo sapiens
gggcctgtgatggctcccaggtggtgatggctcccaggttcccatcccctggcaccccagggctgagctccccaacctgtctgtattctgctccttgctccacaaatgccccaatcccaatccactcagctgccagagtcagaaacccactgggggcggctgatccctggctccctgcctcttcaccctgcgcctgttctctcacacctgtgacggccccgcttcactttcgctggtctcccgaccccctaggctgcaccccaccaagtctccccaccctgcggcccaagagccctgctctaagccactccgcagcagatccgctggggcggggcctgaggaccgtgctaggtgctagcgtggccacctgcccctccaggctgctcagcagctctgctcagggtgaccctgcgatggcttgctccttcctgaagagggcgcagtcagggactc

SEQ ID NO: 166605 - DNA, 588 bp, Homo sapiens
ccccccccgccacccaacacacagaaaccctgcatttctcccctgcactcagcttgctgcttcccttcctataccctctcccggggatccacctcggtacttccagtctgctccatgccagccgttcccctagctctcgggtcaaacctgaccccatccttgagtcctcccacttcccatcccctggcaccccagggctgagctccccaacctgtctgtattctgctccttgctccacaaatgccccaatcccaatccactcagctgccagagtcagaaacccactgggggcggctgatccctggctccctgcctcttcaccctgcgcctgttctctcacacctgtgacggccccgcttcactttcgctggtctcccgaccccctaggctgcaccccaccaagtctccccaccctgcggcccaagagccctgctctaagccactccgcagcagatccgctggggcggggcctgaggaccgtgctaggtgctagcgtggccacctgcccctccaggctgctcagcagctctgctcagggtgaccctgcgatggcttgctccttcctgaagagggcgcagtcagggactc

SEQ ID NO: 166606 - DNA, 344 bp, Homo sapiens
ttgagttaattatgtcttaaaatgtaccaatatgtaatgttttatgtgtatatgtcttaaatttacaaaagtagtactgtggtagaaaatattttgtattttctttcttcttttaatgttatgtgtgtaagatctccccgtgttgtctctctctgccgcacactattctgcagtgtgtttccagtatatttcacaattcctctcccctgatggaccctggggtggtcgccaactccccattcccacataggagaccatggaaaacattcccatttgtgtctgctgatggatgttgtgagaatatctctgggatattcaggagagagtgtattgtgtcttaaggc

SEQ ID NO: 166607 - DNA, 711 bp, Homo sapiens
agatggggtttcgccatgttgcccaggctgatctcgaactcctgagctcaaagtgatccgcctgcctcggcctcccaaagtgctaggattacaggcatgaaacaccacgcccaacctcatgaatagtatagatcttgacctactattataggataaataaatgcatgtctacaaactcttgagccaacatattgttcataagggaaagctctcaaattctttactgttttacctttttctctcctaaatctagtcccatttcaataaattcctacttgaccctctatcaggtcctctgaaattccatctcaccagttctacctcaaatttattttctatcatttttttcctgtccctgttcttggattcttcaatctcaattggcttgacttggcttttctcttcctctctgtcctacagttctttcttttcattacagaaagtaaaaagtgaaagtcactcattagctcaccaaatcccactccaccacacagatatcactgttaatcaaccacattttcccctttaaaaagcccttttaaatctttaaatctgcacttggtgtaataatttcatttgtctccatttggagggctacttcctcttgtggaataaatcattctccctcatcctttcaggattccaaattaacattggcgctgggaagtcctgccctgtggaccctgtcaccactgccctcatcaaataata

SEQ ID NO: 166608 - DNA, 260 bp, Homo sapiens
aggacccctcccaagcatgaggaattgccccatctgtactatgaccgtatcctctcatacaggtttctggcctggaatcttccacttgcatcccatttcccaaattactattagggtgactttgctaaaatgaatatacgatatagtatcctgcttaaactcttcaattattctattttaaactctaataaaactcttaattattctccaaagcccataaaagaaagtccaaattcctttatcatctgacctccagttct

SEQ ID NO: 166609 - DNA, 158 bp, Homo sapiens
tggagggaggaactggagataattctgtggaagtactggctttaagctggtctatagaaataggagtttaatatctggagatgggaaggaaaaacgtgccaggataatgagggaaatattgtgaagccagagagttttggatttaatttgctgatagg

SEQ ID NO: 166610 - DNA, 416 bp, Homo sapiens
ccaatatgactgatgtccttataagaggaaaagattaagacacagtcaaacacagaagagataacatgtgaacctaagggagaatatggccatttacaagctaaggaaagagacctcaaataagaccgatgctgctcacacacgatcttggacttccagcctccagaactatgaggaaatttatattgtttaagccactcaatctgtgggactttgttatggcaaccctagctaatacacaccttgtgaactccataaggggagagattatatctttaatttcatttaaagcttttgtttaaggagtgagaatgaaaccgatatttactaggcagataccatatgtcaggcactgtattaggtactttccacatattacctgacttaatttttccaatgatactaggaaatataga

SEQ ID NO: 166611 - DNA, 340 bp, Homo sapiens
atagcacattgctgcggggctgctgcttaacagacctggtgcagacagcaggcacccctggggctggtgaggggctcctggggtctcaccagatagatggtgttgtgcagttcaaatcagttaggaggcctgagacttgagacaggctcacgtggagggaggtggcatcctacccagccctcggcccttgctgccccactcaggggccagatggtggacagtgaagccactatgaggagttggaaacagctatttgctcacttcccctttagatggctgccagtccttctagatcagtgaactctcccaaacaaatgctattgaaacttctaaaactagg

SEQ ID NO: 166612 - DNA, 550 bp, Homo sapiens
tcctatctgcaccatgaggacaaaactctgtcctctgagattatttccagctctcacacactgtgattctgagatcctaaacccaattgctgtgagctctggtgagagccgcccctgcctgatgggagccccgccctttccaccccctcctcaccttaccctccagtggctgtgggaaagcacgcacatattctggaaaacagacccacacgcacaagcctgcccctgtatgacagcccattcttctgggcctggcaccagctcttgtggccagcgccagggagatgaaggccctgtctcagcaaaggcaccttcaggaggctggcatccctcctcccccagccagcagtggagaaagcccctgggtctccctcaggggtcgagattgggctggagccagagagcaggtcccagagtgaaagtcatcacggctgagaggggcccaaagggcagcccctgcctggtgacagtaaatagcgactgtgatgatgatgactgtgataaagggacacgtgggaggtgccaatcctccaggctgtgtcgcggcact

SEQ ID NO: 166613 - DNA, 738 bp, Homo sapiens
ttctttatcacacatagtacttccactcagctatgtcaggagcctctctttagtctcagccttcacactcagtagaattttggtttcatttttttcttctgtgtgggatatgacaagatttctcttcaaatagcctattaatcctttattctttaatccacagtacccctccccttcccttttcttctctttttctttctttctgcctttactacatgcctaggcatgccacagcaccaatggcttatcagtaccagctcacattcctttccttatttgggaagaaaactagctctctagcttatcacagatgacttctaccccctctcccctctctcccttatgtgcacaccttatctaagaaaaagttcaaatgttcagagaatcgggtctagcttagattgtgcagtccaaccccagccaatggggaaagggcacaggggcaggatttgcgtcagggataaaaattttaactctccttttggtgactggccaaagagaagcacccctctgtgcagaagtaaatttgctttgctgagaaatcctttgtctgagtgtttgttttccttaagactccaagctttatttctgacattctggaattatagtttggagtcttattcctcacttatattgtgctttaccttctaggtgtgtgcacactgtctctctttctccccgcactcccaccccgtatcatcgtgactcgtggaaatgtccacaggaagttgccacata

SEQ ID NO: 166614 - DNA, 233 bp, Homo sapiens
ctcaagggattatcaaacatgaaaaaattgtatacatgatgaagaaggttgtgactcctccaggaagaaattaaggaattaatgggaccagagttgatgagaaacaggttattaacataatctcaaaatacatccctacaaattataatttacagaaattacactttacagtacaacagagaaaccacacaacacagtccatattaacatacttttggtatttcatacagttc

SEQ ID NO: 166615 - DNA, 225 bp, Homo sapiens
acactctagagaactcccggctcatatcagttcattccagactcaataaaaaatgacaggcttcttctgtgtactaccttttcctcctctactttcctcttaccagacaataaagtattgtcccttgtgaggtagaaacaaaacagcaacatgaaaacaaattctaatagctcatgggaaggacagacatcatgatcccaaagtgctatgttaaatgccttaaga

SEQ ID NO: 166616 - DNA, 334 bp, Homo sapiens
ctgacatctctttggatgctaaatacatgtggttttagaaataatacatcttttctggttgaaattgcatctaaaagactatcttcctctgctcccaagtcttgctcatcaagctcctgctattggctgaatttcttctctagccattccacactagaatgtctccctccaatgagcctgtggggtttgggctgctttatcgccatggatcctggaatggtctccatcacaaagtgtgtctgaagaaatgagcgagtgaatgggagacaaacagcacttggacttcccttttgtattttcaggttaacatatttttgagccctggcctgaagta

SEQ ID NO: 166617 - DNA, 495 bp, Homo sapiens
taccaagtcaggctcatacaagtctagatttgaaattgagcttcatgcttggcccaacctagtagagtcctctaggccaggtttcagaagggactgttaggagcacatttttggctaggcctgacctggaaagtctacattgaagacatgggcctgcattctctggatccctacattataggtccattttataacgactctgtggagtgttcacattgacatagacaatacagttttactaatatagcctagtatgtgccaagaagggtaagttgggagacttgtgtttataatctcttgattgttgttttgccttgttttccaggaaatatgtgaaggtctcaacattctttttcccttgttcttgatttttcacctgtacattatctctgattcattagctggtccctgttggggctgtcatggtacatcattaggttttaagtctggatgtaaggcctgcctcaaagagacactaatgggagggaacaaagc

SEQ ID NO: 166618 - DNA, 266 bp, Homo sapiens
gaccgcatattaaggtgtgagacaccatttctttttccctaccatcaggccctacagcctccctagctaagaaatccaggagctggacacggtggcttatgcctataatcccagcactttgggaggctgacgtgggaggatcacttgagccaaggagtttgagaccagcctgggcaacatggtgaaatcctgtgtctacaaaaaaatacaaaacttagctgggcgtggtgatacacgcctgtagtcccagctacttgggaggctga

SEQ ID NO: 166619 - DNA, 150 bp, Homo sapiens
gcagcctctgcttgaacgctgggtttgccacatttaaattgactgtctctaggcaaatcaccttgtctctttgaacctcagaccccccatctgcaaactagggatcatcataatgccctaacagggctgagtagagttgacccagctgct

SEQ ID NO: 166620 - DNA, 547 bp, Homo sapiens
gatgtggaatcctctccggagagctgagggtgctgggacccagcctgggaacatgcattcattggtcatttgtatagtcccaagtacaaatgtaagaaattcagctcacagggcaagccctgcctactctcctcagaagaacagtatggaagtccattttcaaagtccagggtttccctgctccttgtacagggatccttgtacagccacttgtgtcccacagaggacgttggcctcctagggtgaggcaagcagacagcccgcaggtcagaggaccctctgcttgtgacagtgtgtgacaggtgaggagggactggaggccactgttatacctcctcaggggacctttgcagctttggggtctcctctccgccccccagttagtgttcctcctgcatccccgactcctcctgcctgtacccttcatcctacagaggcatctcggtggccctgctccgggtgtggggactgtaatgtggagcacgctgacaaattctttgtccttgggaagtttctattttgccgagggagatagactgtaaacaag

SEQ ID NO: 166621 - DNA, 247 bp, Homo sapiens
agtagttccaggctttggtgagccatgatcacaccactgcacttcagcctgggcaacagagcaagaccccaactctaaaaaataaataagtaaataaataaaaagatctattgaagggttgagaaaaaagaaaggatgatacagcaacatgaaggagagggaaagactaaggattatgttagcagagaatttccacacaccgccaccaaatgcaacaaggtccaacttttggctgtgaaaggggaac

SEQ ID NO: 166622 - DNA, 366 bp, Homo sapiens
ctttcctctgtacaaagagctttgccttttgtgattaaaagcatatcctggaaattactcgatgtcatttcaaagagagcttcctaatacttcactgtgtaccataggttacccaactgttcttctatggatgtgcgtttaggctgtttccagtgttttgtaatgacaagcaatgctgcaatgagtaaacctgaacatacgaacgaattttcatatggttggaggtgtgtcttcagggtagattcctagaagtgagattcttgggtcaaaagataagtgcatatgaagttccccttagacattcccagattctcctctaacaggtgagatgtggttgtgcaaaactggaatgtccatcagtttggt

SEQ ID NO: 166623 - DNA, 368 bp, Homo sapiens
tagcacaagaatacagatgttctagacccaacctaacaaagctcaataggataaagtaggataaaactaacccataaggttcttacctgtgtgactaaacaaaatccaaaactctttaaaaaatgtaaaaaaaaatagcacaaataacataaaattcacaatgtctaccacccagtaaaaaattaccaggcatgcaaactaacaacatttggctcataaccgggagaaaaataaacccacagaaacatatgcagaaataacaaagatgatcaaattagtaaaaaaggatttcaaaagattattataaatcttatggttatgctcagtgaagtaaatgaagataaacataatatggagaaaataaaaga

SEQ ID NO: 166624 - DNA, 328 bp, Homo sapiens
ctcgaatagctgtgactacaggcatatggcaccacacccaactaattttttaaaaaaattttttgtagagacgggggtcttgtcatgttgcccaggttggtcttcaactcctggcctcaagggatccttctgcctcaacctcccaaagttctaggattacaagtgtgagtcactgcacctggccacagaactttaaaataaacaatataaaaatataggaatatttaaacatagtcatgcaccatataacattttagtcaacaacggaccgtgtgcagctgtggtcccatattatactggagctgaaaaattcctactgctttgtgat

SEQ ID NO: 166625 - DNA, 556 bp, Homo sapiens
  misc_feature (369)..(369): n is a, c, g, or t
ggagacttatgtcatgcagaggtgaaatgtttgttagacctgtagcctacaatagcttgaagggaagactgggagaagtaagcctgtagctccagaagaaggtggctgagtgagctgcaataaaaatgtatgttgggctgggtgcggtggctcatgcctgtaatcccaacactttgggaggccgaggcaggcagatgacgaggtcaagagatcgagaccatcctggccatcatggtgaaaccctgtctctaataaaaatacaaaaattagctgggcatggtggcatatgcctgtagtcccagctacttgggaggctgaggcaagagaatcacttgaaaccaggaggcggaggttgcagtgagccgagantctgccactgcactccagcctgaagacagtgcgagactccatctcaaaaaaaaaaaaaagtatgttagtcattcctttggtgtacagtaaggtattgtgagacagagacgcactcaagcaagatataaacggtgtggaaatagaagaaagggaaatatgaagagtttgaggccttgtagtgttggaa

SEQ ID NO: 166626 - DNA, 211 bp, Homo sapiens
taggagaatcgcttgaacccgggaggcggaggttgtggtgagctgagatcgcaccattgcactccagcctgggcaacaagagcgaaactccatctcaaaagacaaaagagagagaaaggtggtcaccacaggcagggaggaagggtccagggagtgcctaaagtgtctagaaggcccaggttcctgtttgggtttcgattgtggtgatggc

SEQ ID NO: 166627 - DNA, 569 bp, Homo sapiens
tcgcgacgggccagtccttgctgcagaatggcgtctgaagggcccctgatgtgcgccacaaccgggacctctgtcctcctacagtgagggtacacgtggctgtgggccccataggactccttccagaagcatctgcagagtcccaggaccaccagactctgttttgccaactaagcacagtgggcacttggcacctgatgtggactgtctccgagccccctgtggaggggctgcaggcttcctgtgctgcctgtgtgggtcccgcaggctggagggaggcccctgcctttgcagattgcagggtggcagggacacgctgagggtggcggggacatggtgagggtggcggctgtgatggcaccgcatcagagcagctcctccacaccagcgtcttctggggctcagagaaggggttggacttcccagagaaggggtgcagggcagggaagagtccccatgcctatgagggagaggatcagggtggggtgatggaggatccgtggctgggcccccagaccacagggaggctgtgcagccatgtcagaggcgctgggggattgggcggccgc

SEQ ID NO: 166628 - DNA, 732 bp, Homo sapiens
acaggttagttttaccctactgatgatgtgttgttgccatggtaatcctgcagcatattgaaccaatccacagagtggatatgtccagttttaccagtaagagttcacttctaatatccattgtggtaattgagaaaatttttggtgttggtcagagataaatacccatagcacatgcaaccatttgtttaaatactagctggaaggtatattcctaatgaggtcaattgaccatttttgatatatagactaaaattagcattcacatttgtatcaaaacatctactctgaagtattctacagtaaattccatagcatataacaatgctgtattatatactgttaaggtttcttttgtgaaatggaaagaatagtggtggtgatctcatagaattgtgaagatttaaaaacataatattgtttagcactatgccacgcctatatcaagtgctcaataagtgctaatcattattatgtagaaattcaggataacattattacttattgttccatatagagtttttgtggagtgaattcttccttcgttttattttggacttgccaagttctgacactctccaaaagaaaagggaaaagactgggccatgcatgtgtttcccttcccagcagaagagcattcagagtcatcttcactctttgcggtcaaggcccctgctgtaggtcgtgtgtccagcttgtcctgcctaaaagcatcatgccatgcttgagaaa

SEQ ID NO: 166629 - DNA, 728 bp, Homo sapiens
cccaaagtacttatttgggtgtttgcagagaaaggcaaggctcctgcagcatattgaaccaatccacagagtggatatgtccagttttaccagtaagagttcacttctaatatccattgtggtaattgagaaaatttttggtgttggtcagagataaatacccatagcacatgcaaccatttgtttaaatactagctggaaggtatattcctaatgaggtcaattgaccatttttgatatatagactaaaattagcattcacatttgtatcaaaacatctactctgaagtattctacagtaaattccatagcatataacaatgctgtattatatactgttaaggtttcttttgtgaaatggaaagaatagtggtggtgatctcatagaattgtgaagatttaaaaacataatattgtttagcactatgccacgcctatatcaagtgctcaataagtgctaatcattattatgtagaaattcaggataacattattacttattgttccatatagagtttttgtggagtgaattcttccttcgttttattttggacttgccaagttctgacactctccaaaagaaaagggaaaagactgggccatgcatgtgtttcccttcccagcagaagagcattcagagtcatcttcactctttgcggtcaaggcccctgctgtaggtcgtgtgtccagcttgtcctgcctaaaagcatcatgccatgcttgagaaa

SEQ ID NO: 166630 - DNA, 256 bp, Homo sapiens
cacaggagtaccatctgtggtgaaagagagtaactataggctatataatacatggagaaacaattcatggtttgtttgctttgccattctgcttcctagtgcttttttaggaatgtattgtgaaagtgagaataggctgtatagccagagatttgtattcatggcacaaagcagaaagctgctaccatcttggtggtagggcagcatgctctctggtattagcaagggacagggaaaaccaagacaagaaagccag

SEQ ID NO: 166631 - DNA, 194 bp, Homo sapiens
attgtaaactgccaagaataatgtctggcccatggtgtgttcttagttggtggtagctattcttattgggcctgggtggttgatcagaaagatcctacattgaagaattttataaactaagaacttattgcataggcaggtcaaggctagaaacagacttcagcatctacagtgtgacatagaaggaagcaatg

SEQ ID NO: 166632 - DNA, 260 bp, Homo sapiens
aacccattatttgtttttccttactctgctttttgcctgtcactagtgtttaatccagcaaaaggaaaaacatttcttgaaaacagataaagtcagcactatcaagtaaatgaaaaatcagaggccttttgacttgctatagacggtactggcctctactatttctctagctttattttaacacataaaatgttctctagttccaggaaaaaagaacagctctgggcgatcaagaaaataaagctgaactactgtctaga

SEQ ID NO: 166633 - DNA, 248 bp, Homo sapiens
ctcaagcttttgccactgatcctagaaggaaattactctttccctcagtaagaggacgcctgcacttctgagctgagaaatatttccgttgcttcccaggagcacgagctggggcagggaccactgcacggcctgacccttggagctgactgcccgcctgcctgctggcaggactgaggtgagctgactgaatgccccaccccaccatgtgcttcaatccctaggctctgcagcagccgcccccacct

SEQ ID NO: 166634 - DNA, 631 bp, Homo sapiens
gatgtgctcactgtctctcaggtgggccttgacttggcagaatcttgaattcaggttctcttgatttctctccctgccatttcctttacataaaacctgccgcggagctcacctatctacatggccttctgacttgttcctaatgatccaatttggagaaagggagttgaagggagatggggaaagggagtatggcttgggttgggactcaaaccccagttaggattaaaaggtatgcattttcctgaaatatgaaatattgaattttaggatgatttgaatatttatttatgaggcactcatccagtcttaccgtataccagacattgattcaagaactttacaagcataaactcacctaacttaagccttataataaggcttagtataggtattacttttctcatccccgttgtataggtaataacactgaggcacagaggaattaggtaacttccccaaagtcacaccgttggtaaagtgtagctctgggatttgaatccagtccacttagtctgggtccctgtcaccaccctgcatttcccatgctggagccagcacctgtgagaaaggtgaagtggccacatacacaagagagaggagcagctctcagctgatatcataaaggaaa

SEQ ID NO: 166635 - DNA, 397 bp, Homo sapiens
gtatcattatttcatctcgccttgtacagacaaaatgaaatagaagagcagagaagttaaataactaccaccacttgtatgaccagaaagtgactgtgttgagaagtctcatttccaaatttctgctcttcagtgccttactgaaaggtcatgaatcaatatctgatataaaggatagtggtcttgttataagctcctgacctacttttcatttgacctcacttgcattttatgttaacatggaagaaacaaatagttttatataaatcagagacaaattagtatcagtagaaattaagtaattcttcctttgtctgtcacgtaatctcagtattgatatcttttcaagggaaacagaaacctgcaaacttaaggttctctattctctgaaatgacc

SEQ ID NO: 166636 - DNA, 1002 bp, Homo sapiens
ggggccacctgaggagcagagaggtgcagcacctcctcagcatcgcaccgtgtgtaggactgaaccagggccggagctcagatctgggcatctgcatgctcaggacaggttacctgagctctgtgtggtgtgaaacggcgagcgtcaggagcttagatctaggagccggcagccctggactccgctctttcttctggggatgaggtagcaggtcctgtgtgagggtgaaaagttggtggctctgaagctcttcacctgggcctgacttgggacagtcacgaaacagagctgctcatgctcttaatgcggcctgccatccagagctcattacaaggccccacaagacaaccagtacaactccaaccaaagaacagctctctctggttttcaatttggttgtttcttttcttttcttttttttttttgaaacggagcctctctgttgcccaggctggagtgcaatggcgcgatctcagctcactgcaacctctgcctcccgggttcaagtgattctcctgcctcagactcctgagtagctgggactacaagtgcgtgccatcacgcccggctagtttttgtatttttagtagagacagagtttcaccatgtcggccaagctggtctcaaactcctgacctcaggtgatccgcccaccttggcctcccaaagtgctgggattacagatgtaagccagtgcacccagccccaactttctttaagacaactcttaaaccttttgtgctagtatcaacattcaaagctgcacatgcacctatagtcccagctacttaagaggctgagatgggaggatcgcatgagcccaggagttgaaagtgggcctgggcaacatagtgagacactgcctctacaaaaatattttaaaaattagctgggggtggtagcacacatctgtagtcccagatagttgggcggcttaggtgggaggagagcccgagcccaggacttctgagctgtagcgccctatgtcgatcaggtgtctgt

SEQ ID NO: 166637 - DNA, 463 bp, Homo sapiens
  misc_feature (459)..(459): n is a, c, g, or t
ggggccacctgaggagcagagaggtgcagcacctcctcagcatcgcaccgtgtgtaggactgaaccagggccggagctcagatctgggcatctgcatgctcaggacaggttacctgagctctgtgtggtgtgaaacggcgagcgtcaggagcttagatctaggagccggcagccctggactccgctctttcttctggggatgaggtagcaggtcctgtgtgagggtgaaaagttggtggctctgaagctcttcacctgggcctgacttgggacagtcacgaaacagagctgctcatgctcttaatgcggcctgccatccagagctcattacaaggccccacaagacaaccagtacaactccaaccaaagaacagctctctctggttttcaatttggttgtttcttttcttttcttttttttttttgaaacggagcctgggcaacaagaatgaaacgccntctc

SEQ ID NO: 166638 - DNA, 542 bp, Homo sapiens
cacatctagtgtctggtgaggcagtggcctggaatacttttcctactgccaatcaagaccggaaggagttagctgcccttagctgctcatgtccaagtactctttgttttatggtgagcatactgcgtgttgtccttgaaagggaggtgttgcttacaccacgattggaaagggacaggaaaagaaatggattgtcattggtcatctttcagctttaatcacatgttaacatgaacgttcccttcactgtatagtcgtctcacacaccggtagacaaggtatgggagaagctgcaagtgcaaactggaggttacaaaacccatcctggtgtattttaatataaccagtaataacacttggtttatgaagtgaaacatctgaacaagtgcttaacctgactgtctgctgcgacaacaggcataaaccagcacttttgcagacaaagggaaggacactgtcaacctgggtagaaaatcacatttctccatctgctttccaccctcctttgtctggactctgcccttctctagtcttgatctttc

SEQ ID NO: 166639 - DNA, 382 bp, Homo sapiens
ttttgcctgactcttgccatcatgagcacattttcctttcatgatcaaagaaaaccacaattggaaataatcctcctcttcaaaaataaaaataaaactaagtgagaccacagttgaaatcatgcatttgccatcatagctctgaaatgtgtggccgaaaaaatcccacacactcctttccccctctgaacacagcccaagtgaggcggcaccaccacggagggtgtgctccagcactagtttttttaaattgtattagttctgaacatagactgatgtcactgggtaatttgaagacaattaacaacaaaccaaaactatctttaaattgatcacttaaagaacaggtggttcaccagatttaacaacaaaatcatgttgg

SEQ ID NO: 166640 - DNA, 651 bp, Homo sapiens
taactctggctatccgcttcaatggctcacaagaacctgggcctccaaagctgaggctcaccctaccaaatcatctttccacccaagacagcaagagctaagagcaagagctctcgggccagcagaaacagactaaactaccagagctgctacttttgcagtgtgtgaccttgggaaaattatttaacatctttgtccagtgttggctcatctataaaatgaggataaagtcaattccctcacaggggtgttgtgacaactaaatgagctaaagcacctggcagagccttgcacttagcaagcaggaaacacaggatagcgttaaaaatcacgtagagtgaaggcaacaccaaggcactaaagggaagagatcttctccaacccacccatactgctgtctcaaagcctgtgttctccactcactattgaccaggaatggtctgtgctgatcctggctgttgctgaccctgtgattatgctccacttgccagcccattcacagtctcaagacagtatggcatctttcctccatgaagtcatcaatttttaaatttttacatctagggaagtattctggtctgcatacatagatggtggtattgtctctttttttttgagacaagagtctctctctgtcacctaggttggagt

SEQ ID NO: 166641 - DNA, 528 bp, Homo sapiens
gatttaagaaggctcagctgcagatatgtaaagagagatttgcaaaagcataatcaagtcaagtcatggcaaggtcataagaagcagtcacaaaagcagcagtaatttgagtgcgaatggcagttttcatcatgactatgcccgttcacagggactctttgaaacagaagtttggttggaagcatttcccattctgcttgtggcagggcatgaaaggggcacagaggctatggatgcattgttccccaggcccaggctccttcctggctgtgtgatgatgggcaagttgctggcctctccagttgtgtctttggaaaatagatgtaattgcacctacctcattgggttatgcagaagatgaatgagatcatgcatgagagtccctagcacagtgcctggcacacagtccctcccatcaacagtagttgaagctcattccctcacagccgttagaatcaattgtgggcctagagggctttcattttgtctctgcttacagttctttgccccgctggaaaaggagttaga

SEQ ID NO: 166642 - DNA, 289 bp, Homo sapiens
ggaaacctgtctcaatcaggtacaaaagaaagcttgtagaacacaaaatttcatctttatagggaagaagtgaaaagaactttttgttttccttaggagataggccactatatttttgtctgcaataaaaacttagaatgtaaataatatgcctcaatgggaccttacccctaatttccaaacttgatcaagtgtatggtttggaaagacctttaaatctaacattatcagaatccccctgctgtattcaagtcaaaggaccaaaaatggacatgaaaattgccaatga

SEQ ID NO: 166643 - DNA, 133 bp, Homo sapiens
tttcaaagtgaaattcttctgccacaacccagctgcatggttctagacacaccactgaacctcttaaggaattcatttccttatctatacagtgaaagaaccggcctgaatgatctttaagttcccatccaaa

SEQ ID NO: 166644 - DNA, 301 bp, Homo sapiens
ctttcagctgcaaggaactgaaaactggctcacatagaaggaaaatgattggctcatgtcagcaagcctagatgcagagcaagttatgggtttcagggatccagcatctaaatgatgtcatcaagaacccaagtttttttgggtctctgctctgttggtttctttcatcctaaagctggttctcctgtggtttaccatagtagagttcctgtgagaactccactctgaccaatcaggccttcccagagccagggatggatggagtcgcttcttttgaggcccatgggtcctatctggaggg

SEQ ID NO: 166645 - DNA, 2186 bp, Homo sapiens
aattcttccctccgagacccagcccgctgcttgccacttccctctccaaacgctggcgggggtgggtggcagcaccgaggcgattttcttcgtctttttttcctccgggttttgtcatggaaacgctgacacaacctccagacggcggccgagcccggccggggactgagggcttttgggaccctgcgggagcgcggcgcgcacaccgcactccccgggcaacagctggacgcgaccatatcccgggtaggggcggggggagcgcgacgctccgccccggcgctagggtccctccctcctcccggctctccgcaggcgccctcccctcgccgggggccgcgagttgcatttggtaaaacccagccccggaatatatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggcggcggagcggcgaggaggaggagcaggagcgcgcagccagcgggtccacgcatctcagcacttccagaccaactccggcaccttccacacccctgcccgggctgggggctccgagagcggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggccacttgcttgggatcctttatcctggtcatcttctatttccaaagtatgttgcacccagtcatgcggaggaatccctttggtgtggacatctgctgccggaaggggtcccgaagccccctgcaggaactctacaacccaatccagctggagctctcaaacactgctgtcctgcaccagatgcggcgggaccaggtgacagacacgtgccgagccaacagcgccacaagccgtaagcggagggtgctgacccccaacgacctgaagcacttggtggtggatgaggaccacgagctcatctactgctacgtgcccaaggtggcctgcaccaactggaagcggctcatgatggtcctgaccgggcgggggaagtacagcgaccccatggagatcccggccaacgaggcacacgtctccgccaacctgaagaccctgaaccagtacagcatcccagaaatcaaccaccgcttgaaaagctacatgaagttcctgtttgtccgggagcccttcgagaggctagtgtccgcctaccgcaacaagttcacccagaagtacaacatctccttccacaagcggtacggcaccaagatcatcaaacgccagcggaagaacgccacccaggaggccctgcgcaaaggggacgatgtcaaattcgaggagtttgtggcctatctcatcgacccacacacccagcgggaggagcctttcaacgaacactggcaaaccgtctactcactctgccatccctgccacatccactatgacctcgtgggcaagtacgagacactggaagaggattctaattacgtcctgcagctggcaggagtgggcagctacctgaagttccccacctatgcaaagtctacgagaactactgatgaaatgaccacagaattcttccagaacatcagctcagagcaccaaacgcagctgtacgaagtctacaaactcgattttttaatgttcaattactcagtgccaagctacctgaaattggaataaagggggtggggagagggagagaatcatgctttttaatttaagatttttatttgtcaaaagaattatatggatattgggttattttgtaaattaatatttctttggggatgatgctgcgagcagcatagtgagaattatttaaaatccttcgtagggaaggacagctgtctttgcaggggaaataggatgggtcgtccttgtctgtagaagtgaatactgcaacactgtctcaaaggtttcttgtgttctggtgaattccatgaattgtgcattccataaattctaattaatattatttatagttatttaaacatgg

SEQ ID NO: 166646 - DNA, 1301 bp, Homo sapiens
ttaaaggcatgagccactgcacccagcttagatatgtgtttgaacgggtggatttatgatctacttgtagccaagtggaaatgtttcaggcaagtactgagttcttattcgtcttgtgtctcctctgcagctggagctctcaaacactgctgtcctgcaccagatgcggcgggaccaggtgacagacacgtgccgagccaacagcgccacaagccgtaagcggagggtgctgacccccaacgacctgaagcacttggtggtggatgaggaccacgagctcatctactgctacgtgcccaaggtggcctgcaccaactggaagcggctcatgatggtcctgaccgggcgggggaagtacagcgaccccatggagatcccggccaacgaggcacacgtctccgccaacctgaagaccctgaaccagtacagcatcccagaaatcaaccaccgcttgaaaagctacatgaagttcctgtttgtccgggagcccttcgagaggctagtgtccgcctaccgcaacaagttcacccagaagtacaacatctccttccacaagcggtacggcaccaagatcatcaaacgccagcggaagaacgccacccaggaggccctgcgcaaaggggacgatgtcaaattcgaggagtttgtggcctatctcatcgacccacacacccagcgggaggagcctttcaacgaacactggcaaaccgtctactcactctgccatccctgccacatccactatgacctcgtgggcaagtacgagacactggaagaggattctaattacgtcctgcagctggcaggagtgggcagctacctgaagttccccacctatgcaaagtctacgagaactactgatgaaatgaccacagaattcttccagaacatcagctcagagcaccaaacgcagctgtacgaagtctacaaactcgattttttaatgttcaattactcagtgccaagctacctgaaattggaataaagggggtggggagagggagagaatcatgctttttaatttaagatttttatttgtcaaaagaattatatggatattgggttattttgtaaattaatatttctttggggatgatgctgcgagcagcatagtgagaattatttaaaatccttcgtagggaaggacagctgtctttgcaggggaaataggatgggtcgtccttgtctgtagaagtgaatactgcaacactgtctcaaaggtttcttgtgttctggtgaattccatgaattgtgcattccataaattctaattaatattatttatagttatttaaacatgg

SEQ ID NO: 166647 - DNA, 1182 bp, Homo sapiens
aattcttccctccgagacccagcccgctgcttgccacttccctctccaaacgctggcgggggtgggtggcagcaccgaggcgattttcttcgtctttttttcctccgggttttgtcatggaaacgctgacacaacctccagacggcggccgagcccggccggggactgagggcttttgggaccctgcgggagcgcggcgcgcacaccgcactccccgggcaacagctggacgcgaccatatcccgggtaggggcggggggagcgcgacgctccgccccggcgctagggtccctccctcctcccggctctccgcaggcgccctcccctcgccgggggccgcgagttgcatttggtaaaacccagccccggaatatatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggccacttgcttgggatcctttatcctggtcatcttctatttccaaagtatgttgcacccagtcatgcggaggaatccctttggtgtggacatctgctgccggaaggggtcccgaagccccctgcaggaactctacaacccaatccaggtaagcttcaagcactctgtcagcatgtgaattttttttttttgtaggtatggatactaaaaactctaaaattgtggtctttgggggatttaaaacttcctttcacagcctggcattttaccttcagtggttgctttctccgtcaccctttttctatgtagcatctctgaaaaatctagcaggggatgtttagaattagagaaatgcctaggtttagtgctaagcattcagacctgcccagggtttgaactcctgagattaacagtctcaagttcgagcaatgggact

SEQ ID NO: 166648 - DNA, 2065 bp, Homo sapiens
aattcttccctccgagacccagcccgctgcttgccacttccctctccaaacgctggcgggggtgggtggcagcaccgaggcgattttcttcgtctttttttcctccgggttttgtcatggaaacgctgacacaacctccagacggcggccgagcccggccggggactgagggcttttgggaccctgcgggagcgcggcgcgcacaccgcactccccgggcaacagctggacgcgaccatatcccgggtaggggcggggggagcgcgacgctccgccccggcgctagggtccctccctcctcccggctctccgcaggcgccctcccctcgccgggggccgcgagttgcatttggtaaaacccagccccggaatatatagatcgttggagcgcaatgaagtagcctttggagagaagggagagggcccgtcggacagccacagcggccagcgcagcggcagcggcggcggcaccaccatcaccgctcgcaccccagccgcccggcccgcgaccaggcagcggcggccgccggcgggatcggaggaggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggccacttgcttgggatcctttatcctggtcatcttctatttccaaagtatgttgcacccagtcatgcggaggaatccctttggtgtggacatctgctgccggaaggggtcccgaagccccctgcaggaactctacaacccaatccagctggagctctcaaacactgctgtcctgcaccagatgcggcgggaccaggtgacagacacgtgccgagccaacagcgccacaagccgtaagcggagggtgctgacccccaacgacctgaagcacttggtggtggatgaggaccacgagctcatctactgctacgtgcccaaggtggcctgcaccaactggaagcggctcatgatggtcctgaccgggcgggggaagtacagcgaccccatggagatcccggccaacgaggcacacgtctccgccaacctgaagaccctgaaccagtacagcatcccagaaatcaaccaccgcttgaaaagctacatgaagttcctgtttgtccgggagcccttcgagaggctagtgtccgcctaccgcaacaagttcacccagaagtacaacatctccttccacaagcggtacggcaccaagatcatcaaacgccagcggaagaacgccacccaggaggccctgcgcaaaggggacgatgtcaaattcgaggagtttgtggcctatctcatcgacccacacacccagcgggaggagcctttcaacgaacactggcaaaccgtctactcactctgccatccctgccacatccactatgacctcgtgggcaagtacgagacactggaagaggattctaattacgtcctgcagctggcaggagtgggcagctacctgaagttccccacctatgcaaagtctacgagaactactgatgaaatgaccacagaattcttccagaacatcagctcagagcaccaaacgcagctgtacgaagtctacaaactcgattttttaatgttcaattactcagtgccaagctacctgaaattggaataaagggggtggggagagggagagaatcatgctttttaatttaagatttttatttgtcaaaagaattatatggatattgggttattttgtaaattaatatttctttggggatgatgctgcgagcagcatagtgagaattatttaaaatccttcgtagggaaggacagctgtctttgcaggggaaataggatgggtcgtccttgtctgtagaagtgaatactgcaacactgtctcaaaggtttcttgtgttctggtgaattccatgaattgtgcattccataaattctaattaatattatttatagttatttaaacatgg

SEQ ID NO: 166649 - DNA, 1505 bp, Homo sapiens
ttttttgctactggctgcttggagtttattttccgcttggtgccaggtgcacagttccaggtgtcaggaaagctagcgagtgctggggccgggcggtagagagcggggctctcactggtttttggtgtctgctgtgttgatgcgaaggtctgcttgctgcagccgcctagtttacagggtggggggtgggaggtgggagggcatcttctatttccaaagtatgttgcaccccagtatgttgcacccagtcatgcggaggaatccctttggtgtggacatctgctgccggaaggggtcccgaagccccctgcaggaactctacaacccaatccagctggagctctcaaacactgctgtcctgcaccagatgcggcgggaccaggtgacagacacgtgccgagccaacagcgccacaagccgtaagcggagggtgctgacccccaacgacctgaagcacttggtggtggatgaggaccacgagctcatctactgctacgtgcccaaggtggcctgcaccaactggaagcggctcatgatggtcctgaccgggcgggggaagtacagcgaccccatggagatcccggccaacgaggcacacgtctccgccaacctgaagaccctgaaccagtacagcatcccagaaatcaaccaccgcttgaaaagctacatgaagttcctgtttgtccgggagcccttcgagaggctagtgtccgcctaccgcaacaagttcacccagaagtacaacatctccttccacaagcggtacggcaccaagatcatcaaacgccagcggaagaacgccacccaggaggccctgcgcaaaggggacgatgtcaaattcgaggagtttgtggcctatctcatcgacccacacacccagcgggaggagcctttcaacgaacactggcaaaccgtctactcactctgccatccctgccacatccactatgacctcgtgggcaagtacgagacactggaagaggattctaattacgtcctgcagctggcaggagtgggcagctacctgaagttccccacctatgcaaagtctacgagaactactgatgaaatgaccacagaattcttccagaacatcagctcagagcaccaaacgcagctgtacgaagtctacaaactcgattttttaatgttcaattactcagtgccaagctacctgaaattggaataaagggggtggggagagggagagaatcatgctttttaatttaagatttttatttgtcaaaagaattatatggatattgggttattttgtaaattaatatttctttggggatgatgctgcgagcagcatagtgagaattatttaaaatccttcgtagggaaggacagctgtctttgcaggggaaataggatgggtcgtccttgtctgtagaagtgaatactgcaacactgtctcaaaggtttcttgtgttctggtgaattccatgaattgtgcattccataaattctaattaatattatttatagttatttaaacatgg

SEQ ID NO: 166650 - DNA, 433 bp, Homo sapiens
ggccgcgaagcgactccgatcctccctctgagccttgctcagctctgccccgcgcctcccgggctccggtccgcgcggcggggtccctgctcctgcgccccgggcgcgcttcccggacaccccggtccccgcagccaggacaaagccatgaagccagcgctgctggaagtgatgaggatgaacagaatctgccggatggtgctggccacttgcttgggatcctttatcctggtcatcttctatttccaaagtatgttgcacccaggtagggggcgcgttagcgtggttttgttggatattttcttctctctcgcgctctagctcgctccgcctgatttctgcctcttccaaccctacctctccgccttcggcctcttcggggctcctggctgcccagagctcctggctgcccagatctacccgggtcaccgcg

SEQ ID NO: 166651 - DNA, 367 bp, Homo sapiens
gcataatatatatttatatattatggatttccagtgcaatttatactacagataaaaacctgtagctgaaaatgtggccatttaatagagtggcctttatgtatatttagcagatttgatggtatgaatatgcatcatttgtcagaagcaaagtgcaacttgaaatagtagaattaaatcagttctgtggattacttaccaactttattttagatagtaatttcaaccagattcttcaacagatcttgtaacacagctaacaaacatcacagttaacaaatatgtgtccttttatgtcagttttcctggtcaccttcaaatggagtttccaattagcaggaaaacagtttaaaagcaaattataaca

SEQ ID NO: 166652 - DNA, 106 bp, Homo sapiens
aaactgatctaataaaactttcaggatgacgtatgcaagtacctcattcttgctgaatgtatttagaccactgctgacctagcatatcatggtatatgtgtaatta

SEQ ID NO: 166653 - DNA, 124 bp, Homo sapiens
acaaagtgggaattcactagcagacgcaccttacaagaagttctaaaggaagctcttcaggctgaaagcaggtgacttagatgaaatctgaatccacacaaacaagcaagcacgaggaatgcag

SEQ ID NO: 166654 - DNA, 162 bp, Homo sapiens
cagacttgatggggtgatgctacacacctatgaataccctggaaagtggcagaccctcctctgctaaattctggcttgcaagacttgtttgtaccattgaaaatactcattcaggccaggtgcagtggctcatgcctgtaatcccagcactttgggaggctg

SEQ ID NO: 166655 - DNA, 372 bp, Homo sapiens
  misc_feature (336)..(336): n is a, c, g, or t
  misc_feature (343)..(343): n is a, c, g, or t
ccctcagtctaccacgtccaaaacaagcgcactcagtttgtggctggcaggaggttctgagcaagccagctcgtccatccctctgcccctgtgcaagcccccacaaacaggaactgactgtttgcagcagagtcggagggcaggtgaggcagagacaccaggccaaggctactcccaacaccacactctgagccccatgacaggttcatctccacagtgctacggaaaagctgggctcagctctggaaacaggcgatggggaggggatgtgacaggccgctggcaatgggatccccaacatctatcagccagatctgtgccagactgcatgctgtngacacgnccgcgaatttagtagtagtagtagcgacc

SEQ ID NO: 166656 - DNA, 307 bp, Homo sapiens
tgatgggggcccaatagccctgactccatggggagctatggagctaggttgctcctacagtgggctaggtgtctatgcattcgcccagtcatgggatgtgggttgtccttggaagggtcaaccttgggtgaaactgaaatgattctctaaagggactgaaagctggatgaacgttgtacactgacagcactctcagcagttgaggcaacaagcctttccttgaaagaagatctgggctatgcctctccatgtctgccataaggttcatagtattattattattaagtcaataaattttcattcaaga

SEQ ID NO: 166657 - DNA, 418 bp, Homo sapiens
actcacatcccaccccaacagagaaaacattttaggagtttggtccaatttggtctccaaccagagcaggataagagcagagcttgatctccagttttctccccaggaggccaatgaaaagaaagttctgcttgcagttttggcaagaatgaacaccacagcctgtcatgtgtcccacagcaagatgacaccactgacctaaatacctgctcagggatactgtgccttcccgctcataatgactggcttggattcttccaaaccactaggttgagccattatggcttgggatcctcagcttctctcacacagattcaatcctcttagcaggtgtacatatcacaggtgaatgttcagtctttgggtgtggacacacacagacacaaggtgcccctcaattcattctctgcaagagcag

SEQ ID NO: 166658 - DNA, 210 bp, Homo sapiens
cccctccccgctctgtcctgtcgttttcttaacactcttcacacgcgcacttcctcctcctcctcttctctttttcccacccctacctttgggccctccttccttaacctccgctggccccccattccatgatccgtccacctgacacgctgggtttcatgcctctctttcccaggctgtgggttgtgcccttcactccttgccctcctc

SEQ ID NO: 166659 - DNA, 395 bp, Homo sapiens
ttactcctctcctcactagttttgtgacctagggaaattttgcaatctttctgagtttgttttctcatcaggaacaggataatacctaagtaacaggatagttgacagatttaaatatgatcgcatggcggtggacatgagccgtaattagttgttaagaatatattgacactgaactctcctttatccatgttaaaattgtagataaacaacaattgacaaagaatagacaaaatgttctaacataaatattcttcccttgtttctagaaagaagtcacacatacggtaaaaataattagagaggacctagttcatattgaacaatcttccccaaagcctgaaacaggtcttctttctaacaccagagatatcttgagtgagtccaacccctgc

SEQ ID NO: 166660 - DNA, 178 bp, Homo sapiens
ttcatgcagaaacacttggagaaatttaaagggatttagttgaaaagttgtttccaaatagaatttgaaaataacagatactttaagtgcatttgacagaattgcatattgaagcttcattaatgcatacgtggtgtatgggtatctgctttgctaaactggttttccttagtttatg

SEQ ID NO: 166661 - DNA, 441 bp, Homo sapiens
agaggaaatagtggcccttgatccaactatttaatatggccttagtagaattagctgtatttagggcaagtcagactttattgtgaaatgtaataggtgtctgcattctcttcattttaatcaaagaaacttaaatggcttcttttcttccacatgtcctatccttgacaagatgggcaatatcactaaggggcctggttttctattatctgatgctaggaagtataaacttgtacttactgttcttgtttctcttttatctgtgtatctttgccattctgttttctcaatgaatagtatgttctctcccattcaggtaccttaatggtgtctattttattttattgctgcataacaccacgacacagtgcaccacgacacagtgcaccacgacacagtgcaccacgaaaaaggagaacaaagaaaacagagcaccaaaga

SEQ ID NO: 166662 - DNA, 477 bp, Homo sapiens
tattcaatcatatgctgtctacaggagactcacctcactaggacacacatagactgtacatgaagggactgaaaaagatattccatgcatatggaaaccaaaagagagcagggttagctatacttatataaggaaaaatagactgtaattcaaaacctatcaaaagagatcaaaaaggccattatataatgataaaggagtcaattcatcaagaggacataacaattgtaaatatattcatccaacatcaaagcacctaaatacataaagcaattattaagtgatttcaaagaggaggtagactgcaatgcaataatagtacgggtattcattttttataacagaccatctagttagaaaatcaacgaggaaacactggacttgaattacactttagaacaaatgtacctaacagacatatgcagaacattgcatccaacagaaacagaatacactttcttctcaatggaacattct

SEQ ID NO: 166663 - DNA, 115 bp, Homo sapiens
cacaaatccactttttgtctctgtagatttccctagtctggactttcctacgaatggaattatacagcatgtggtcttttgtaattggctttttcactttataatgttttcaata

SEQ ID NO: 166664 - DNA, 167 bp, Homo sapiens
caatatttgtctaaaaaagcaatctctaaaattatgcatcataaggttggatgcggtggctcatgccataatgaagtgggagggagagacatataggagcagagcgtttgtatattattgaaactaaattgatattattcaaactaggttgaactagctaccgcgcc

SEQ ID NO: 166665 - DNA, 350 bp, Homo sapiens
cgactgtactgtataaagcttggagagacaagtgccaccatttatcccaaagggacccactgatgtctcttgggctagaagggcttcaaggaaccacagatttcacatgagagtctggaggctaagcaaagaatagaaagtcatcacaggaatctcctcttctgtccccctcacatatataaagctaaacataaatcttaaaagggcaacaccatgaaggagtgaaacagaaaaatcatacctcgagagatttacctatctcagccatgaatagatgcagaatggaaaaaggtctcttttgagaacttctaactacaagtctgcattttggagagttttggactgcactc

SEQ ID NO: 166666 - DNA, 877 bp, Homo sapiens
gtccgtgtggattgtgctagaggtagctgaccccttatgggctctagggggagtcatatgacttaagcctgtccatttatggttatcccatccttcaggacactgtgattctaatttagaagtggccttgagtgaccgaagccatgccctggattctgggactttcacaggaaccatgagtaaaaaggatttctgtatactaggactggtgagctataggcttggcgctgctggtggctgtcttatcattcaggaaaatctgcccaagaactagagccagtatgagaaaatgatgagagatgaaaaaagacaattattgataacatgacttgagctcctggatatagtcatgcctgaaaccattaacaccttgactttttgcttatatgcacaagcaaatttattcagtgctttagtttgagttaagtttctgccgtttttcaactgaaggagtctcaactaaaactacagttttcaagtttcccaagtccagtctctttctatcactctcagcctatttcttggtgttgacagtgagagaatatagcttaattgtataatactttaaataaaactatattgaaaatgcaatagggtttttttttcctactgatacaatcattattggcttaggtctatttaaaggaaaaaaagctaaagcacttgctgtatctgaactttgcctaaaaccaaattgcttcgccattataatcttgagttcatttcaactattaaactattaactcagcgagtagtgatcactaaaagggattatagagcttcatttttatgacttaattacaacaaagtggggacgcttttgtatagtataccttataaaaatttaggaggaagaactgatgataaaaggaatgta

SEQ ID NO: 166667 - DNA, 324 bp, Homo sapiens
tgtacatggtcttttgttccctaaaagactgcatcacacctctgattgggaggccaactgtcatttaactgagtgtttgagtgtctaaaaccaagttcagcatttgtctatctagcaagcttccctttccaacttgcttactcctctcaatttcatctgcagatctcctggttcaataaggctcaaaaactggctgttcccttgcattcctctctcttctcccaggcactcttcatccttttttctctcaggctcacccttacaatccaacaccttccaatggcctctcctagtccagtccatcctgacaccaagtaactggcc

SEQ ID NO: 166668 - DNA, 544 bp, Homo sapiens
ggccctccatcgggagtccaggcctgatgccacaagtcacttgtgccctgtccttggcactccctgcaccaaggcatgatggatacaggtgtctgtgtgaggctgtcctcactgcccactccgtcccactccatcccactccgtccgtcccactccggggtcgtttgtttgcactccctcctattcctggattcttccgacttcgggcccagaggaaagcagctgatacaaagaagcagctttggggggtctggtgagcctctcgtatctcactggagatgttgcaccagtctgtctaccagttatccatttagcttcatgcatggagaaaagacaattccaaagacttctggagaaaaaaagtctcttcatttccatctgcagatcttagtgtctctctggcataatttccctccagcctttcttcggtccttttagtaccatctgctgtagtttcatctttcatttaactgaaaatgtctctattttgcccttgtgtttgaaggatacactattgtataaacgtcatcccattgtcttccaa

SEQ ID NO: 166669 - DNA, 190 bp, Homo sapiens
aggcaaaatcacaatagtgagtaagggtgaccgcacagcaaaactgttcttctagactcatcttgcaccatagtggcagctgaaggaattgtgcaccacgatgcacccctgtagtcaggaaaggcttctaggatgcctgggagctgaacgaggtggtaaatgatggtgttggagctggagagaagtacag

SEQ ID NO: 166670 - DNA, 261 bp, Homo sapiens
ctccttccatgtccccgtccccttccgagttcctgtcctgcatcgcttctgtctccagagtgcactctttgtcctcttcctcctctgggtcctcatccaccgcttcctccctgaacttttctgccattatgggatcttcctcagcaacagcttcctgggtccttagcacgacatccactcctccttgcccttcagctctcccctccagtcctgcgcaggagtcggtcgacgcggccgcgaatttagtagtagtagtcgacc

SEQ ID NO: 166671 - DNA, 105 bp, Homo sapiens
aaattaagacatctatgcaatgctggagatagaatcttaccaaacctaatcaagaacacattaatggagaagtataggcctggctacagaaagaacagcaaagag

SEQ ID NO: 166672 - DNA, 302 bp, Homo sapiens
aaaagaaaagaaaaaattgttaaaacttgcagaagcagaagatgcttattcactatcaggtagtgaataaaatcgaactagagtgaatcaatcttaactctttctaaaaatgactaagtatcactggtttaagtaagcttaatttccaaatctcaagtacttgaaaacatattcctacaagctaaataagactgggctctgcatgttcccaatatggacaacttaataatttctactaataaatagtcattcccaccctctcccgcggttagaatccccaagacaaccaaaaaataaacttg

SEQ ID NO: 166673 - DNA, 210 bp, Homo sapiens
ggatgtcccgccccttccaccagcaggattcatggtttgttcacgtatttgttcaaaacaccggcaggcactattctagagcctgggaatcctagcagtgaataaaagagacaaagctcctgccctcatgaagcttatgttcagctctctgctccaagcccataaaaccttgcatatcccatcacatatttatcatgctgcaacaaattg

SEQ ID NO: 166674 - DNA, 122 bp, Homo sapiens
taagaaatccaagagagtatcaccaagatggaagccacagtgctgttttatgactgtctctctctctttctctctctctctctctctcacacacacacacacacacacacagagcatcactt

SEQ ID NO: 166675 - DNA, 611 bp, Homo sapiens
caaaatcctaggttataccaagactttatgttcattttgaattttctttattcatttttttcctctctgtgtatagaataatcaggagatattggtgggcagaactgttggttgataacaggaagcagagtatctgagaaaggccctcatcctgtttccttttggagctactgaggcctcacatgccagccattttaggatttgatgaaggctagagaagagttaaactgagccttcacttactcagcatcagtaggaagtagtgttggctacactaaaaacaccgttgtgccagtgaggatttggggggaaaatgacaagctgcctgtgataaacaagcaaactgtgacaaactttttgatgtgtaggttctgaagcttttcagtttacgtcctcaaaagattatttatatatatatatatgcacacatgcacaatatagcatatatacttttgatatacatgaaagagaaaagatgagtggcagtaaaatagagattccaggatttgtaaacacagggcaatagaaatgacatttccggtacagtctggaggagcagcacccattttcagaaaggaaggtgttagggataaacttgacaaggatgtgga

SEQ ID NO: 166676 - DNA, 542 bp, Homo sapiens
tccatttctattacacatggtcaggcatatgatgagaaatgttctggctaacacaatttcatcttataactgtcctagaaaatgaaataaattgttacagcattggtttcctagcagagccaaaattatgcaaggaggaaagcccttctacttttcctcatatccctgtactctctctgataaatctttctctctttccccctctccatttacttttggtgctatacagattcaatttattagacaattactaaattacctcatattattgcttaaagtgtatcttctcttctttaatttgttaagtttaataatctccagtgaatatccattaaagagcatatgctttttcccccattttgaattgttaaaagtcattagaactaggattttgagccaatctgaaatcagctagatattccttgtattgctttttttagaaaacttacttattgactgttcaggggaaggacatatttgtcctaaagcaggctgttaattatcatgaaaacttacctattggctgttcaggggaagcacat

SEQ ID NO: 166677 - DNA, 442 bp, Homo sapiens
aacaacaaacaaacaagcagacatttgcacgtgctgaacccattgtacgggaaaggcctcagttaaaagtatttctcttccaaggcagtggcttaggggctttgcttaaattgtatttaaatagccatagatcctgcatagtgacaagataaagaagagaacagtttcagtcttttaaaagtcaggaaaatgtggagagatagtaaaacctgttcccagatttctctggtgcctgctggttccttctctgggccaataaacaagtgctgtctccagtaaagaaggactgatgtcctgccaccaggcaagtagaggctgaggaagtgtacccctgccttttcagtgacttgactttagcaatcctcaatatttcggggagaaatattttggcttccctcagtttgaagtgttaggtttttgtttcaccccagctatggaattc

SEQ ID NO: 166678 - DNA, 380 bp, Homo sapiens
ggggtaaaatatttcagtttctttcaaggcctgctatctgtcacatgatgctatactagagtcaggttggaatttggtgtcttatgctacgcagaatctgttttgttagtcttaagatctctgtttgaatgttaatgctggtcagctgtgcctgaattccaaagggaggagggtataatgaagcatgtctaaccccacctcttcccatcatggcctgaactagattttcaggtttacttcggaatgcccttggctgagacgggaatccatcagttggttgggggcttagagttttatttttgggtttcagaatggatgctctaccagaaacctgctgctactgcattctgctctcacccttgccatcggctcctgctgcc

SEQ ID NO: 166679 - DNA, 489 bp, Homo sapiens
tgaggtggtgtgacaggaacttggggtaacgccttaggcctctggcaaggattcttacatcagagctaataggtgaatgtgtctcattcaaggtgggtgctgctctgtgctaagtcttgggcatggagccattgtatctgtacagaaaacacttgactaggcaccatggggacaccaagagagaaagacccggatcctgccctcggtttaagtcatggattatgttcatatcactatatgaattacataaaccagtgaaatctatttgtatagatgagatcattcattcgcttattcattcagcacatatttatggagcacccatgatttatgtagccactttgggggtccagaaaagtcaacataacccaagtttcccaggctccaggacagtgctggggtcacactaatgataatggccatactttctggttcttctctctactattcagtgagcgcttctagcaccatgccccccacccactgctc

SEQ ID NO: 166680 - DNA, 272 bp, Homo sapiens
tcttcctctcatcagtctcttttattcctttcgaagtatccctctttacaacttttccttatttctgtctcaccacccttacttcaaagggtggtttctttgcggttttctatggctttttactccactctgtgcctcttaatgtatacacattcttattgcagaatatttatgcacttttggaagagctaagagagacatactactgtataaattactaataaaaatatattagccatgttttataattaatcagtatcttaccatcacag

SEQ ID NO: 166681 - DNA, 407 bp, Homo sapiens
tgtgatggtaggaacatgaaaggagagccagatgcagtcaacagagcaaacagattgatgacttgggggaatgcagtaagaccaccacctcccaagggccatacacgtttctacacatgtccctgttctgtggttgctttaacaaatcataacacatggctagcttattctgtatcaaaacctgcattattttccatgaattcagaatataaactattgccctggccaatgctgatgtcggggacatacatggagaatgtgcaatgtcatgaacattaatatgactttgtgagctctgatccttaactttggtgtgtcataatcattggattttctcactaaccagtaatttagtaagatagtcctctggactgaatatctgtgtctttccaaaatttgtatgttaa

SEQ ID NO: 166682 - DNA, 367 bp, Homo sapiens
tgagctgtgattgtgctactgcactccagcctgggcaacaaagtgagaccctgtctcaaaaaataaaataaaataaaaagagcctcccaaaaaacaactgaaagttaacctggcctaaatctctcctgtggctcccttcacacttaaaactcatcttaatgcgcaaaccgtgaacaacagcccccgtctccccagcctcatttaccacaccccttacccacttcactccaagtacacagactgccttgatgatctctgcctcccccgaacctcttcactcccctttatgacacccagaaccctccctgcttcctgtcattcagttccctgcttaaacatcgcctccttgaccccctgtctacagcag

SEQ ID NO: 166683 - DNA, 715 bp, Homo sapiens
aacaaggcttggttgtaaaactatgcaagagtgtagttcagctctcctgaactaattgggtagtaagtatgcaccaattgctgttctgccctgaatatgacatgaatagaaaaaaccctttagtagcaaatggatattttagcacatagcagaaaattaattttgtttctcagttagctcatatatatctgagtatgtacacaaacacacacacacacacacacaattttctgactatggctaattcctgaaagcatgctgtacttacaaaggatgcttttgctctgtaggaattcaccaaggtaaaattttcaaagcatatgaagaggattgttgaaattaattaggaggtgaggggaatcttgggatatctacttcttctagcctctgagctatggcttggaaccttggtcagccttattaaggacttccttagtttataagtgtatctcccatgggatcacaaatgctttcttgtttgatttagttcatttgaagaaacattaagtttctcctactcatttattcattcagtcacgcattcacccagattatttattgagcacctatactatgtaccaggtaatggcagaagataagtatatatcataccttttagaactataggagtgacactctccccacgctttggctggcattctcttctttttcctaaatatttctgcactagctagccttcagaattgggattttg

SEQ ID NO: 166684 - DNA, 429 bp, Homo sapiens
gcaacacagtgagaccttgtctctacaaaaaattttaaaaattagctggctgtggtggtgcatgcctgtggtcccagctacttgggaggcagaggcaggaggatcactcaagcccaggaggttgagggtgcagtgagccatgatctggccactgcactccagcctgggtgacagagcaagaccctgtatcaaaaaatagataataaaataaaaattgataaaaatagatcaatgaattgttagtctacgaatgatagtcatttttcacaattggcagtaaaaataggatttgtgtaaggtatgagtttaccatatttgttcattagatcttagtttcaagggaaagtatcatgtattttccagcatgataatgatgaatcatttaaagtacggctcataaaaatgaaaaaaaaaattggaagaaaaaaa

SEQ ID NO: 166685 - DNA, 367 bp, Homo sapiens
tggtgatctagccatccgcttacagtgctggggaagtgcaccgggcaggtaacctgcaaggctcttatcacaggaagagtatgcagactcctgctctaacctacacgtgacggaagggagctatcaccttgaccttgatgagcgtgaactggtgcaaaagtagccagagaccgcgtgtaggtgaatgaacttggccatgttgctatgtaaccgtgtggactgaagtttgaattttgcgtaacttcacatcacaaaatattgttcctttgatttttttttcaaccacttaaaaagtataagaaccatacacaggccatagaaaaacaaggctgagttcagctcagagagcctgacagtagggcacacc

SEQ ID NO: 166686 - DNA, 471 bp, Homo sapiens
tcctgaaatattattattgccaattcatgtgctttgctcatttcttttttggtgtgttatttgaaaaataggtttgcaagcttttataaatgctaggcttattaatttttaaaaggtatgtataatcttcaaaggtcattatttgccttttaattttgtttatggtgagctttattgatatataagcattaataaatttcatgcaatcgaaactacttggcattttcatttagggtgtgtctgtgatgatttgtattctctttttttttacagataggttttcttttgtcttgatggtatactggattttaactcttttcttcttttagatcaaatgcatatttccttcttcgtggtggagcagtggtgtttttagtccttaactaaccacttagcttattctgtattaagaacattttttcccacttagtatatttttgaccctaaatctgctggctaacttgatagtct

SEQ ID NO: 166687 - DNA, 328 bp, Homo sapiens
agcctgggttatatataaaggaaagaggtttcatggactcatggttgtgcaggctgtagctgtacaggcatggtgccagcatctgctcggctcctggggaggcctcagggagctttttactcataatggaaggtgaagcaggatcaggcacatcacatggctagagcaggagcaagagggaagagatgccacgcccttaaacgaccagatctcaggagtcctcactcactattgcaagggcagcactgagccatgagggatctgcctccatgatcctgtcgcctcccctccaagtcctgcctccagcattggggattacagttcaaca

SEQ ID NO: 166688 - DNA, 579 bp, Homo sapiens
acaaacaggcagcaggccatagtttgccatcccttgctctagaccacagatgaatggctaatgaggacccatcataaagcatggacaccagtagttctctcatggacagatgacaaagcaggcatcccccggcactcgcgatgaccaaaggaaagtctcaggaaagcacgaagatccaacagtcatactagtgctgcagactttcagaatgttttaaacctatctgtggtttaaacagacagacaaaaaataaaatcttaaggctaactggccttgtctactaggtttttgaaggatagccttggcccccaagtgcctgtcatttcggttttgtaactctgctttaatgggcttctagccttcaccatccagcagtgccactcttgtcagtgaccgctgttttgaaggtctagtggacctgtcagttcttaaatttgtggcattttgttctccccggggcttcattcatactatgtccttccttttttatctgcccagattctcttttctcccctccatttctgagtgaaatccctcccatccgacaggtctgagactaagccccaccttcgttgtcgg

SEQ ID NO: 166689 - DNA, 313 bp, Homo sapiens
caatccaaactcatattgttctatcgtcaactgaagtgagaagcaaggcctaagtggagtccacagggaggttgggcagctggagggttggttcgttggtcttgagagcgtggaacccagaactgtactgccataagcacttttcatggtgacttctgcggggtcttttgggagtgcaggaatcatgcaacttaccgaagtattatctggaaaatcacagagatcatttaggggggctacctttgtttttttttttttttttggagtattttgggctgcacgttaagatggttatagatgcattttggatgca

SEQ ID NO: 166690 - DNA, 181 bp, Homo sapiens
cacactccctccggaggctccaggggagggtccttccttgcgtctccaggctcttgctggccccaggcgtctgtgggctgtggctgtgttactccaacggctgcctccatcttcatggggctgtctcctccacatgtctctgtctcttctcccctgcatctctgtgactttttcttctctt

SEQ ID NO: 166691 - DNA, 341 bp, Homo sapiens
aaacttaaccaggcatggtggcatgtgcctatagtcccagctagtcaggaggctgaggcaggatgattgcttgagcctaggagtttcaagactgcagtgagctaagatcatgccactacactgcactccagcctgagtgacagagtgagaccctgtctctaaaaaaataaaaatatatgaaggcatctggctcagtgcctggtccatagtaactgctcaataaatgttagcttttgttcattttacttgagataaaatgagagaggacgcttgaaaaaagaggaagactagcatcctctttggaaagctggggttcttctagagaacctgctagagggttt

SEQ ID NO: 166692 - DNA, 525 bp, Homo sapiens
aacggtgaacaagttagaccagctaagaagctccccaatttagctgcatgaatagctattgaataccagctttgggccaggcacagtgctaggttccagaataaagaacatgaatcttatttatgaaaagcacagcctgggctttctgaccatgttcaagggcaaggttgtcatggcctgaaatagtccacttagaaatcttgcgtgcctgctctaagacagccttgctcaccaatggggcaactaatttacttcaattttatatttttgcaaataatatttaaaaatataaaccatgattcatggtatgttagtgtttagattatactatttatgtctgtggtttccagaagagaatcaagctggaccacctcatccctgatggccatcgtgagtgcttgagatctgcttctaactaggcaggatctcaggtcctcagcacctataaacatggttattggctaaagatctaaggttccatgttatgtccaatcttttctaagctggaaactgagcaattttcag

SEQ ID NO: 166693 - DNA, 354 bp, Homo sapiens
tgacagaggctaaatgaagaccaagcgtgatgaaccatctaggagaacacacttcagtcagatagttttctgagttacatttatcccgtgcacttgacaaaattgataaaacttgcttcagataaagaagcactgaaaaataaaaatacaataacttgatttttgcccccagtgctatccctcttctgtgagatgttcttgagctagtattcactttaaccttgcatgaagtttagtaaagagtctttctttgatcttttgaagacactggatactttggtttccttactgtttcataagcatggatctaatttcattttcccaattaaacctgagcaattatatatttaggca

SEQ ID NO: 166694 - DNA, 287 bp, Homo sapiens
cctaatcatccaccagagaacactagccatgttgaatccacaggttggttagatttctgtaaaagtctgaagatttcattccaatcatccctctaattctcagacatgcagttttatcattaagccaggaccattaaaacctgctttaaaagcttgttttgtctaaaggacttaagggagcaggaacagatggggatagatggcaaaagtgggcccctgtttgtcagaaggtaaagatattgtcccctaatctgttttctgctcctaacggcttttccacttctcag

SEQ ID NO: 166695 - DNA, 432 bp, Homo sapiens
cctgaacaacagagcgagactctgtctcaatttaaaaaaaaaaaaaaaaaaagggtaaaatcaaagatgttgatcgccaccacagatgagggcatttggtcaaggaaatgattccttggagggattttgaaaaaccaaatgtactcagaaaaagagctcactcaccttgttcatggagagagggatatctgctaaactaagggtagaacaagcaaagaccaagcaaagacagacactgtacaactggaagaaagtgccaatgaaggaatcacagcagtgaaagacgctctagtctaaatcaccaggactagttcggggttgctctccttgacatcctggcctgacctacgtgatggtaaagaacatgcatctgtgggggcagacagactggttttgcatgtcagttctgccacttattagctacgcaacctt

SEQ ID NO: 166696 - DNA, 382 bp, Homo sapiens
tagggaatataaatttgctggcgacataaatatgggaataaataaatgccaatgtggctacgaaaaagagagtacaaattaaaatccatctttaaagtacggctggtgctgaagccgctccatgtgttcatggggcactcacaggcccaccgctaacataaactgcaggagccagcaacttgctttatatccattcctaagggcttggaaatggtggtctcagcctttcttttcatgttggtaattctgaatggcagaagggtcttgaaggcctttctccttatccaaacagcccaagaatccaacatttggtcaaagtttatggatttgccaataacctccaccctgcacccccggccccagcttcctcccacaatggccc

SEQ ID NO: 166697 - DNA, 277 bp, Homo sapiens
tgagcgagctcggtaccgggttcgagtgaagccctcctctgcaccgtgagggcaggtcccgtgagttctctctttaaaggctcaagggaagacctcactgagagacagagactggaggtggagactgaattaattcagcaataaataagaaacagcaaaggtctgcaaaagaaaagaaacaggcgaaggacaagaagggtattttacaaaagtagtacaaacaaccactaaatagaaacagtgatgaacttcactcgaacccggaccggcctgatcg

SEQ ID NO: 166698 - DNA, 514 bp, Homo sapiens
attctcgcacctcagcctcctgagtaactgggattacaggcacccaccaccacacccagctaatttttgtgtttttagtagagatggggtgtcaccatgttggccaggctggtctcgaactcctgacctcaagggatccacccacctcggcctcccaaagtgctgagattataggtgtgagctgttgcgcccggcccccattcttgtttattttacttacctttgggtggtgaggcgccacggctcaccgtggcaacagctggcagtgcagccccaccacgcagagagctgcaccagcacctgtggatggcatcccgaggtgccaggcgaaccctggggcttctgtgtctctcctacaaccttcgctcccaagggtttttaatgatgctcttatttttgcattaattgggttgtatcccatcacctggatgtgattaccgagaggagtatagcaggatacccgagtaatatgtgtgcgatgccagcagaaagacgtgaagagagtaaatgaata

SEQ ID NO: 166699 - DNA, 551 bp, Homo sapiens
gtccagcagatcggcatcctgaagccgcacccggcctacgtgcagctgctggagaaggctacggagcccacgctgaccttcgaggcggtggatgtacccatgttttgccccccgctgccctggacatcgccgcactctggtgccttcctgctcagccccaccaagctgatgcgcacggtggaaggcgccacgcagcaccaggagctgctggaaacctgcccgcccaccgcgctgcatggcgcgctggacgccctcgcccaactgggcaactgcgcctggcgcgtcaacgggcgcgtgctggacctggtgctgcagctcttccaggccaagggctgcccctacctaggcgtgccggccccgccctccgaggcgccccagccgcccgaagcccacctgccgcacagcgccgcgcccgcccgcaaggccgagctgcaccgggagctggcgcactgccagaaggtggcccgggagatgcacagcctgcgggcggaagcgctgtaccgcctctcgctggcgcagcacctgcgggaccgcgtcttctggcggccgca

SEQ ID NO: 166700 - DNA, 296 bp, Homo sapiens
ggggctgggcgggactcacccctctcaataggcgacgctcacacagaggccaagggacgtggggagggaagccattcaccgtccccacggcagcgtcccggtctgcctacccacggcagctctgctgcttgaacagaaaaacagattctttgaaaccacagagggcctgagtttccgagattgccaagctggggtcagtgccccagctcctggcatatgagggcctcggaagggtcttcctgtccagccttctcccctgggacttgagtcttggcccattccaggccagtagttgt

SEQ ID NO: 166701 - DNA, 391 bp, Homo sapiens
tcaccactcatggacctaacaggccactcctctttagagattaggaagtgagagtgggaagccagcacccaaagcaaacacaaggcaaacgggcacacgtgaccccttgtgccagcagcagcagacctcaggagggaggaaggagccaggtctctgcactgctccggctgcccgagctcccttacatcccaccacaaactctggaagactgctctgtgcaggaaagcagaactgggggccagcttgcttgcctgtaagccccaccatgtcttccaaaaaatcaccagcacctcatcttcctgcaactccagcgatcggccagaggaaggctatgtgcccctggaggctgtgggcagtgccaacagtattaacacacacggagggagaagga

SEQ ID NO: 166702 - DNA, 200 bp, Homo sapiens
tggagcaagataggaaaggggtgaaatcacatccgaataattagaaactgacactgcctttaagataggtatgaaaaacaaaattacttttaacattgacttcaattttgtgagcaacctcacacacaagcacaggacacactgactcttagcttgaacaatcgctgtttatggggtgatgtacatgatggatcaattca

SEQ ID NO: 166703 - DNA, 232 bp, Homo sapiens
agcaagagcgagactccgtctcaaaaaaacaaaaaccgaaaaaaccacctcactattctaggcccgagcccgagcttaaatatttaccccatatccaaccataagttaatcccgcacacaccttcatcagtttcttaaagaaactggtgccccagcacggggcatgccaacgtattagacaggcaacaacttagacatggggatgaaatgaattccatcttaaatctcaaag

SEQ ID NO: 166704 - DNA, 584 bp, Homo sapiens
agcctgattaagagagcagggagactctgtaacagtgacatgtgattttaagatgttttgactacattgtctttgtatatgtttggaaaataagcatcagttggtaggaactggctgactcctggtctgtactgataatggtgctgggtgcccttggggtataaaggaagaagagggcatgacctcagtaagaagtaaaggtgcccccgcggaagacaagagttacagggctcggcccgccaagccgagcatgccgtggaaccacggccactcaaagttgagcgatccgctttttcaacaagtcttttgatactggacattgcatctccacctgtgatgctgaacattatgttgatgaaggtgatcgccaggatacaagaagataatgtttgtgaaacataaagagtatctgcaaactattactatgatgactactattattcttgttgttttttttcccatttttaacctagaattaaaaatggagcctgattgactactccctggcaaatagtagatgatgagtaaatgtaagttgaataatttattgaatgactaaaaataaatacatgtatttatgcaaa

SEQ ID NO: 166705 - DNA, 183 bp, Homo sapiens
tgggctccctggcttactccccggtggtttgtagtcattttcatcatgactttgcggttgcattgatatcagaatgagtttcgactgctgtacgtgatgcttccatgctccattgctttctctcttatgttgctaacgactctcctgttggcttcagcccttagccaagcccaccccactcca

SEQ ID NO: 166706 - DNA, 689 bp, Homo sapiens
ctggcgggttgggaaggtgggtgagggaggatggtggttagcagttgactgctgtctgctcatggtgtaaattctggggatggagcagccttgaatgggctgtggccttgtggccagagaaaccaggcttttgtcatgaggccaaggaaagaactttctggagccgaggtcagttctcatttctctcaacccccaagggccctgagggactgggcttgtttgcaggtttccaggaggcaagtgcggagggccccgggaagggaaaggccatgaggcagtcactggggccctgtgcggtgactggatatcactcctgcctggcattggcacggggcttgtcctgcttgtgtgaactatctgccaggcttcaccagaccaggcttcgagtctcaaacgcaggatggtgttcctgatccctctccaccgtgaacggatgcttcaacaacaccttaccctgagtctctaaagcgcttcagaagaggagggaaaaccaacccgggagacaaatgtttatggtttggctgaagcaggcggtgttttaacactaacatcctgctgcctcttccttaaattaattggcttcagactccaggcccacacaggttagaatttgcaaggaataacagacaaggaggctccccggaacctgcagcacccatgccatgctgcattgaaccacccagcagctg

SEQ ID NO: 166707 - DNA, 303 bp, Homo sapiens
gttgaatagtggtagattgctagatctctgccaaaaaccagcagtaatgcagggcaggaaagctcctttgacattttgatttctgtcccttgttatatttgttcaaatcttgtgcaacccattcgcccttattctttgaaattttcaatcctagttctgtgttctctattaatacttctatagtgaccttgtgaaattttaatgtccataacatgctctctctaaaatcctagccttaacctcctttctgccagtgctgtttcttcccatggggcttcagccattctgtcccatgatctcagc

SEQ ID NO: 166708 - DNA, 403 bp, Homo sapiens
aagtttacattttttaactttaataatttttaatgttttaatgaagagtatgaagagtagtagtactgctcttcaaagtactactactttaccttaccttttactgttttgttaagaaaattaggccgggcgcagtggctcacgcctgtaatcccagcactttgggaggccgagacgggcggatcacgaggtcaggagatcgagaccatcctggctaacacggtgaaaccccgtctctactaaaaatacaaaaattagccgggcatggtggtgcgcgcctgtagtcccagctacacgggaggctgaggcaggagaatggcgtgaacccgggaggcagagcttgcagtgagccgagatcgcaccactgcactccagcctgggcgacagagcgaaactccgtctc

SEQ ID NO: 166709 - DNA, 322 bp, Homo sapiens
cctcacgcttaatatctgatcaccttaggctgtcttcagcaagaattcctccttacttctacccatcatgcctctcctcttagcaattttgtatccgttgaccccctcactctgctccttggctgtgaattcacactgattttggttgtatttggagttgaggtcagtctgtcttgctgttgtgatagattgacccctattgcaatagtcttgaataaagccttaccatttttgacaagtgtcagaacaatttctctttaacagtgtcactaccagtattttcagtggccttagattggtacttgagagagttttttagttc

SEQ ID NO: 166710 - DNA, 437 bp, Homo sapiens
ttaattacctggtaatgtcgcagctgcactgctacctgtgtattttctgttttaatactggtagctctcaccacataagcttaattactgggggcagagtgacatgctcgtgcacagtcaagattccactaaaatggtttgatttcgttgtaaatagtctcgtattgcctaatgcattaaaactcttgaaatgattgtattgctaggccctttcttcaaaacgggctttcttcgcattatttagtttacaggtggacttttttttttttaaaggaagccaaattattgaatgtgtaagagtactataaaaagctgattgctcatcttgagtgtcaagacccagttccgggtactttattctttagatttggtagtgtagcattatcgaccctctgccctatgttgctgtactgtttcctttaaaaggaaatggctga

SEQ ID NO: 166711 - DNA, 514 bp, Homo sapiens
cccaaacccccatccccagtctctccctcacatttcactctactaccagggccttatgacttcattcttcaatttggaagtattcatttagcagatatttctgtgtcagtgactatctcaggccttggggctgtagtagtgaccagaagagacaaaatgtctgccctcatggaactcacattctaccaggggagacaggaaaacaaaataaggatattaggtggtggtaagtgctgaagaggcagaagaaataaagcaaggacaggatatgaaatgttctgaaggggaggggacttgggattttagttagggaaaacgggaggcctcaccggcaaaatggtttaagtaaggacttgaaggaggtaagaaaaaccgtgcagataccagggaggaacattccaggagaaggaatggcacaggaaattctatatacaaacatggaataatgtagatcctggatggccaatgcagggcatctaagctgccattcttgtctccatggcacatgtgtttg

SEQ ID NO: 166712 - DNA, 542 bp, Homo sapiens
attctggtgcttccagagcttctgtggacacgctgccgtcagtcactgactctcggggaagggaccagtcggggggtttctgggtcagctgtgcattcctctgtcaggcaagcctcccgctcagcgctctgtgaccccacactgccatgagggattcttggtagcagaaggaccctggtcaccctgccccgaagtctgggagagaagtcctgagaggcagcagggaggctcccagatgaccctggagggcagtggctgttccagtggctgagaaagtgtcctcaggctggcaggaatcctcctgctttggatttaggcccgctcatactgggctaaggtagggctgatagtgggcaggttctagggcagctgccctgtgacccttattgctggggttgaattgtgttccctccccacccccaacaaaagatgtatccaagtccagcccctgatacttacatttgtaaccttgtttggaaatggggtctttattgatataatcaaggtaaaatgaggtcatactggattcgtttgggccctac

SEQ ID NO: 166713 - DNA, 1377 bp, Homo sapiens
  misc_feature (13)..(13): n is a, c, g, or t
  misc_feature (48)..(48): n is a, c, g, or t
  misc_feature (186)..(186): n is a, c, g, or t
ccgaggcaggagnttggaggtttctgcccctttccggagggtttgggngggctgttcgggtcccgtttaaaaggcccacacaaaaacagcccccccaggttgcaagggcctgttagttgtgttcctggaaggtgggcaagcagcctgatgggttaccattgggatttgccgtcgttatagcggtcnaaggggcctgtagcggctgcagggtcggtgagggttcccagccggccggaccttggtcgtctggcattctgcctttgaaatatctgggtggccggcgcctaggcatatggggttgtgctttctgtgttgtggtttgtagcttgcatcctccactgttcttagcgcatttggctctgtccatatggctgttggtactcatggccctatttggggttggactgggctctttttcttgggtctggtgggatttaagcaagaactggaattttgtaagatgtacagcagtgtcctgggtgttgtctgtctggtgtggggtgtgagcagttgcaggagttatgaacgtgtccatgatcgtgtggttggctttcccttgcatgtggtgaactttcccctcgtttgctaatgctgaaaggcagtgtcaggcagttcctacttgtgaaatgccttcttattaacttggatgtgttcctaaatcttgggagctttgcaattgcttgtagaaagatatgtgtgcaaaactgaatttaaaacgagcaccagggttgcaggtacctttagttctagggagccagctcccccaggcttccctggtgctgtgaagttgtttgagtttatttatggaaattaggtttgctttgagctgtgttaccttactcttggctcagagtttctctgcatgttgggaccctgatctttgatattgggtactgtttcaacatttgaggctaaatgaagcaccgtgtactgatgtgtaatgtcgtgtatcacaatctcaggataacactagatagccaagaatggcagtacctgttttgtctgtctacacgaattggacctcattgtttctgccacaatgtactgctccataaattccgccttatttccatggtattgtctgtaagttttgaaatctaactggtcatgaaaagccatttttcaggcagtatttaaaagctttttcccacaagtagaactggtatctaaaacattttttcattcaagtttggtaaggtgggagatttgaaataaggtacaacagtggttttggaaatcagctatcaagttttagttttaggggccaccacgtgacagaaatgatttatagagagagtaaaaattgtattccatttctcttggtattttagtgcatataaaaactaaataaaccactttcatatatcattaaaaaac

SEQ ID NO: 166714 - DNA, 549 bp, Homo sapiens
gttgaaggactcaacacttcctgatttcaaaacttactacaaaattatggtaatcaaaatagtgtggtactgacataaagataagccatacagaccaaggaaatagaattgagatttcagaaataaattcatacatttatggtgactgattttcaataagagtacgaagatcagtcaatagggaaaaaatagtctgttcaaccaatggtgttgggacaaccagatatccacatgtttaagtttaatccctacttacacatttgcataccctttatacaaaaatcaattcaaaatgctcaatgacctaaatataggagctaagtctgtaaaacttctaatggaaaacatagagtgaaatctccatgactttgtttttggcaatggattcttagacatgaaagcaaaagcataagtaacaaaagaaaatgcgtaaattggacctcatcaaaattaaaaacgtgcatcaaaggacagtattaagaaagtgaaaagacagcctacagaatgagagaaaatatttacaaatcaaatatctgttaagggcctggt

SEQ ID NO: 166715 - DNA, 365 bp, Homo sapiens
gagtgggttcttcagggagaggggtgtgtgcaggagtggatgaatctgtgcacctttgcaagaaaggatggatgagggagtggaacagtgactggggtctggggagtgagaagggttgccagccatctgtggtcagcaggagcttccaggcccaagtttggtgtgttgggaggctgggtgagaaggtgggtccacccacctctctagatacccaagaggctagtggggacccaggccaatttctccaggaggacatggatgcttttggggtctatctcttgtactccttccttcctcaccatgctgtggcatgcacggcctgtgctgggaactaggggtacaaagctgaggccagcacagccctt

SEQ ID NO: 166716 - DNA, 599 bp, Homo sapiens
tgtgctagtgatctagaggatcccacatttccacgagtcacccaggctggagtgcaatgcgccatctcggctcaccacagcctctgcctcccgggttcaagcgactctcgtgcctcagcctcctgagtagctggtattacaggcgcaccccaccacgcccagctaatattttgtattgttagtagagacagggttttaccatgttggccaggctggtctcgaacccctgacctcaagtgatccaactgccttggcctcccaaagtgctgggattacaggcgtgagccaccgtgcccagccaagactatatactcttatttcccgtgaatacattattgacagttattgaaaatattgactatagccccaaaaggcttaactggttagagatacagggcagacaaaggatagataaaaatggtgggggcaaagagtaaatgctatgggattctaaagggtatctgcatgagagagattcctttttgttgttgttttgttttgtttttgtgacagagtctcggctctatcacccagcctggagtgcagtggctccatctcagctcactgcaacctccgcctcccaggttcaaccaatacct

SEQ ID NO: 166717 - DNA, 261 bp, Homo sapiens
gcttttcacagatagggcctaaagaaagggactggacatatgcttttctcaaacatctagtgggcatcaagattgagacaggaagcttgttttatccaggctcctaatgcatccctggctttgggtctctgttttttagacagtacatcttgccagtctccaaatccttttgagaagaaggtaataactaaataaatacgatgtgaaatacaacgtaaaagtacggtcagttaattgtgtccttataagaatattaccctt

SEQ ID NO: 166718 - DNA, 560 bp, Homo sapiens
catcatagcttcacctaaactaccttaaatgtgctcaggacacttacattaacgtacagttgggcaaaatcatctgacaacacagtctcttgcagagtatcggttgtttaccctcatgactgtgtggctaactgggagccgaggctcagttttgctgcccagcatctcaagagtatcatactgctttctactgaatgcatatctctttcacatcattgtaccactgtaaagtcgaaaaattgttaaggcaagccgtcataagttgggaaccatctatacacatattttattatttccttaaaatgaattctcaaaaaatcaagaacaaattttggtatttattgccaaattaccctccataaaggctatacaaatttcctttctcaagttatacagttattttcatttgtatttcctttattattagtgattgtgaggttttttcatgtgtttaatgaatgtttgaatttgaacagggtatgtatgtgaatggtctaatcatgtgttttcccatatagataggaggtgtttgtcctttttttaatggtttttgttacaaa

SEQ ID NO: 166719 - DNA, 311 bp, Homo sapiens
aaccaggaagcagaggttgcagtgagcctagactgtgccattgtactccagcctgggtgacagagcaagattctgtctttaaaaaagaaaaaaaatctaaagctccacctgggttcattggattttccattttacctctgtgtatgtttcagaactttcatagtgaaaagtctagatacatgaagctccaccaagaagcaaaggaattcaaagtttgtgaaatatacctgctgcttttaaccaatggcaggcattagtatctagccagtttttcacatgatgggcctatctgcatagcagtccagaatgtt

SEQ ID NO: 166720 - DNA, 724 bp, Homo sapiens
gagagctgggctcggcccgcgggctgctaggtggcggcggcgcggggcggggaggcgcggcccggcggaggagggaagaaagagcgagccgggccgggagaggcgccgcgcccggtcccgcgcccggtcccgcacccgctctcagcggcccaagcagtttctttctgggtgacaagaatgtgcctcggttggtttttcttttttttctccatctccttaagacgatttccatagtaacctgatcaagtggctcaaaatcgcaaacctgaggatttccgcggcccgccggcaagacctcggccaggtttacaggaaatctgtcattttttattaaaatggaaaactgtgaagaaagaaaaagatagcagttgaagtcaaaattctcggatgactattttgcttttgaggagtcagcatttaaaaacgatatgctgatttggaaggtcctgggagtaaactgcaaactttattttttccattcaatcaatggattttttaatcattccttggagtcgatgaagttcggaaacggtgtgtgatggggaacgtggcgggccagtgtgttcctagaaattgcatcttggattagtttgctgcttttttgaagagattccattttgaagggcaagaacctaatgtgatggatttatcttcagaaatgaacagacatgggaagaatccagtgagtcacaagctagaagatcagaagaaggtaaaagaaatt

SEQ ID NO: 166721 - DNA, 333 bp, Homo sapiens
ttgtgtttcatatgagcctttctctgtgcatgaccagctctgagtgaggggattaggagcctccagccgtggttgacagacacctctgcaaatctggatcaccctctctgttagcctgggacgtgttctatgaccctgttgctttccttaatgtgttggctttgtgcttggagataacttgcaaatgttcgtcaagcagttgtgccacagcttttcaaatgtttcgcttctaattaagaaagggaattggatgtgctcttgcctggctatgttttttttttccctggcaggagaatgagggtgggaagaaagagcaaaagaaacagcaaagag

SEQ ID NO: 166722 - DNA, 682 bp, Homo sapiens
cccctcaccccgtgtccaccgcccatggccgggctcacagtgtctcagagccgtggtgagccatcctaggaccagtgtacctcacaacctttcagaccagtgaaggccagtgggctgggtggtccaggcatgtccccaacgcaggtccagccatctctgcacagaactggaatctcggttcatttcggtttcagcaggtcccatgtagttagcaggacagcacttgagttaggtctgagaaagaacgcctgtttgtcatggcatttcctgtaaggagcccagagccgtggccccaggttgggacggcggcgccagagctgggcctgagtctgacccaacctgtgctgagtggtcctgctggaatgggaaccccaagaggaccacccctctctaaaagaagggaaaacagtaagcgagagggaggctgcaggggcccagaccttggctgaccttcctagccatggtctccaccctccgagacccaggggccccgcagtgacagcagggtgttgggccacacagagcccgagtaggtaaaggaaggttctggaaaccacttttcagaacccaaaaggtgtctgggaaatggcgttacctgccactgttgttaagtgtttactttgtatcaatactgaattgttaaaaattttaatcataaaaaccaatggaacatgtttttcta

SEQ ID NO: 166723 - DNA, 296 bp, Homo sapiens
atggttcatctcaaacgcaaacgaaaattaaaatgatcttaggcaatttagaaatggcaactgagatgagagctggagagaggcctttcatgggaaggtgagcaggggttacttagagttgttaaagggcaggggggtggcgggaggttcaatgcaattttcttactttcttgattccctaatactccagtcctttggacttcttggtcttaaggctatctgaatgaccctattagacaagtttcccatcttccactgatcttccttcaccgtctctctactatttctcaaccttg

SEQ ID NO: 166724 - DNA, 223 bp, Homo sapiens
tgtgtagctcggactacaggtgtgtgccaccacactggctaattttttgtagagatggggtctcgccatgttgcccaggctagtcttgaactgacctcaagtgatcctctcgcctcggcctctcaaagtgctgggattaaggcgtgagccaccacacttggcctctttgtcttttttattaatttgttttctggaagagttcctcagcttcctcacttaacct

SEQ ID NO: 166725 - DNA, 306 bp, Homo sapiens
accttaaaaaaaattccttattttattcacttgccagaataatgttgcatttgaaccatgccaacggtagcttattaaaacagcatttatttttctcattcatgggtcagctgaacttgtctctagccttcagattgggctcaggtgggctttgtgtttgtcattctggagcctagttccagagagcagtggctgcttgagtgtggacttgcttatggtgggccaaagaggggcaagggaaagcgcatttacactttctcgtattccattgcccagagatggcatatagccgatcccaagtcagtg

SEQ ID NO: 166726 - DNA, 106 bp, Homo sapiens
ctgcaaagaagatgtgatctaggatttgtgccaagtgttatattctatacaggaaaatagggaaatctgtaaaattctggcttgggctgaaatcagtagtttatgc

SEQ ID NO: 166727 - DNA, 152 bp, Homo sapiens
actttaaatgataatatccaagaaagtatagattaaacccttaatatctttaaaaaatggaaataatggcatagctgaacccagtttggaaaaaggatggttggatgaagggagacttcagggatacttatcaatgactaaacaaagccaca

SEQ ID NO: 166728 - DNA, 506 bp, Homo sapiens
caaaacttgagttggtaaaatgatttgtcagagacattaaaaagtcagtgtaatcaagagtggtaaatgaagctaccctgtctgtgctctggggcccttgaaaggggaccaccaagggcagtgcagtgtttctctgcctcctgtttgctaactctgctcctgctcttctctcctgtgcttccgggctgcaggtctcactccatcgggtaagcgccacagggctgcgtgtggggctttccccactcccttgctgcccctttgctttccagggctccctgtttctttcacactgtgcctgaaccaacaaaactacactctgttttccagacagttcccgtgaccaggaagatagtttatagggcacttaatacatttgaacttattgaagtacatctctatctcatttctgaatcatttacaccatttcacttgctgagctctctctcaggagtctctttctctgcaccatttcttccggtgttgacagagcttcttagaattgaaaa

SEQ ID NO: 166729 - DNA, 403 bp, Homo sapiens
gagctgggaagagggaagggaccagggtaagttaaaaatgccacaaagctcaatattctaaccacaatccagctagtttttctggattcagtgtttcattagttgctacaagcttttggttggtttctagagttctgaaaagttgattctgccagtttctatcaggtttttattgcttttatggagggatagacttttggaggtcttaactctgccattttttctgatgtcactcagatatgtcaaatatggcttaaagaaaaaaactgattaagataatcagagctgggttgggtagtatgtgcctctagtcccagctactcaggatacttaagtgggaagattgcttgagcctacgagtttgaatccagcctgggcaacagagtgaggaccctatctctta

SEQ ID NO: 166730 - DNA, 213 bp, Homo sapiens
attttgacattcaccatcaaagaaaaaattttcaaacaaaacaattgtttctaagatcaaaactaccttactatgttacagttaatgaatatgtatacctccagagcattttaacggcatgtaaaacatgcatctataataaactacgatcatatagtaaaaaatttactttaacacacccaatgcagaatcaaaaagtgtgaagatttgaat

SEQ ID NO: 166731 - DNA, 249 bp, Homo sapiens
taaccatagcatagcaatctgtcactataattttctgcagaaataaatgttttcgtttgtcctgtaatgtctgaaattactgctaaagctggaaatgtgtttagctttctcagcaaaattcttaaaaggatattgtcagagccaacaatccagaattatctttactctttaaatggttcttcacccactttggtttgccttttttttttttttttttttttttgggggaaaacagggggggggggaccc

SEQ ID NO: 166732 - DNA, 485 bp, Homo sapiens
gggcacaagcactctagtcacataacatacgcccagcaatatgtcacaatacacctgtgggcagcaccaaggcagaagaggagactcaaatcacctaggtgcaatgcccagcgatgtcacaatgacccctgtgggctgtatcaaggcagaatagaatcacattaccaagggtctggatccagtgatatggcactgtgagctggacccaggaaacaacaaataactcagatgctaggccaaggtatatgtcacaattacacttgtcaaaaggccttgcgatgacattaacaattacacacatgtcctgagtcaagggatgagagtcaacacctcctgcatgttgggtgtaagtacagggtggactggatttgtgcgagagcctcaatttcctttgcaaattgtgtgccttagactgggcacggtggctcacacctgtaatctcagcattttgggaggccgaggtgggcggatcacttgaggtcagg

SEQ ID NO: 166733 - DNA, 230 bp, Homo sapiens
tcttgcccatatttaatggatttgtcttattattgagtttcaaaattattcagaattattgtgagttctgtatatgttctggatacaagtcctttatcagaaatgtaatttctgatctcttatcccactctggagcttgtctttcattttcttaatggtatctttttggagcacagacattttttaacttattataaagtccaatttatcattttttttcttttatggag

SEQ ID NO: 166734 - DNA, 212 bp, Homo sapiens
tctagggttctgggctcaggcaggagggcggggtcccaggaggtcatctctctctccttaccctggagcctttggaatttggtttccaaatgtcctgaattcctgttcattaatatgtggctcagtacagtgcttgtcccggcagcaggagcttggttggtgttagtctgctggggaatgggataaagcagagaaatgtcaagctttccctt

SEQ ID NO: 166735 - DNA, 299 bp, Homo sapiens
gttggccaggctggtctcaaactcttgacctcatgtaatatgcctgcctcggtctcccaaagtgctgggattataggtctgagccactgtgcctggccaatttttaatttttttttaacttttatttattttgcttaaaagttttgttttgatagaagcatgaatattattagggtgtgaaatataaggacaggctgggcgtggtggtgtacacctgtaatcccagctgtttgggaggctgagacaggatcacttgaacctggaaggcagaggttgcagtgagctgagatagcaccact

SEQ ID NO: 166736 - DNA, 298 bp, Homo sapiens
actagtggaaacagaaattctctccataacacacattgttggttctctgcagtacgttgtggctttccaacgtttcctttttgtgccttttctactggaaactaggctctaagctacttctgtgaacaggaaagttctgcctttagcagttaggagtaaaatgtcttccatagccaaattttagtctccatattgtcccatcagcatgaaaatagcccctcagttcctatgttcttttaagacatccaatctgtttcctactaaaatggtacttagtaaggggattctaagtttggaa

SEQ ID NO: 166737 - DNA, 613 bp, Homo sapiens
ggttgatctagaggtcccgacggttcaacggaatttttaaaagaggcaaaggcagaggagaacaaaggaaggaggaagtaacttgtggaatgttgaaaaaggtaaaaacaccttcaaataaggaagaggaacaggctatgacctaatgcttgtttggaccagtataagcacgccagggcaaatatttaggttaaattgtgggagctaagaacataaagtacattgatttctttattacagctagcagatatttaagaatgttagtacaggtctttgaataaattatgtttttaagagaagtcactatttattcccaatcagatggggaggaaagtctttgaggaggaacctccactttactttttacaccccccaaaaaataaatcccaagcagtataaacagagaaatccatacctaaacacaccaaaataaagatcaaagaaaaaataaaatcaaagaagagaatatccttaaatagccagaaaggaaagacagattattttcaaaggaaaaacaattaggctaacaactgacttatcaagacatgaacaacaggagacagaagactggaatggtgtcttcaatgtgccaagagaaagtaattattaacat

SEQ ID NO: 166738 - DNA, 555 bp, Homo sapiens
gtgttatgcatgtggtagttgtttgctagagtctgggttgtgtccccccagaattcatcttttgaagtcctaatccctgtacctcagaatgggattgcatttggagacagggtccttaaaaaggtaattacgttaaaataaagtcattagggtgagcgctaacccagtatgaatcctgtcttcttaagaagagtgaatttggatgtagatgcgtggacagagggaagaccatgtgaggaggcgtcggcaagccgaggagggaggccttagaaggaaccaccctgctgacactttgatcttggacttctggccaccagaactgtgagaaaagaaatttctgttatttagcaactaggtctatggtagtttgccgtgacagccctagtactaacattttgtttaataaccgttttcttatatattggctctcagggcccttcatagacatcttgccctggtccgtttactcagccttctgtcctgacagtccctcacaccttctatgcccgctgacctctcagtgttcactgaatacatcctgcctttgaatgcctc

SEQ ID NO: 166739 - DNA, 278 bp, Homo sapiens
caccatgcggcccacgcttcagtgtgaagacaccacctgtgtgttaatgggcccaacaccaacctgggtgcagggcaggtattcagcaaacagtgaatggacaccagggagctggctactatagcgacctcctgaggtcgcagggctaccaaacagtgcacggcatttgcaccccagctcaggcgtcccggcagggattctgcattgtctgcctttgaaaaaagggtgggagagttaggacaggaattttctctgtttccctctctctctccttctcc

SEQ ID NO: 166740 - DNA, 271 bp, Homo sapiens
cacctttctccaccttcccccacctccctcatcccagggcctggagctggaaagattacacccgattgcttttagggtggcccggatctgcagtgatcagatctgggctttgaggatccagcctttcggcctttcgtcaactgcattcaggggaggagggggagagatttttacacattctctgctttaccagttttgcaagaacatctggtcagattgtaattgttccaggttgcagctttactaaagcaatcgctcttttctgattaga

SEQ ID NO: 166741 - DNA, 279 bp, Homo sapiens
aggcgatctctagcaggatcccttcgatggcgggcacttaccactctgtacctactctgaggatggcttttttatttagttattagtttgggacattgttaatgttctgtaaagacaaatataaaacaaaatttgaaaacaaaaacagaaagagccacaatattgggcatgaataatccaaatctgagcactgtcaccacgtgctcctctcaaattcagggttttaattttttattctttattacagacaggatctccctaagttgcccgccaatcgaa

SEQ ID NO: 166742 - DNA, 420 bp, Homo sapiens
gacagagatgccttgccaggctgcacgctcttcacatctttgttgaacgtgtaatttccatccttgtcgaatgcataattcaaccaattatgcctttgatcaaatcgtttttttcacatgtaacaaaccttctctttaaaatcttttaccttcctaccaggaaaaatgatcttattttcgttccctttccaagccaaaaaaaaaaaaaaaattacctttgtcacatgagatgtgacaaaaattggcagccctttcctgagatatttttacagcgctttacaatgtgttacattgaaaagcgtacgaaaagtgtaatttcagtgtatgaaattacaaggttattttcatgtccattaataaaggttcatttgatcctcaccacccaggacaagagagacagcaaaggccatgagtttcatt

SEQ ID NO: 166743 - DNA, 124 bp, Homo sapiens
tctcaaagcctgaaagaactgatgctggggaagatgcccaagacttatttagtctaggctttttgtgtagattctctctctctttttaaaaaaatctacttatttatttttgattctctgattt

SEQ ID NO: 166744 - DNA, 258 bp, Homo sapiens
aggacacagacacagagggaagatgactatctgcaagtcaaggagagaggcctcagaagaaaccaatgctgctgacaccacgatcttggacttctagcctctagcactgtgaggaaataaatttctgttgtttaagccacctagtctgtgatactttgctacggcaggccctagcaaatgaatacacttgtcttgtctttcccccgccctgtgatatttatcagtgccggatattacatatttgtgtatctatatgct

SEQ ID NO: 166745 - DNA, 439 bp, Homo sapiens
cagcacagaaatcggcaaagggcatgaaaaggccattcagacgacacaaatgtccaattatcagaagagtataatctgtgaagaaatgcaaacgaaaatctcacctgcagaaaaatgcagataaatacaatgaaatacttttcttctatataacaggcaacaaggtaacaggcaaacaaggtaagtttgatgttgagtttagtgaaataggcaccgtcacccattgttggtagggtacaacctgggacagctttttgtttttgtttttgtttttgagacagcctcactctgtcgccaaggctggagtgcagtggcactatcttggctcaatgcaacctcagtctcccaggttcaagctatcttcttgccttagccacctgagtagcttggattacaggcgcccaccaccacacctggcaaatttctgtgcccatttcaa

SEQ ID NO: 166746 - DNA, 136 bp, Homo sapiens
gagctcggtaccccggcaactgcttcggatgaggattgcctctacgccctctatgacgcaacctatgagaccaagagagcaagaaggaggacctggtgtttatcttctgggccactgagtctgtgccccttaagag

SEQ ID NO: 166747 - DNA, 200 bp, Homo sapiens
tagtgagcaatctggaaagtaagcaggccaaatcaagtagggccttgggtcatcgtaagtacttgagactttatttgcggtgcgtaggaaatccttggggaatctgaagcaggagagtgacatgttctgatttaaggtttaaaaagaacacttggctttttgagttgagaaagtattgaagtgggaagcccagttaggag

SEQ ID NO: 166748 - DNA, 395 bp, Homo sapiens
acatttaaaaaaagaatatggagtgattttgatgcacatatacttgtggcaattcttaagaaacattaaggaccgagccagatcaaggtagaaggtaatggctggagaataatatatgtgtatttagaagacattagaaatctttttctccaaagggatacctataatagctttttcatctggattcctaaaattccaaatttcttaaattaccctgaaatatttccaaaaggaaataatttaaaaataaacagtaacattctattacaaaatacacttgtaaatctggattaacaaatatgttcagcaatatgaagaaagcattgaaaactctcctgaattaagtgattcaatgccaaacaacacattatccaggcactctagaatatggaatc

SEQ ID NO: 166749 - DNA, 352 bp, Homo sapiens
ttagagaagagacgagatgtacaagcagaagagacgagatgctgtgacaaaggcgttgacccacagggccttgggggcccagccagggaactcgggcttcaccctgaagaacaggagaatgccctcaagactgcaggcactggtgcagcgtggccagatgtgtttcagagagagaactctggcagcaggctgtattcatctcagtgccctcagtttctggatgaagaaactgtggacttgagtggggctgtcatttgcccgaggtcaagtggctgggtggtatccatccctagcttctgtcccagggctccttttaccacaccctgctaccatcccgaaagctctcactgca

SEQ ID NO: 166750 - DNA, 227 bp, Homo sapiens
tgggtctcaggagagacataagagttagagaaacaaatttttgagtcattagctagagcagacatttaaatctctaggactggataggagaccttggggagtaaaagaaaagggaaatgtatttgcagtatattatagaaacataatagaaaaaaatagaatcttctcatacagtaagggcaagtaggcaagtactagtccataaacattttatttcagagatcgat

SEQ ID NO: 166751 - DNA, 148 bp, Homo sapiens
aatagggagctgaatgtggagagcttctcacattacacatggatagcttcagacacagatgtttttacacatgtaccataacccccatgtaggcgaatttgggtttgcaatattcagattcattttgtatgatttgctttacagaatg

SEQ ID NO: 166752 - DNA, 190 bp, Homo sapiens
ctgcaagttatctatcattgaattctgatatttatgggtatttataccaattatatcttccacagataatatgaaaactctggtattatcatcacaaatactttaccttttaaaaactcattatttttcttttgtttatctcttgccatcttatctgcccacaaccaacattctggaacagtgatgctct

SEQ ID NO: 166753 - DNA, 350 bp, Homo sapiens
cctcattttacaaatgagaaaattgaagcctagagattaaagaactactgtgaggtcacagcctaatgtctcatggctaggaaacatgtaggtgcaaagaggggaggtggactgagatttacattttttctagctgtttggagtattatcagttataagataatgcactagagggcgctaaatacacaagctttagctgtttccataatgcagttcccacagtagtgaaagatatataattggtaatggatgcaagccaaaaaggccctccccaaaaaagatgcaatttatgataactgagaagctgtatttctgtcccctcaattaagaaaaaccctcattttatattg

SEQ ID NO: 166754 - DNA, 462 bp, Homo sapiens
gtgctatatcgagacatggtgaagcgggaaggcaagcaggcatgtgcaatgcaaaagcaaacacaaagagaaatctcactttatagcaactcactgtcacaatcactaacccagtcctgagagaaggagaatgcactgtggttagatggcattaatctattcattagggatccatccccatgacccaaacacttcccattaggtcctactccccaacaccatcataatagcaatcaaatttcaacatgagttttggaggggacaaactatattcaaaccgtatcatcctctattcccagtttgctgataatttatcatgaatgagtgctggattttgttaaatgatttttcttcatagattgacactatcatgtgattttttttttcttctttagcttgttaacatgatgaatgatattgactgatttcaaatattaaaccagccttgcatccctggaataa

SEQ ID NO: 166755 - DNA, 339 bp, Homo sapiens
gtcagtatcagtaactgattgtaattgttggattattcatagagggaatgtctttccccaggattccccgttgaatgatcttgggtccttttcctttaactcgaagcgatttggggtaggaggggttggagtgggggagaggttagttttgttttgtttgtaaatttcaaaagacatttcatgagaatgataatcaccacttattgttttaaaactgggaattctggtatattctattactatttgcatagaataatacaaatagcaagaaagaaaaccttattattgtatactaaaaagccatggatgagagtaccttcctcttgctaaaaacaaacc

SEQ ID NO: 166756 - DNA, 513 bp, Homo sapiens
ccattcaggtatacatgtgggcaaaactgtgccagcccagagtggagaggccactgcattctcctgaccttcctgcttcagcccagggcgtcaccagcctgaaaaccatccaagcttctctgctgtttagtgaagccttaggcttccacgcagcatgtgccacacctccttcctcccttccaggcccacatgccctctgtgctgtttggccctggacagccctaggttcatttgcccatagcacacataccctcatccaaggcctgccccagtcctgatttgcacatttgtgcaaagggcacaggctttggccagactaagtccaagaggccaaccctgagtgcctgtttgttcacacgtaaatgggcacatggtacctgcctcccaggtggggtgttgaacgagccatttatacttactttctctctgtagtctcaggacacgaagatggaccttcctgttctttattttttaaagatagagtctcacggccaggcatggtggctcacgcct

SEQ ID NO: 166757 - DNA, 287 bp, Homo sapiens
tccacttaacttcattaaatccaactgaacatacatttagtgtcttctaaatactacttgttatttagtcctgtgatgagctcagctacctgaggttgcaaaatgcttaactgtggagttgttggacaactaataattctgagagactcaagccaggctaagtggggttggcagggggtagtgggagggtcctcatagattggtcttgctgcactcctcactgtgacctcactctgtccaggaaggacactgtgagctatccctcactcataggcattgtagggtcc

SEQ ID NO: 166758 - DNA, 299 bp, Homo sapiens
agcaatcctcctgcttcagcctcctgagtagctaggattacaggtgtgcaccaccatgccaagctaatttttgtatgtttagtagggacagggctttgccatgttggccaggctcctgcacttttttttttcccattcacttgctgtctctcacacacacacaaaacacgggcatcctgctcttgaaaacaggaacaagagcaaataataacctctgtccccatggccacaatgagggtccttattagatgatgaacgtgaagcattggcacagtggaacctggtgcacacgttggcta

SEQ ID NO: 166759 - DNA, 284 bp, Homo sapiens
ttggactgaacttctgtgtttgttactcatctccccctctctcctttccctctcatcctcccaaccccccaatcaaatgaaagggaataacaaagagaactgacagataaccaaagagaagagaaagggtcaagaacaaacaagaatagaagataaagacaaaaaagcaaggacaaatgtgcaatcagagaccaaggcagggaatgctacagaccagaatatgcccagagggaactgaagtgggcatggcttggagctggcgcagggaatagcaggaaaaaatc

SEQ ID NO: 166760 - DNA, 327 bp, Homo sapiens
ctctagagatccctcgtctttgataggggggcatagcagggaaccttgtccctgcctcttcagagctcaagtctggtggcaagattgttggttttaaaaaacaaaggtgtaacacatgtgactatgatcactgtaacagtaaaacagacttgaaagaaaaagtagaaaaagaaataggattttatgagcagaaaaaaaacctgacattacttttttcagtattttctatgagaaaattcaaacatgtggcgaagctgaaagaattttacagccaaataagtattacatacaccatctagatgttaccattaatattttactgtgcct

SEQ ID NO: 166761 - DNA, 498 bp, Homo sapiens
aacatactcagaaaaagtaacatgcaaggtaattggaaatcagactttaaagcatgtttgaaaagatggcaagcatttccattggttttcatagttttttttaatgactgactccaaataagaaggatgtcttattatttagcttgacaacatctatgttaaagagactaggatctaaaccccgaagagaaattcagaaactagaaaaaaagaaaatgaacccggggtgttaagctgggaaccaaaaagagcacatttcaattcttttccaccgtaatgccacaaaaccgtaccttaaaacttctaagattacaatcttaggtaagaaaaggaaatattttcagttacaaatagacatgtctttgcgccttcattctagactttttttttggagacggagtctccccgtcccccaggctggagtgcagtagctctatctcggctcactgcaacctccgcctcccgggttcaagcaattctcctgcctcagcctcccaa

SEQ ID NO: 166762 - DNA, 535 bp, Homo sapiens
tgataggtgtcctcaggcctcccggtggccgtccccactgccgccctcctccagggtgctcccactgtcctctctccttgccctggccttccagggagagaatccggaatctgctcaccacaggcattcaacttctgactctctgttctacttctatctaaatcaacccagctatatctattgaaatccttcctgggtccaaccctactctgcctctgccttccactgtgccacggacaggtccctgtccctcctgagcctcagtttcccctctacaacaggagctgagacaatggagactctcagtcccagtggctccaacttccatgcggtgtttcaaggcaggcaatttaaggggcaaatgtatgcagatggatatgcaaatgggcatctccaggatttatgggtggccttaatttcaaggggaggaggcggcctcagcctggctggacccactaaatcctggccggtgtcagcaccgtaaagcactgtgatgaagggccggcaggcgctgggggcggccctgatttacagc

SEQ ID NO: 166763 - DNA, 379 bp, Homo sapiens
attagaggagacaagacatcatttgtcagacttgagaatgacatatcttacagatgcccactgctgatgtgaactatttatgttagaccacaaataactgataagtatgtgagttaatacatatgttaattagcttgattcagccatttcacaatgtgtacatatttcaaaacatgttgtgcaccataaatatataaaacttttatttgtcaatttaaaaaacaacaattcttccatactgacaaatagactcttacacaactataaagccaaaggcaagtttacaaataaataaaaaccaaaaacaagccaacaaagttaaaactgaagtgtgttggatgatgttattttgctgaaattaattgagcttctcgaaatg

SEQ ID NO: 166764 - DNA, 522 bp, Homo sapiens
gagggttctgatttctctgtctccttaccagtacttagtattgtatgtctttttgactatagccatccaagaggtatgaagtgttatctcattgttgtcaaccattgatttttgatattataaacaggtttcttttgtgtcatttgcagttagagagattttactctaactttttttcctaaagtagacttacttgttgaaatgaagtttttagtgagaaagtgtgatcatttatatctacttcatttgacagctcatgtatcttagaataacttagaatttcagcagcttctgcagcatcatatatgcggctaatagtattgatgcgatgaaaaatactgttctttacatttttgcttcttgattttttaactttttgttttgaaatacatttaaatttacagaaaagttgtaagaattcaccagttactaacttttagtcgcatttggtttctcatttttccgttatgcatgtaatttttttctgaaccattttagaataaggcgccagacatcctgaat

SEQ ID NO: 166765 - DNA, 485 bp, Homo sapiens
aaatagaatatggccaaattcttgtgacttgtgacaaaggttaaacttccagaaagtgccctagaagccataattttccatgataagagactagaatggaatgtctttcagactttatcaattgatgacaaatggagaaaaataaaagttcatttatggcacttctgaccaagctcatttccctagattgaatctgagtaattgcaatgtcagctatctagggttggctcttcaaacaaataacctggagtcataagcacactgtttatgaattcctcaaatgaaattctgggagtgagacaccactcaccctgcacatagtcaaatcttttgttgcctgtaatggagcttccaccttaagaaactagaaaaataagggcaaattaaactcaaattaagtagtaggagaaagagaataataaagaacagaatggagattagaaaattactagcgagaacaaacaaaactgaaaggtggttatttg

SEQ ID NO: 166766 - DNA, 360 bp, Homo sapiens
acatttattgattatgaattaattgggtgcccttttaccatggttttaatgtgcatcaatctgaatcagattgtaaatatgtggttttatgtttattgcaccatttctaactcagtgttcattgtctttcatgttcgtcaactgaccgtgtttcttcttagttaatatttcttcattaaagaaagtctggaaaataaatgtagagaattaaaagatgaaaataaaaatcagccaggtgcagtggctcacacctgtaattccatcactttgtgaggctgaaacaagaggattgcttgaggccaggagttcaagactagcctgggcaatatagtaaggccctgtccctacaaaaaaaaataa

SEQ ID NO: 166767 - DNA, 274 bp, Homo sapiens
aaaaaaacggttatggctatattactgctatataaaatagatactgtttgaaagatttttaatttatacattggtatttttctgaaaaaactttgtagcaaatacaagtcacacacaatacatttataagaaaataaaagttatacaaaatatatattatgccacagagagcattcagtgaaaagatttttattcattgattgataccttcctgggaatttttgaaattaaagtgatttgaaactggccatgccctctctctatgacagaatat

SEQ ID NO: 166768 - DNA, 1512 bp, Homo sapiens
atgctgccggactggaagagctccttgatcctcatggcttacatcatcatcttcctcactggcctccctgccaacctcctggccctgcgggcctttgtggggcggatccgccagccccagcctgcacctgtgcacatcctcctgctgagcctgacgctggccgacctcctcctgctgctgctgctgcccttcaagatcatcgaggctgcgtcgaacttccgctggtacctgcccaaggtcgtctgcgccctcacgagttttggcttctacagcagcatctactgcagcacgtggctcctggcgggcatcagcatcgagcgctacctgggagtggctttccccgtgcagtacaagctctcccgccggcctctgtatggagtgattgcagctctggtggcctgggttatgtcctttggtcactgcaccatcgtgatcatcgttcaatacttgaacacgactgagcaggtcagaagtggcaatgaaattacctgctacgagaacttcaccgataaccagttggacgtggtgctgcccgtgcggctggagctgtgcctggtgctcttcttcatccccatggcagtcaccatcttctgctactggcgttttgtgtggatcatgctctcccagccccttgtgggggcccagaggcggcgccgagccgtggggctggctgtggtgacgctgctcaatttcctggtgtgcttcggaccttacaacgtgtcccacctggtggggtatcaccagagaaaaagcccctggtggcggtcaatagccgtggtgttcagttcactcaacgccagtctggaccccctgctcttctatttctcttcttcagtggtgcgcagggcatttgggagagggctgcaggtgctgcggaatcagggctcctccctgttgggacgcagaggcaaagacacagcagaggggacaaatgaggacaggggtgtgggtcaaggagaagggatgccaagttcggacttcactacagagtagcagtttccctggaccttcagaggtcgcctgggttacacaggagctgggaagcctgggagaggcggagcaggaaggctcccatccagattcagaaatccttagacccagcccaggactgcgactttgaaaaaaatgcctttcaccagcttggtatcccttcctgactgaattgtcctactcaaaggagcataagtcagagatgcacgaagaagtagttaggtatagaagcacctgccgggtgtggtggctcatgcctataatcccagaactttgggaggctgaggcaggtggatcacttgaggtcgggagattgagaacatcctggtcaacatgggaaaaccccgtctctactaaaaatacaaaaaaattagctgggcatggtggcacatgcctataatcccagctactctggaggctgaggcaggagaatccttgaacccgggagttggaggttgcagtgagctgagatcacgccactgcactccagcctagcgacagagcaagactccatttaaaaaa

SEQ ID NO: 166769 - DNA, 393 bp, Homo sapiens
tggaatactatttagcaatgaaaatgaacgaacagctacatacaaatctaaatcttacaaacaaaatgttgagtcaaagccagacatgaatacatacaatatgattccatgcatataaagatgcaaaacaatcaaaactaagccaaaactaaaaaggtctacacacacaaaaaaagaaggtgattctcctacaatcaggacagagattacctttatgagagaaggactgggttgtgattgggaagcttcaaggaaagcttgtggaatgtcagtaaggtcctagtgcttgacctacatcatggttatacaagtgtctgattcataaattgtaaagctttacttttgttttacatacttttctacatatgtgttacattgcaacacggtctctca

SEQ ID NO: 166770 - DNA, 531 bp, Homo sapiens
tgaaattgtctgagttttgacaattataatattttatttctgattaatcagaaaatagtttgccataaaaatttatcacttctgatattagcacataaatttgtttttattgtaatttcaaaactaatgtcaagactgagcaaatcataagatggaagcacctgtgagtgcctgggaccctcaagatcatcaaatccagctttccctgcagagatggtctttcaacttttgcctgaacatcatccttgtgagggaaatcgtttcatcacaaagcaatccagtttactactggaacactgcaattatttgaagatttttggcatcacatgtcacaacattgcttcatatgaattggtacttaaaagaaaactcgacgccatagaactacaaaattaaatccaggaagaacctcagagacgatcttcttccaacatcctctttctcagataaggaaattaaggttttaaaagatcttgtgccaaaagtcacacagttgacttgtggcagttaagattaaattttaaaattcct

SEQ ID NO: 166771 - DNA, 401 bp, Homo sapiens
cttgagaggagaatttattacttcatcacctaagagaagggggcacacccctccatgcagggcacaggggaaccaccagtgtgggtcaggaggcagaaaggagccagagaaaagtgtgggtgggaaccttagtggggcttcctcgggaaaggcagtgcgtggctggtttgaataatgatggtgggctttggggtggtctctatttgcctggtatctggccctgggatgttttaaggcagggaaaatactggcttggtgtgtgttagagaaaatgggcagctggcttacttccaagttctttactaaattgaggaattagctggtcttgggagaggcagtgtctttctgggtctgtaagtccctggaaaatgttaaagtatcataagataaaaaaaaaaaaa

SEQ ID NO: 166772 - DNA, 393 bp, Homo sapiens
gacattgtttaagaactgatcacattcctttcatttgacaaatatccatgaagcacttcctaagccaaggccctcttctaggaactggagtcacaagacctgagaaggtccgccttacagagatcttatatcctactcgggagataaacaataaacaaattcggctgggcatggggactcaacgcctgtaatcctagcactttgggaggccgaggagggtggatcacctgaggtcaggagttgaaaccagcctggtcaacttggtgaaaccccgtctttactaaaaatacaaatatattagctgggtgtggtggcaggcacctttaatctcagctaacatgggaggctgaggcggaggttgtaatgaggtgaaatcgcaccactgccctccag

SEQ ID NO: 166773 - DNA, 372 bp, Homo sapiens
gacattgtttaagaactgatcacattcctttcatttgacaaatatccatgaagcacttcctaagccaaggccctcttctaggaactggagtcacaagacctgagaaggtccgccttacagagatcttatatcctactcgggagataaacaataaacaaattcggctgggcatggggactcaacgcctgtaatcctagcactttgggaggccgaggagggtggatcacctgaggtcaggagttgaaaccagcctggtcaacttggtgaaaccccgtctttactaaaaatacaaatatattagctgggtgcagaagtgcgcctgggtgcagaagtgcgcctgggtgcagaagtgcgcctgggtgcagaagtgcg

SEQ ID NO: 166774 - DNA, 373 bp, Homo sapiens
agcatctttcttctaacttaagaagttttatcttgttaacacaaccttctaaggctacacttttgctatatattatgttgtttttgaaatatctttcgtaaatctgctttattgcagtataatttacatacaataaaatttaccatttttaagtgtttggtgagtttttaaaatatatgtgcagttgagctgggcatagttagggatgcatgcctgtaatcccagctggttgggaggctgatgtaggatcacttgagcctgggagtttgaggctgcagtaagctttgatcttgtcactgggttccagcctaagtaacagaacaagaccccatctcaaataaaataaaataaaatataaaataaaataaaataa

SEQ ID NO: 166775 - DNA, 128 bp, Homo sapiens
aaattccaacccgagaactaccacaaatataagacaaactggctgctacatggaagaggggaggtaacactgacaaagccacatctatgaggccagatacaccaggtccgcataaggctgagatgagg

SEQ ID NO: 166776 - DNA, 531 bp, Homo sapiens
ccactgcgctatggaaatcgtggggttgcggggaggctgcagcttgtcatccagcccccaggcactgactgcagagatcccacccctgacccccccagactgggatgccaggaggggcagaggatctgcacttctgagctgtgtgccttgagccaagcacttgaccgcctgtgctccaggtcccctagctttgagcaggggctaacggaagaacctgccttgccaggttgttgtagtaaatgagtcaacacacgtttcacacttagcacagtgcccagctcccagtaaatgctcaatagatggaagctatgattagtcatggaacacggcctttctgctgtcctccctgccatggaaaatgggtaactcagctggagggcagttcctctgtgtagactggccaaggccccggggatgaggcagggtacctgggtgccaaaccagccccctctgctaccaatgctcggcaacacaccgacagtcaagacacacaggaggacgtcccatctcccttgtatccaattcggcacc

SEQ ID NO: 166777 - DNA, 529 bp, Homo sapiens
ttagcccttttataaatttacagccaaaattacagccaaaattacagccaaaattgataaagaaatatcaataatataaccttcaactggctgaaaaaaagaggtcaggttgccaattttaccaaaaactatatggatgaatggtcaataaagtcaccaagtacaaatgacaaggtggagaaaaacaccaataatctacagtcgcaaactgtagcaatgacatggcttgagctacagaatatttcctgtgagtgattttaaatggcaatattccttataggagtattataacttacacagatgatatgggatctggaagcatactacatcaaaagaggctgaaagataacctttataataaggcagactctacttgtcctactcagaatgtaatatgtagtttaaatataaaataaatatcatttccttgtttcattacttcgtggagatggacaaataaaattattttttgaaacttatttttaaactcacatcttgaaaaacatcttcctcagtctcagctattcac

SEQ ID NO: 166778 - DNA, 205 bp, Homo sapiens
aacgcgctgatagcctctaacgcgctgatagcctccaacgcgctgatagcctccaacgcgctgatagcctcccaaagtgctgggattacaggcatgagccactgcgcccagccttcagtcagttttaatacaactgtaatttcaacttgtactgaataaaaagataaatttaatttcaatttcctggagaagtgttgtaagggat

SEQ ID NO: 166779 - DNA, 123 bp, Homo sapiens
taccaaaacacgtgtgttgatactacttgccacctaattttaacatctatccattcataaagctgtgaaattcaatgactctactccaatcagcaaactaccagctccccagtgtggagagag

SEQ ID NO: 166780 - DNA, 444 bp, Homo sapiens
ggagattagatagatgccaattttaccagctccggcaagagaggttgaggcttatgcttggttagcactggaagtgaagaagtaggagcagactggattcttttctatcagatttggagtaccattagccgtataaatcattgtggggcggggaatgcctggtgccgtggctcgtgcctgtaatcccagcactttgggaggccaaggttgggagcattgcatgaggccaggagttccaaactagtctgggcaacacagcaagaccctgtttctacaaaaaaataaaattaaaaattaggtagacgtggtcacatgcaccagtagtcccagctactgggaaggctaaggctggaggatcttttgagcccaggattttgaagctgcactgagccgtgatctcaccacggcactccagcctgtgcaacacagtgagaccctgtctca

SEQ ID NO: 166781 - DNA, 323 bp, Homo sapiens
gaagggatgagggaaaagacggagcctggggaggaggcagcaaagtggtgagaagtataaagactaaggagggaaccagtccgtgagaaatacttggaaattatttactgccctgtgctataattatcagcaaggatcaatccattttgtctggtcatatctgaaatactggtacttgaaatgacaatctctacacatgtgcatacacacatgggggtatttttaggtttctactttcttccactgacttgcctattcttgcatcaagttaccatttaaaatactgtagggccggacacagtggctcacacctgtaatctcag

SEQ ID NO: 166782 - DNA, 251 bp, Homo sapiens
ccaggccccagctggatcccagtgcccagtccagctgtacccacgtaaagggatctgccaagaggtggcttttcgctgttgcagaaggcatctcttggggctgatgacggtgagtctctcattcttaacagcaagagtcaccctgctccatgaatcttcaaatttggggtcatttcccacctaaaggcagagatttggcctatgttcccaaccacagctgagagtccaacctgcccctcgggtgacacaca

SEQ ID NO: 166783 - DNA, 386 bp, Homo sapiens
tgaggccacccacatttgtttataatagattgacacaggcagtctcctaaggacagtttttcccatggctctcatcaaactattattagcaaggaaattcttattatcatttgacctgtgatatgaccctgatcctaacactgtttttagtttatggtgctattaaccaagtctgtttgtccacaataaaaacaaattgaactaaatgatggctaggacctcttgtagttccaaattattcctaattatgatgttgattataaaaacaacagtatttttgtttccatggtgcctttaagttaacctttttcataactgttttttttctttggcttattactagtcttaagggagttggttattatttattttcattatgtataaac

SEQ ID NO: 166784 - DNA, 287 bp, Homo sapiens
gaaaaaaatggcacatttaaaagctgcaccgtctgacagctaaggttaaaaaaaaaaaaaaagctacagaagcaaaaagccaaagtattgagtaagttattaccaaacatctacagtgtaggaataagttaaattcatgagaaagcatgtaaaagagaaagaggtgtaagaaacaaaattaatgctacaatagaacactcttaaaatcgtcactttgttaacccactgatccaagtcagactcctaaaatggtctcttatgccatttgtagacttcactggaaacac

SEQ ID NO: 166785 - DNA, 321 bp, Homo sapiens
aacccacagatgaccccaaatcttgaagcattccttctgtaaccatttcacaagtgcttattacatgctgggcactctctccaggacctaggatatagcaccgaagagacggctgtctcatgaagctcatattccaggtgggtgagacagacaagaaatgagcaaagaaggaagtttcaggtaataatcagtttacctagaaaataaaacagcatgacgggagaagtttttttgccgcctatcctggcttcagactctaaccggtaagatgagtctcagcaacgtgcaggttaaaacctaatgacctgacgtgtaattaat

SEQ ID NO: 166786 - DNA, 283 bp, Homo sapiens
agagatgtagcctttttgggtaaaatgaggatttcagatatcttttctgctcttgtgaggctgtgctcattagagcctacactggagctctagagaacaccagaatggatgacttgaaactctgaccccactagttgattgcttgccttattattgattttcaaaaggattcaggccaagaggctgtacctctgttatatttcattatttcttcatctgtaaaaatgaagcattgtttatagcactcccctacctcctgggaatacagcagggtaacacaaga

SEQ ID NO: 166787 - DNA, 267 bp, Homo sapiens
tatcacagggcatcacaatttgggacattttcatagctgtacaaagcataaatcttaccacttaagatgatttcagtcctgccatcaagtcatggctatgacatctgcagaatttgggtttaggtcaggaaaactcttctgactaggctttcattttctaccaagcaactgatgagatgaaagcagagtttttacagtgtttcagtgcctcccaacagctgagctcgcaagcggatagaagtcctccatcttcccgtggcctattac

SEQ ID NO: 166788 - DNA, 396 bp, Homo sapiens
tttaaagtctactgaaatctcaccctttctttggaagttttccttgtgctatagcatccacttcgctttctctcttttctttaatttctttggggctaagtgctagatgctggtactagttgataaatgtttcacatgggtagatcttttcaacaagattatgatggccaagtgggcaaggactgcattctcttgatgtatatcctccatagtgtctgacacagtgctaagcttataaaaaacacttactgatctatgctcaagaggttgattagcctgctgtaccttcgaaattgcttatttgatgagtatatattgcctaccatgagggagattctgaggatgtggaaattttatgatgaataaaatatagggttgaatttcatttgaagctgc

SEQ ID NO: 166789 - DNA, 439 bp, Homo sapiens
ataactgttaggaaaagagaaaacctagatccctacctcatttttattaaactaagtaccttatattaggctaaagtaaagataggtgaaagactaaaatatacaaattaaatataatcacaataaaattgagaagaaagcataagtaaatatttaaaaaacttgagtaacaaagctcatttcaataacgccataaaattggaaacagctcaggaaaagatttatcaatataattacataaactcatagaactttttaaagacaaaaagcagcctatggtaaatttgaaagaaaatgaaaattaatagaattacttttaatagtgtcattgttaaagcattcatattttaatatataaaagctcttcaaaatcagtaaggattaaaaaattggtgatcataataaaaaaaggcaagggatttgaaataggcaatagaca

SEQ ID NO: 166790 - DNA, 336 bp, Homo sapiens
ccattgaataaatgagtgcaaaatttaaataaccttctatatactagcaatgaacaatcccaaaatgaaatgaaggtaacaattccatttataataccatcactaagaagtagcttagaaaaaaatttatggcacgtacagtggcataaataacttcgggagtccaaggcaggaggattacttggagttcaagaccagcctggccaacacagtaagatcctgcctccacaaaaaaatttttaaaaattagctgagtgtggtggcacatgcctgtagtcccagctacttaggaggctgaggtggcaggatcacttgagtgcaggaggtcatggctac

SEQ ID NO: 166791 - DNA, 208 bp, Homo sapiens
gacgtgaggatccgggcggccctccagcttatcttgaaattccccctttcatcttggcctcccactaacttaaaacaatgcaataagaacacattcaagacacctccagtaaatccatatccgtattattcacgaggcactaactagaaagctgtttatcctgaagcctacgtggtcaactttagaaatgtgccttcgtgtaagctgg

SEQ ID NO: 166792 - DNA, 216 bp, Homo sapiens
ttcaggcacatcttcatccttcctggaatatcaatattgccaagggtacacagcaccttcaatggagagtgtatttttttcttacctgttgaaattcctaagcatttctcgacaggtggtgttttcagctagaaagtcgcacattttattttgaagcatatctttctcaccatgaatatattaagtacgaggaaggcatttggagggattactgga

SEQ ID NO: 166793 - DNA, 189 bp, Homo sapiens
tcgacgatcacgccattatagcagcctccgtggtctcctgcacttgtcttttaacatattttagtttacttatgtctttttaaaatttaaaaaaattttttcagtggttccctggttggttagtgtcttttgtttattaactctttccccacataagaatgtaaagctttgtgatatttggtagtcttg

SEQ ID NO: 166794 - DNA, 180 bp, Homo sapiens
ttttttcttgctgatatgagttagttgtagattttggatattagtcctttgtcagatgtatgattgtgaagattttctcccactctgtggcttgtctgtttactctactgactgttccttttgccgtgcaaaagctcttttgtttaattaagtcccaactatttatccttgtttttattg

SEQ ID NO: 166795 - DNA, 359 bp, Homo sapiens
atttcagaagtgattctttctctctatttcttcctactaagagaagttccttccttcctttgaagcaggctgactcaaaatttgctttcaggagtaacaagagaaaacctccctcataataaactgtggaaacctgattttaaaaatctacccaattcaacgtgcctcctccttcttcatcgatgctttatttaccattccttggtatatttaataacactttacaatccaatgccttgagaggacaaaacgtttcttctcttggagaacatagctgagagagcggggaaaacaatccctggattgatgagtccaaacagaataagtcttcagcgtccacaggggtggggaaaggtctg

SEQ ID NO: 166796 - DNA, 199 bp, Homo sapiens
ggagctccctgcgggcttcctccatgtgccgccgcagcctccggtcccagggcctggaggccggcctcagctgcggtaaggctggtgtcagggggagggtatgaatggagctcagttttcccacctgcaaaatgggcttggtgaggtggggaatcccagggaatggggctaagcagggctcaggattggccctcctggg

SEQ ID NO: 166797 - DNA, 411 bp, Homo sapiens
tggctagtgatttataatgtgctatttaaagttcaaaactcccctagaaacaccctccatcggcttgtctgcatttttattgaaaatgtatagcctgatggctggaacctagtgtactgagtacacaatctggtttggctatatgaccgtagaaaaatgagactggcttcggatttttatggtagtgatggggttggtcagggtgagggttcctgtgcaaggtgaggaaagggtcttacacggtttgaactttccgccaatgacaaaggagacagcacttgggctaccaacttgtccagatgtggggcacaaagggaagagcaaggggtgaggcctaaaagctttcagcagcagcacacgcaattgagcaaccacatccgaggaaggcagcacacggggtaccgagccccg

SEQ ID NO: 166798 - DNA, 1050 bp, Homo sapiens
gctagtgttccttgggcgtgagctgttgcccctgggacaaggttagccacttcctgtgtgtgacccccagtcaagcccccttcccagagggcactgggcagaacatcagatcctcatcttggcttcagggatggagccccaggctgtgagcgtgggggctgtgtgaggacatgttggtgccagtagggtcggcattaccacacctcaccccacatcagctgccacacttgtgccatggcgtggattttggtggctctgtgactgtcactgcccagccctgtgtttctccaggggcccagggctaaggtctgttctgacctctgatgcctgcatgggctggtggggcaggaggggagcttgctgtggattgcagacacgaagtacagagctacatggccaggggaggggacccagaggtagacctatttgaggacagggagcagagaacaccatgtgaccaagttgtctagctgcacacgctggaagggctgacctgttcctctggccccttcgtgggctccctgaattctgctgtcccgtctccagccctgccagaccccacctcaccccgactccaggtttcccactgagaactgccactccttagtgagacctggaactgtggtgggcttgttgtgcgtggggagggaagacagtaaggcaggtcctgtcccagactggtggagttcaccaccttgtggaaggccaagcagtggacgagttacgcaggtgacacattcctctcagtgcacggaggccacataacccagctgcaggtgagatggggaaggggaaggcttccccaaggaggacagggcaggctgtggcaggggtgtggagtgtggagccaggcccctagttatgtcccttacaaggtgtgtagcctggagcaagtgactgtcggttctgtgaggctgaggttgttcacctcatgcagtcgctgtgaggataatctgggagaatacattttgaggggatcacgtgctctgtgcactggaactgctcattcaaaaagcaaccatgggccaggcgcggtggctcacaccagta

SEQ ID NO: 166799 - DNA, 278 bp, Homo sapiens
tccattacctacctgcacaacccctgtgggagaaagtgtggcaatagggtcaccatactgggttggagagttccttggccgtcccctaggtggtgctggtgacccagggtagctgaagcaggtgactacaagggttgtctttgggaaaggtggaggcgggttataagtgactagttaatgttcccattcagagagcttatacattggtttgtgggccagaaaccaggctgagagttgagaatgagcagtgatgctgcaggtggacctgatgtgagaat

SEQ ID NO: 166800 - DNA, 456 bp, Homo sapiens
taatgcattataattagcgtataatgagcagtgaggacgatcagaggtcaccttcctgtcttggttttggcaggttttgaccagtttctttgctgcattctgttttatcagcggggtcttgtgaccttttatcttgtgctgacctcctgtctcatcctgtgacgaaggcctaacctcctgggaattcagcccagcaggtctctgcctcattttacccagcccctgttcaagatggagtcgctctggttggaaacttctgacaaaatgacagctcctgttatgttgctgctgctgccgccaatggacagcctttaacgtgcccgccagccctgctccaccgccggcctgggctcacatggccccatccctcctcgaacctcctagcctgttagttactcaaatctgcaagctctctgccttctcagggccttcaataaatgcatttcttctgtctgg

SEQ ID NO: 166801 - DNA, 409 bp, Homo sapiens
agctgggattacaggcgcccgccaccatgcccagctaatttttgtatttttagtagagacggggtttcaccatgttatccaggctggactcgaactcctgacctcgctaacaccaaatcttatagattctaccttcttagtgtttcttcagtttctcctctcatttcaatacttactacctcaaaggccaccaccaacccagtttagtttaacttctactttttttttcaacttgagtgtcacctactccaaaaaactttccttaactattctttgccaggtctgaaatatatgctctttggtgttcctataaaattctatgcttactcctgtcactgcacttaactataacacactgtactctactgatatagttctgatgtttgtcccctccaaatctcatgttaaa

SEQ ID NO: 166802 - DNA, 436 bp, Homo sapiens
gtagggagtcgtttgaagcgcaatgcatttatctgcattgttttctgtagatatccaggcaaagcagaagctctccagctaggctggggagcagtcttggtaatgggatggggccagtatcccagctcctcccaaattgatagattccttgccttccctctcctccttccctcatgagcaagagaccaaggctgaactttagcatctactgtggtaccgtaggggccatgtagagttgggctggaaaggctccagcctgggtgacagagtgagactctgtctcacaaaaaaaaagaaaaaaaaagtcaaaaaaattagcttggcatggtggtacacactcatggtcccagctacttggaaggccgaggtaggaggatcacttaagcccaagagtttgaaccagcctaagcatcaaagcaacgccctgaataaacca

SEQ ID NO: 166803 - DNA, 435 bp, Homo sapiens
gagagccggacacactccattttagtttcttcacctgcggccccctttcaccttcctccctgaaggcatagctagtgtaaactgactcaaagcacgtccaggaatgcacctactgataagacattgaggcaagctgcaccagcagctcctggggacacgcgtggtggatggcacccaaaacccctgcatttatctctttgtgatagtttaagcctctgcacctggaactgtttattttttgtaactgcatttgtaaccaattaatttttttaactttttgccagttctgcttccgtaaaaattgcttcagctaaaatcccccctcccctatttagaccacggtataaaaacaaaactagccccttcctcggggccgagagaattttgagcgttagctgcctctcagtcgcggctaataacggactctttaatttg

SEQ ID NO: 166804 - DNA, 366 bp, Homo sapiens
gcttcaaaagggatatattatactctctctagtaatccaaaggtattcctaattttgccactcctcattttcgcttctctttaagggccttatagtatgttctaatttctcatttggtagtatgcaacattcaatatttctagctctaaagttccatcattaattatttctttttttctttttttttttctttttttgagactccatctcaaaaaaaaaaaaaaagcaaaattgttggcatctctaagacagagcaagactccctctctaagagatagtagtgtctcccacttaattgaattcgttttgttttgtttgctttgctttgattcttgccacgtaaaatctgtgggtcttgacccagag

SEQ ID NO: 166805 - DNA, 419 bp, Homo sapiens
actacatacttccggactacataccccgccccacacagagattacgtgctaatcagaaaacagcatcagaaagtgattaaatccacctttttatttattttttctcatttccccctgtgtctgtcttgtattcagaaaactcagaacttaaagaaagcccaatgtataaaacattttttaactcccaattcatagacaagttaacttaacccataaggagggtgaccaacgctgccagttctctgaggactgtcttggtgctgacactgaaaatgcctcatctcagaaacccttcagtcttgggcaaaagggacagttggtcactttgactttagggtctgtggttgagtcaaaagagcttctttctctcagtttaatagccacagagtacgtatgaaatcttggacaactctttaagc

SEQ ID NO: 166806 - DNA, 750 bp, Homo sapiens
aaccccgtccctactaaaaatacaaaattggccggagtggtggcacatgcctgtagtctcagcctcccaagtagctgggactacaggcacgtgccaccacgcccagctaattttttatatttttattagagatggggtttcaccatgatgttagccaggatggtcttgatctcctgacctcgtgatccgcctgccttggcctcccaaagtgctgggatttcaggcctgagccaccgcgtccggcccactgctgactacttagtacagaatcacccaggagctttaaattagaatgcgcatcctaggccccctgccagaaattcagattcagctgatttgggatgagcctggccttgctcccgcatttttgtcctttgtgttgttttaaatgctccccaaccagggtgactttaattttcagctactattttttaaaataactgaagtataagtaaaagatcataatttattttacccaaagtgaaagacctccaattaaagccaaccaactatagcgtgtaaaacagaagattgtttacatgatatcaaatgtcaattgatataaagtttgaaaaattgcaagtactcttctttagctttagattagttgtgcaatacaagaacactaaccaaattaatggctttcttctcaaaggactacctaatttatggagaaatgtcattcatgaccccgaaaatcaaactcatggcataaatacattttaatcctttatgtctctcaaagaaaaa

SEQ ID NO: 166807 - DNA, 448 bp, Homo sapiens
ctgcctgcactacccccaccttcctttttcccatttgtttcaccaagattttccttcctgacttgtttttggacactttctgcacccctcttgttctgttcctaaactgtcccatgcacctttccactaccttctccctgaatattttttgctgtgtcctgttccttgtcctggtcccaaatcacttggcctgcccttcccttgtccctggatctttttgctgagtggcactatttttggacaaagagccttttccagtcctgccttgaaccacactacatagaagcctccgtgtagatgatgtgagagtcaaagctctaggaattagctaactcttacctggggctgggggccaggctgtggaaggacagagactggaaagagagcaggaccccttcagcagccctgcttaccttctgcagagcacaacagcctggcctaaacaaaa

SEQ ID NO: 166808 - DNA, 150 bp, Homo sapiens
actgtaggcatgcatgactggtttggtaaaagcatgtgattacttcaaccggttagaagttaggagtaatgtagaactgctgagatacctaagtggaatcatgtgagatttcagcaactatataaatcacatgaggaatgtgaggcaggg

SEQ ID NO: 166809 - DNA, 583 bp, Homo sapiens
ttgttataaccaattaatttgaaaagggacattataaacgagtaaacttacattcacaatttcaaatgtattccaatattaaaatataaatgctttacattagttattttcattgaccaactaaaataagagaattttagaatcacgagattagaagtgatctgaggttcaatgaacatttacggtgtccctatcacatgtcagaaacagagcaaggtgctttcaagtaactcaagtgattcaacccactcccttgtgtagatgtcaaagctccccacctatgccaaatcaagccatctaggttccagaaccagaaattctgggcaaagccctcacagtggtatagttttctatcaaaactggctggtgtcgtcatcccctataaaccaaataaaatttcaatgttgacctatttaacaaaaacaatagtctcagccgcaggagtccagcattctgggaggctgaggcgggcggatcatgaggtcaggagttcaagaccagcctgaccaacatggtgaaactctctctctactaaaaaaaaatacaaaaattagccgggtgtggtggcacgtgcctgtaatcc

SEQ ID NO: 166810 - DNA, 987 bp, Homo sapiens
tgcttgttgaatcttagcctttatttactggttttcagaataatgaaaaattaagtatcattgtgacctcatggatttaaaccatagtggatgtcagtctcttgcagttattacccttattgatgcttaaatttcattccatttctggtcagtaggaacctcttcaagctggttatcaagtcctttaaacaacaccctagtggtacttcatggcaaagaagatatctggtgtgacaagatgtctcaggcttatcctgcacttctgtgccccaaattcagagttggctttcaagaccagaattggagagctagtcatgccctttcctactagattggtcactgttcctagtctttttagtagacaaagctaggaagtatgtttcatctgtttctttaagataaaatacatgagtttataccgataattgcaattgaaatttaggaatacaagtttttatgtagctgtttcatgtttatctccttttattctagttgtcaacaatacagagaataatgtaattagaatatctcacaattggttaactgtttaatcctacacaagaatataatagtcttggagtaacaacaccagcaacactagcaccaacaatatgattgtgtaaaacagtttagaactttccccccatagggcatagtgtacaagggttttatggtcaatattgtgttttaagtctcttgaaataattgtgtgtttataacaccaactggatacacacttatgttgtttaggtcattaattttattgatttttaaaaaattaaatgttctgagttgtagattcacatgcagttgtgaaataatgtagagtgagcctagatatcttttacctattttgccccagtgttaacatcttgcataactattaatacaatatcacaactaggatattggcattaacacagtcactctatagaacattcctgtcactgccaggagtcatgctaccctttatagtcatacccacct

SEQ ID NO: 166811 - DNA, 361 bp, Homo sapiens
ccctccccgggtatcagaaaacaacaaagttcagaatattgattactctgaatcaataccgttcagaatattatttggccatgccaaagttgaccctgattacccagtaactattgtcacctcaagtctttcttcagcgttaacagttaatattaaaacaatccatggccgggtgcggtggctcacgcctgtaatcccagcactttgggaggccaaggcaggtggactgcctgagctcaggagttcgggaccagcctgggcaacatgggaaaccctgtctctactaaaatacaaaaaattagccaggcatggtggcgtgcgcctgtagtcccagctacctcgggaggggggggtaccgaga

SEQ ID NO: 166812 - DNA, 335 bp, Homo sapiens
ctgagtccctctcttcaggtcaaaccccttgcctgggggcagcaagctcccgaggggatttgtcagtgtgggagttcaaaggcctaaccccgtttgcttctagtaggacactcagccaggctccagggtccctgagggatcgcctaaggcctctgttaccactgcatccgggaacttcctctataccccagaggtattgatcctgagagcagccccagtaaaactcccacccccaaatctcagcatctcacagactgtttcccaggaatctgccccgttaatatattgtttcctaaacaggcaaagcacttctcttaccaagactaagcactatt

SEQ ID NO: 166813 - DNA, 714 bp, Homo sapiens
gtaagcccaagagatgaataaagataaatttctaaaagctgggtgcagtggctcatgcctgtaatcccagcattttgggaggccgaggtgggagaatcacttgaggccaggagttcgacaccagcctggtcaacatagaaagaccacactccacaaaaaaaagtttaaaaattagcaggtgtagtagtgtgcacctgtagtcccagctacttgagaagctgatgcaggagcactgcagcctgagcaataaagcaagaccctctctctgtgggaaaaaaagtcccaaataaatttcagtgggctaaagccagggtgttggcagggtgcgttccttctggaggttcagtgggaagactctactcctttgccttttctagctccagaggctactgcattccttggctcatggccccctccccatcttcaaagccaacgatggctgagtctttctcacatcatatcactctaacatttaccttctcgtctccctctttcatgtataaggactcttatgagtacactggactcacttggataatccagagtactctcccgtctcaaaatccttaatctcatcacatctgcaaagttccttttgccatgtgttcacagcttctgggaattggcatgtggacatcatattctgcctaccacaagtattaatagaacagaacttgtcactgccaacccagagtcactctgccctccttgtaa

SEQ ID NO: 166814 - DNA, 529 bp, Homo sapiens
gcgaattcactatgtgattgagctgaggaggagctgatgcaggagcactgcagcctgagcaataaagcaagaccctctctctgtgggaaaaaaagtcccaaataaatttcagtgggctaaagccagggtgttggcagggtgcgttccttctggaggttcagtgggaagactctactcctttgccttttctagctccagaggctactgcattccttggctcatggccccctccccatcttcaaagccaacgatggctgagtctttctcacatcatatcactctaacatttaccttctcgtctccctctttcatgtataaggactcttatgagtacactggactcacttggataatccagagtactctcccgtctcaaaatccttaatctcatcacatctgcaaagttccttttgccatgtgttcacagcttctgggaattggcatgtggacatcatattctgcctaccacaagtattaatagaacagaacttgtcactgccaacccagagtcactctgccctccttgtaa

SEQ ID NO: 166815 - DNA, 771 bp, Homo sapiens
aaatgatattggtagctaagtgtgaatggaattatgtctcaatttctttttcagatagttcactgttggcatataaaaatactactgattttcagctgggcgcagtggctcatgcctgtaatcccagcattttgggaggccgaggtgggagaatcacttgaggccaggagttcgacaccagcctggtcaacatagaaagaccacactccacaaaaaaaagtttaaaaattagcaggtgtagtagtgtgcacctgtagtcccagctacttgagaagctgatgcaggagcactgcagcctgagcaataaagcaagaccctctctctgtgggaaaaaaagtcccaaataaatttcagtgggctaaagccagggtgttggcagggtgcgttccttctggaggttcagtgggaagactctactcctttgccttttctagctccagaggctactgcattccttggctcatggccccctccccatcttcaaagccaacgatggctgagtctttctcacatcatatcactctaacatttaccttctcgtctccctctttcatgtataaggactcttatgagtacactggactcacttggataatccagagtactctcccgtctcaaaatccttaatctcatcacatctgcaaagttccttttgccatgtgttcacagcttctgggaattggcatgtggacatcatattctgcctaccacaagtattaatagaacagaacttgtcactgccaacccagagtcactctgccctccttgtaa

SEQ ID NO: 166816 - DNA, 246 bp, Homo sapiens
cttgtgtgctaagtcaccaaaatctgacatgctgaactgtcaacttaatggtggagttcgggttgagagctgatttctaaaaccactgccacctctggacagcagccattcggatatcaggtcaaggtttgggagactattaagaagccagcaccaagacatgctggtggagaagtcggagttttatcacgtcctacctactttgcggtgaaatgaaggtcttcatagtgaggtggtgatgaacgt

SEQ ID NO: 166817 - DNA, 405 bp, Homo sapiens
ctctcctttacactgcccattgagtgtgcaggtgtcatctagccctcttaacattgctctataggaatagggctcagagaatccatgaagaaaagaaaaaaatgccgataccctggttactatcatttgtctctgactcaggagtctcatgtcttctaacagcatccatgaaactatagtgtggtaacttgttagctagtaagtagggtaaaatctcatacccttcacagttattgacacccattctttagcagataactgatatttcacaattatagacatctataggccaggcacggtggctcacgcctgtaatcccagcactttgggaggccaaggcgggcgaatcacgaggtcaggagatggagaccatcctagacaacatggtgaaaccccgtctctact

SEQ ID NO: 166818 - DNA, 263 bp, Homo sapiens
gcgtccatatttgatcaggagacacccatagtttttggaagtcatctcatgacagcaatatgctttatgtttctaaaaaggaattgttataaattaacaatgccctcttggtaacattaaaactgcactgaatttttggaaccttcttaacatttgtttctacatggaatttatataatttacaaatttacattattcaaagctgatggttgatggcacaatatataatcctgtgacaagattatgaaaaggaagttcccaga

SEQ ID NO: 166819 - DNA, 344 bp, Homo sapiens
cccccccacctcctttctcggttgtagctgcaagatcagtcctttcctgggatctttaggaattatgaaaaatgaatcatgagaaataaaaaaaaagccctacagagtaaaaaagaataaaattatctaacacctcagctgcacatcattatagaaaactgtgggcttttcatacacattacagtaaggcagacatcccctctaacagactcagtacgacggatcagtaattgttttcatacactttaattagaaaaactcagatggctatgaataataatggaaaagagagacttttgcacttgaaaggttgaagtcaatcaagtgtgaatgacggcaaaaaa

SEQ ID NO: 166820 - DNA, 532 bp, Homo sapiens
tgggtttctgtttcaggcgaaagtgtggcacctgctgaccaggatgcaaatgaggactagaacgacatgttctgactgtgacgtcaacccatccagccctgattctaactgatgcctggcctggctctagctgttagagccctctaacggaactcccaggcaacagtgccctactctggggtgggcttgggcaacatggccctgcggaggctccccagaagcctccagaaaggcaacttgtttgcctcacagcaggccagtcagttcctgttctgtactccattttgaggccctctgggacaaggccagaaagcatctcattccagaggcttcccacctccaacagaggaccccaaagagacacctgaagcaatgtggccttctactccacctttctctctcctctgcagccttttactagccaggcaaatttatccacattcctccggatgaaaacctaaccatgactccccactctcctcaggacaaagccccaactcttttaatcatcctctgtgccccgactcagaca

SEQ ID NO: 166821 - DNA, 530 bp, Homo sapiens
gttggatcaatgtgagaaagactaagataaagcatatataagcgtgttttataaatggctaagtactatataagtgctattattaataatcatataattctattacattattagtgaagtagacttttggggccagttcatcctgtcactcgacaaatatgtgggtgcctctatatgtctagcaccttccgaggctccaaggatatggtggtaaacaaaatggacacaaaatgccttctaaagcccagacaactaacgtacaaatacatctttagagcacaacccagtcgtaagttagggacttccagtactaactttggtcaactgtcaatgtctccaagagcgttgagggtctacatttttgcttagtgcttttggacagacattgagttagaggacaacatcagtcttggcatttaatagtagataacgtgaacacaagaattgtgtcttctcattaaagcagtagcccagtcatctacctagacaggcaataatagagtgggagttagatttagataaaagtgaac

SEQ ID NO: 166822 - DNA, 408 bp, Homo sapiens
tcaacatgggactaaatatgtcagaagttaattgggggaaatgcctctgaagaataaagggggaggaagcaggtggagtccaggagactgtacactactatgctgatctgacacctgtgaaagtggagcaggaaggcatgattgggcatgaagagcatcagatcacagcacagtcctgagaaagtctcagctaggccattggagagggacctagtccgagctgcccactgaatggacaagcactaacacacccactatgctcattcaccagttgagacaagactggtgaaagtgtgtcctcagcactcacagggcggcagctggaggctatcagccagccagactccctactgtgggctgtctttaagggtgatctgagtgggtcatctccatggctaacattttgct

SEQ ID NO: 166823 - DNA, 320 bp, Homo sapiens
atggcagagatagcatcaggtgcgtggcttcctggcttaccccgcacacagtgcatcctgatcaataaaaaggagggacctcctcccctcaccgtgcctgccagggtcgggaaggaatccacaaatctagccaatttcaacgatggtaaaagattcctttccaagtcctatctcaagacaactcccaagcctgaatttttacaactgctacccgggaacacagaaatcagagaaatgcgccaggccggcgtagaaggggcagaggaagatgttggcacccaggaaaggaaaagaaagtggatgggcagttctgtgagcag

SEQ ID NO: 166824 - DNA, 173 bp, Homo sapiens
agattgaagtgaatctcaggtctcctttgtgtgtttcccaggacaatcaataagggatgcttctgcatgataaaaatgtgatgatgaatgcatcagtaaaagtttaaatctgtgaaggtccctcaagctcgggccccctgcctatcttcctagtctttctctcaccttgtcat

SEQ ID NO: 166825 - DNA, 366 bp, Homo sapiens
ctattgatagacatttgaattgtttccagtttttgactactacaaatcaagctgttaggaacattttgtgtggaagtctttgtatggacagatgctttttcttttcttttgggtaaacacctaggtggaatggctgggtcagatgacaggttttccagagtagttgtattttacattcacatcagcgctgtatgagagttctagttttctatctcctcactaacacttggtgtggccagtgtttttcattttagccactctaaaattgctgttagttcattgtgattctaatttgcatttccctaatggctttttaaaattttgagatagggtcttactctgtcacccaggctgcagtggtgtgat

SEQ ID NO: 166826 - DNA, 351 bp, Homo sapiens
tacaggcatgagccactgcacctggcccatcctgtttatttttaaatccttagtcttcagtctccagctggatataaaacccatctttccccagctccagccacaactaactgtctacgattcaggggtcccggaacttggaaagggaaggaaattccctctttattttcactaatctctcacttaaatccagcgtctcctttaagtatgaatgtggacaacaaacctcagtagtttccatagtatctgtgagtttgtccctgacagcaatcacagatattctcctgtcacattacagttgttgcagagatcgagaaataccatttacacttgtcacacctttcaaattac

SEQ ID NO: 166827 - DNA, 227 bp, Homo sapiens
aggttacggacactatttacaaaaagatcttaatttgagaagtaaatatgtgtatgtgtgtctagaggaaatatactaaaacactggcagggatatcatctcttcaacgggtgttgccccggcccttcctccaaaccagttctaggcccagttttccatgctgaacatcagtcattctgtgtctggcccagcattcagtgccctttctgctgaaggcatcccattct

SEQ ID NO: 166828 - DNA, 487 bp, Homo sapiens
cgtacaaaagccatgattatttgaaaagaacttgttttctaaagatacaaggtaaattacaaatatatgttgatacttaatacttccaaatcaattaaacccttggaaagccatattgaagatataagcaaattccaaatagttgagttaaaatggggatacattttaggtgatcaagaatatgaatttttactactaattataaacatcggttaaatattactgtcttcaagttagttatactttaagtacatgtaaatttttaacatttcaatttatctagagaaaaatgaactatttgataggtatttctacacttagtggaaagtttgcttttcaaaaacccagtgatatttgatatcaatatcatatttttctagaaaacaatcgcaccataagatatctagtgaaatttagtggtactaagtcatctgatctagcctcctgagccttaatcaactgagatgaataattctaaaagaacaaa

SEQ ID NO: 166829 - DNA, 377 bp, Homo sapiens
caagctatccggttcaatcttattctacttttctacttaccattatatcacaagctttgcccccatgacttaaaggataaatggcattccataatatggacatgcaataatttacttagtcattacctgaatgggttttttgcaaattttgttatcataaataatattaccataagcatattataaatagatctttgaatgctttgaaaattatttccttcaaatcatttcctaaaagtagagttataggggataggtatagtagcattttaagtctcttgataagtatgaataaattgcttactaaaagactgtagcaattaatataacccccccacccccgagtagtatgttaaaccattgaaccggatagcttg

SEQ ID NO: 166830 - DNA, 467 bp, Homo sapiens
ccatgatattagtaaaatgacatcttttgatttgtttaaaagtttgaaaataagaacatactcaaagactatttttcttcacaaatccagtagtgttggcagattgaaaatgtgtaattataattattttccatttagacatgtattattttgatagcaatttctcagtaatatcaaatataattacccaactctagaaagtaatttcatttctccctacctagacatgtggctataatataaaaagaatgataaacattttgttttaatcaaaagtacaaattaggtattctagcttccaaaataattttcaagcatgtcaaaaaaattcatgtcaagtattagcttaattatttttaactttagtgtttagtgccttataggtaaagtggcttaattcacagaggctttgagatatttctgcataacttttactatttcaagatgtgaaaacaaagaatcccaag

SEQ ID NO: 166831 - DNA, 337 bp, Homo sapiens
ggcaggcttgtgtttgtgaaatatacgatctgatcatattctgaagcaccaggataagaggccatcccaggaacagctcagctatcacacagcccagtgaccacatatcaatagcttcacaaaatggtaacccaagaataatttcaggagctctgtagtaacgtgactgtaagtaggttgagcacacagctttggaaacgtgactagcagaaccaaagtcaatgaccttcactcggtagggctggcgaactggatcaaccagcatgatgttttcaggcttaaggtcagcgtggatcagaccaagactcttgagcttcatcaaggctgtggccacctg

SEQ ID NO: 166832 - DNA, 248 bp, Homo sapiens
caaatattgacaggggtgctgccatcctagctataggatgggggtctggcttccctttaataagagtagattcacctttatttcatttatatatcagcctgttgcaacattttggttggagaaaaggttctattttttaaaaaaggttaaaatcttttgattttaaatgtttaaaaatgttttattatggaaattataacaagtagagaaaacagtatagtgagatcataggtacctatcaacagctt

SEQ ID NO: 166833 - DNA, 217 bp, Homo sapiens
ggactttgatcttgccataatggtatgcctccatttaagaactaggtcagctgtctttcacaccagctgtgttcttcatgcttagggcaataacatgtataaagtaatgggtatttttctagtagggttaacacacttactcaggtttattcttttaacttgcctgcatccaaacatttttttttttttttcaagataaaaccagcctgtcaaactg

SEQ ID NO: 166834 - DNA, 354 bp, Homo sapiens
atcgtgatatatctgttcatacattaacagctttacttttcaggatctggattggaaggccccttatgggggcaaagccagacagatttgaatgtgtaaatctaggcatctttctgctgactgatggtccagtggagttgagactagagatagtgaaccatggtaaaaagcacatttggatgtccaggaggacagggaagctgttctgttttgttcattcctagttcctaaaaacaaggctgagtgtggtggcttgtgcctgtaatcccaagactttgggaggccaaggtggttggattacttaaggtcagcagtttgagaccaccctggccaacatagcgaaaccctatctct

SEQ ID NO: 166835 - DNA, 498 bp, Homo sapiens
aggtaagatttatgtataataaactgctctgtttcaaagtaaaaaatttgagggttttcagatatataaatctgtgaaactacttataaatctgtgaaactactataatgtcaagatacaaaacatttccaacacccccaaaagttgcctcatggcctcttataatcattttctgcttccagcctcagatagccattgaagtatcgtgttttcaatgttttttttatttttttaaaatcattttggagtagtttgcatttcgcggaatgttacaggaatggaatcatattgtgtgacttctttgggcataaggattttgagagccagttgtgtttcatgtatcgatagttcatcccctttttattgataagtattcccttgtatggatatgcatattcacaattttttcatattctttaaccttgttaaacaacattctggttgtttataagcttttggccattataaataaaagttttttcaacattgttgtatgag

SEQ ID NO: 166836 - DNA, 427 bp, Homo sapiens
tatttttgtatttttagtagagatggggtttcactatgttggccaggctggtcttgaactcctgacctcgtgatccccctgctgcagcctcccaaagtgctgggattacaggcgtgagccaccacacctggcccccttcaaatcttaacagagaagccaccaaagtctccttgggtccatcccatggatgggcctcctgggcccctcagaccctgggcttcccttgaggtcctggagctatgtgggctccagctctgggaaggtggacccccatgcatgtgtcctgccgtcactgtctctatgaagtctggctcacactaagtgagccataaggccttcttcaaggtcatctgtcccactgatttcagactcagggcggagtgtgaaatcatctgtcccccacagtgcactcagaaccctgtctgga

SEQ ID NO: 166837 - DNA, 271 bp, Homo sapiens
ggtagtagcagcaacagtaacagtattatataatgattggaaacccattttgatttcacaaaattatttttgaggacacaaggctttactagatactaaaaatctaacaggaattttggaacttctgactggaatgcctaatttaatctacctccatcttacaaaatgtaggaagagattttaagagaagagtgattttttaaaatgtggatctaacatattgagaaaattttaacctttttattaaaacaaaaaatacccaaatctattc

SEQ ID NO: 166838 - DNA, 256 bp, Homo sapiens
aaccaaaccagacccagaaaacctaaacctttgagaaacttaccagatactttctcacctaaagttacttttctgtgtaatttttcaggtacaacaatctgctgaaaattcatttcttaccccttgtacatttaactgataaacgtgatgaatttagaaagaaatgtgatgaatttagaaagaaagcatatcagttcttcattcagaaatgcagctatcttaggagaaaaatgtgtttcaaatgtccgcaagatat

SEQ ID NO: 166839 - DNA, 177 bp, Homo sapiens
aagcaggttaggggagagtaaagaggagcattgaccagagaaacaacatggaagatttgcctatagaatgggactcaccagcccattgtcgtgtgatttaacctgtacttattcaaggacagcttggacagttttgttttgtttgagacagggtctcctgtgttacccaggatggag

SEQ ID NO: 166840 - DNA, 499 bp, Homo sapiens
ggggtacatcactcccacctctgtgaaagcctctctcccagcgctcaaaagccacgaaacaggtccctcacataggctgatgagtggtgggcctgggacggtggtaggactccctccttgaccagacgttagaggtctggtcctctgagctctttctcactaggactcatccctgggcccttccttggcctgctgaagccagttgtagccaagagtcccgctacgttgattccccaccccttcacatctgattacccttgacagctgattaagttcctcacctgcacccctgatatctgatgaccttggcctgcctttagcaaggatcttcctgccttgatgtctcctcttagtaattttccatccactgaccccgcccctcccttggctcctcagctaaacatccccacttctgttgtatctggaactgaactcagttctatactgaagcctctccccttttgcaatagtattgaataaaatgtctttaccaccttta

SEQ ID NO: 166841 - DNA, 868 bp, Homo sapiens
tgtgccaccacgcctggctaatttctgtattcttagcagagacggggtttcaccatgctggtcaggctgttctcgaactcctgagctcaagcgatctgcctgcctcagcctcccaaagtgctgggattacatgcatgagctactgagcctggctgcttctatctcactttctctttgaaatgttctcagacaaccccctctcaccacaccctgtatgactagatgctcctttctctgtgttccttagccctgtgtaaattcctctatcttagcatgtgtccatcacatttgattgtgtcttagcctgtacatttctggacaataagggctttgcctcgttcattgctgtgtcctggcacttctcagtctctcacggaatgtgccttggataaatgagtgaagcaaagtcatcccttgatgattttatatccatgccatcatacactattctgaacatgcagttaaattaagaatggtttgaaattgagattagttccgtaagtcccatgattttatgtgcacacatttatacacacatatttaagattaaggcatgaaaataaattaccaaagggatttccccaggagtcagtgttttcagacctattgcctgaagccatctacagatcttacagctaagtttaactcctttacattatcactgttccacttcagcaaatccattttatataaacctttttctgataattatcaatgtagtacacatttatggtaaagatttagaagatgctaaaaagtatacataagaaggcaaaccccctccaaaatcccttgttccttagtcctttgtatttcttttagggaaatcactaagtttacatcctttgttagttttctgtttatagtg

SEQ ID NO: 166842 - DNA, 704 bp, Homo sapiens
tgggcccagcctccacagaccggggagaaggtatttcagggagatgggaacatcttataggggctggacaagagcactggggagttcataaggagagagctcccctggctggggaacaggggtcaaagattcactcactccacacagaggggcattccgcaaatattcctgagtgcctgggatgtgccaggccccatgccagctgtggcatggctcacgcctcccccggggctgcagcctcatgggaggggcccacagggacaagtaacaaagaaacaggtgacctggtcttgtgatccatgctctgaagaaaacactgggggaggtggaggggggtcctcaggtcaggcctgtgagaaggggggtgccccacagcgtcagtagagccaggaagctgtgacctggatctgaggttttctgaaagcataaaagtgccctagttttcccctctcctcaggctccgctgaagctatgccaagaattggcttttaaaggctgcctgaaatgtggtttggagccaaaaatctatagagccagcgcatttgtgaccttgttgaaaatgcttactgaggaaaaacaagggggtgggatttgggattttctttttcccttgtaaaatttaaaaatacatgtatctgtctggtctgtccccaccccttctctatcccgcctgcaggccctcaccttggcccgacagccccgac

SEQ ID NO: 166843 - DNA, 632 bp, Homo sapiens
gaggtgattagaggatcccccctcttcccagcccagctggggaacaggggtcaaagattcactcactccacacagaggggcattccgcaaatattcctgagtgcctgggatgtgccaggccccatgccagctgtggcatggctcacgcctcccccggggctgcagcctcatgggaggggcccacagggacaagtaacaaagaaacaggtgacctggtcttgtgatccatgctctgaagaaaacactgggggaggtggaggggggtcctcaggtcaggcctgtgagaaggggggtgccccacagcgtcagtagagccaggaagctgtgacctggatctgaggttttctgaaagcataaaagtgccctagttttcccctctcctcaggctccgctgaagctatgccaagaattggcttttaaaggctgcctgaaatgtggtttggagccaaaaatctatagagccagcgcatttgtgaccttgttgaaaatgcttactgaggaaaaacaagggggtgggatttgggattttctttttcccttgtaaaatttaaaaatacatgtatctgtctggtctgtccccaccccttctctatcccgcctgcaggccctcaccttggcccgacagccccgac

SEQ ID NO: 166844 - DNA, 599 bp, Homo sapiens
ggcaagcctgagaatatggcacctagacaccagttttccatttaggccaggcgcatggtggctcacacttgtaatcccatcactttggcaggtcgaagcgggaggattgcctgagctcaggagtttgagatcagcctggacagcatagtgagaccccatctctaccaaaaaataactggagataacactatcaacatcttgggtggttgtgagaattaaatggggaattttatgttagggacttagtgaggtgttgattacatagtgaacctattattcacagaaattcaatggatgttttgaggtgccctctacttgatgcaagcctcggcgaggtggcagtggtggcctctgtccccatggcacagatggtctgttctgctttggaagcactggaagagcacatctgacaattgaaccggatagcttgccgggcaagctatccggttcaatagtaaagaatagagagccccaaatagactcagtatatatagaaatctagtattgtgatgtctctcaaataaatggggacaagacagattattcatacatggtgctgtgaaagggaggggcacttgagaactactactggttcatgc

SEQ ID NO: 166845 - DNA, 447 bp, Homo sapiens
caacatcactaaaatgttgaaaacagagactagaagcccgaagtggtaagcttataacagaagtgacacctgtcctgctttttcattgacttgtttccgtgacctggagaactgagtttggaagatgcctccagtaacagaaaataagatatcagggcaacacaaaggttaggttggaacaggaagcaaaatcccaagccccctttgggcaagtaccctgctctagagaagcctcaggcacccaaatgttctgaatgttcccttccattaccattctcagaccctttggtctcaggaatcctcagcactcttaaagattactgaggaccagcagggcacagtggcttaggcctgtaatcccagcactttggaagaccaaggtggccagatcaccagaggtcgggagttcaagaccagcctgaccaacagggagaaaccttgtctcta

SEQ ID NO: 166846 - DNA, 247 bp, Homo sapiens
tcctgtgctccataagagataaggccttgcctccctggaaaaccaaagggcaggaaagacgcaaagcaccatacatttgggttcacctggcatatggtcaaatctttctttaaaccttaccatgtttttaatcactgcattttccccatcacactcactctttgcttcttcagacagcacaactcttctcaaaaaatatccctgatgactcagacttatttgagacttgagagactcctggagtcca

SEQ ID NO: 166847 - DNA, 376 bp, Homo sapiens
ggattcagagacaagaaatgctgttctagtttcagttctaccatcaagccatgtagccttgtgcaaatcacttcagcattttgattctctagtttgttatgctataaaatgtggacgatgacttgcccaatctgcctcagaggaatactttaattaaggtagggtccttaggccatcatcatcagcatcatctaggaacttgttagaaatgcaaattctccagccacatcctagacttacagaatcagaaactctggggactgtgggtagcaatttgtgttttaccaagccctccaggtgattctgatgcaagcttaagtttggagataagttcatgtgaaaccccttgtacaactacaaagtggaactgaaagag

SEQ ID NO: 166848 - DNA, 243 bp, Homo sapiens
ggattcagagacaagaaatgctgttctagtttcagttctaccatcaagccatgtagccttgtgcaaatcacttcagcattttgattctctagtttgttatgctataaaatgtggacgatgacttgcccaatctgcctcagaggaatactttaattaaggtagggtccttaggccatcatcatcagcatcatctaggaacttgttagaaatgctgtaagtgatttcgacaagctaatggcttga

SEQ ID NO: 166849 - DNA, 400 bp, Homo sapiens
  misc_feature (30)..(30): n is a, c, g, or t
agccgagatgatagccaatccaggacaganggattagaagtgtatctgatgacaaaaaatctgatggaagtgatatatttgacatgaaagtgaacattttcttagttgggtgtttataacttttttttggtaaattgtttttagtttttatccttattttacttgatgcttggcaatagatggtcttttttccccaaatcttcttctgaattccaaggaaacactgttttagcatttatttgattactttggttcattcttttctccactcccatttatttgttttccattttgtgacttctataaagcagataaaaatctggaacttctagatctgaccttcatgtcttgtcttttctatggtgcttattctttccatctcctgggattgggctatcaa

SEQ ID NO: 166850 - DNA, 409 bp, Homo sapiens
ctaatttcaaggttagagggcactttagagagttcatctgccaattaaagaactgaattccatctatataataaaagccaagtggtcttccagcttttgctggaacatctgcagggctgaggaacccacccattccattttcagaacgttctgaaattttattcttatattttacaaaaatctgcctccctaagacttctatccattggtcctaacccaatatcttgagttcccacataataagctagacaccctttacacatgacaattattcaaagagctgaagacagctatcatgtcccctgagtctttcatgtaccagaaatggtgaataataaacacactgcttttgacttaaagaaactgtagcacattctcagcaactgttagttaataaggagagtaaaaa

SEQ ID NO: 166851 - DNA, 321 bp, Homo sapiens
tacagcctgtgatcaactggtagtttctcccattagaatgccgggaatcactcatgtgtttttatcattagactacttggtgtcggctgggagtctttcccattggaatgccttgggtcgtccaggtgaatttattattagactgtctggtgtctgcgggagtctcttccattacaatgctttgagttgcactggtgtctcaatcgttagactgttgggttctgccaggagtgtctcccattacaatgccttgggtcaccctggtgtttttataattagatttcctggtgtcatctaggactctttcctattagaatgcct

SEQ ID NO: 166852 - DNA, 303 bp, Homo sapiens
agtctgcatcccacaattcagccataatgccatactctcatcccctgttcattgcccaggacctacagatggaagtatccaaaggcagatggacactccctaaacggatgaacttcccaacaactgcagttgccaatgttagaatgggtggcctcaggagagataaaattctccatcattaaagtgtccaagcagaaagcacctatctggacaggctgggaggatgttgtgggtctgaatgggagatggaatgaggtggtcaaaaagagtctgattttattaaatatgagaacaaagactgta

SEQ ID NO: 166853 - DNA, 340 bp, Homo sapiens
gctcaacagggttgtgaatgtcatgtaggatccataggattgtggctttgtggagtaggtaagatcacaggaaactgaatgtgtctgtgctaattgttatttatcatggttttgtgtgtacattccatgataactgaaaatggatcactatgtaagtgatgttaatgactgaagaactctgtgtgtctggtgtatttcattttgcttgcagaattatgacagtttctaataactaaaatatcacaagcattggaaactaggaggtaaaattataatttctagatgacagggttgcattacctggaaacatcatacaaactaaatccaatatgttgaaatg

SEQ ID NO: 166854 - DNA, 560 bp, Homo sapiens
tgcagtggcacgatctcggctcactgcatgctctgcctcccgggttcacaccattctcctgcctcagcctcccgagtagctgggactacaggtgcctgcccccacacctggctaattttttgtatttttagtagagatggggtttcaccatgttagccaggatggtctcgatctcctgacctcgtgatcccacccgcctcggccctccaaagtgctgggattacaggtgtgagcgaccacgcccggcctcataacctagtttttaagaataaacccattgcttgtctgggtcttaatgggcacccccagagtcctgtagtcagtgtctaagctgcacctatatgccctgaatttctcccatcctccccttcctgcctggactctcgtttcctccttcctcacccagtctgtggcgagccccttcccagtctcctgcctccatcatgtcctctctcaaacctttcttccacctgtctgcaagtggagcttctcttaggcccctccctgcctgaccgtctgtctcctcaccactggaacagtgagacaccagcacacacaca

SEQ ID NO: 166855 - DNA, 404 bp, Homo sapiens
gggaggctgaggcaggtcccttgaatcggggaggtggaggttgcagtgaacctagattgcgccactgcactccaccctgggtgacaagagtgaaactccgtctcaaaaataaaaaatacaaaaataaaaaataaataaaagcaaactgcctgtaaatatagggtcaggaggctcaaacacagtacatgaacttcaacgtaaagcccaaccccaacataaaattagggcatgttcatatgggactagcagcttccccaaggctgcagagacctaagaaagtcaggtccatctgctacagaagcccaggtaaaagaggcagaggagcaaaggctaacatggaggtggccagaccaaaatatgcaaagtcataagtagcatggagattggctctctaaacctcaatg

SEQ ID NO: 166856 - DNA, 492 bp, Homo sapiens
aggcaggagaattgcttgaacccaaaagatggaggctgcagtgagccgagattgcttcactgcactccagcctgggcaacagacacagactgtgtctcaaaaaaacaaaaaaagttccctttgtgcctcaccacaaaatgtagccacaatcctgactcctaacattgtacattaattctctctgtttggaactttttataaatagaattataccacatactcttttgtatgagagtcctgtcttgtgtgtagcagtattttattccttttcattgcttcattgctttagagtgtgaatataccacaaattatgtattcattctacagttgataaaattatgggttgtttccaatattttgaatattattactaatgctattgtgagcattgttaagtatgtcttttaatgtatgtgtacattcatttttcttatgcattcctttctaggagtgaaattgttgggtaatagggcatctctgtgttccaatttg

SEQ ID NO: 166857 - DNA, 423 bp, Homo sapiens
ctcaggaatgtacatctaattgacactacattgcattaatcaatagctgcactttttgcaaactgtggctatgacagtcctgaacaagaagggtttcctgtttaagctgcagtaacttttctgactatggatcatcgttccttctgtggcagatttttacagttcctctaatgcatttgggacgactgtctcaaagtaacctgcagctttcctgacaactcctcgctctctctcctgctaagaactgtagcccttttctgctgtttttagaaccttctgctaccatatccaccacttccccatccagatcgcatcccaggcgcgcgatgcccgggcccgcgagcgcgaggctggcaggccaggggtcctgcaggcgccccccggctccccgcggcctctggaccggcccgagggcctgcgcga

SEQ ID NO: 166858 - DNA, 376 bp, Homo sapiens
tgattcccattttataaatgagcaattggaagcttagaatcaccaaataattttcccaacatagcaaagaatccagctctggctgactccacactcacagcaactacaccacttcgcttctgccgaagcaatcctacttgcactcctccttttggattgctgagaagcatcactatctaattaccataaagccccctcctctccatgcctgctatctttgtcctggtttgagacctctttatccctcccatccctaccttcagtctatcctgcacaggactgacaaagtcatcttccagaatcacaagcatgactacatcagtattctacttaaaatccttcagtaagtattctctctaccagtcgagatgctcga

SEQ ID NO: 166859 - DNA, 387 bp, Homo sapiens
atgggtgatgcaaaggttcgaaattagattttggtgatgcttgcacaagtctataaatgaatgaataaaagtcattgaattatacacttacaacaggcgaatttaattgcatgtgaattatacctaaacaaagctgtttaaagaaatatttaagattggctggaagcaggaaaaggaagggacgtcttgacaaaatgatttaagttcattgatcagatggggccccactgattatttgctatgtcattattcttcaccttggaagcttataatcccaaagccttaccctgtgtcctaccccactacagagtataatagcaacttcttgtttgggaggtgactcaagtgtttggagttgctactgatggacctagagtgaatgatatt

SEQ ID NO: 166860 - DNA, 409 bp, Homo sapiens
atttattattcctataagaataataaaaactggcctgaattatactactctaggaccctaaaaccttaaacacaacttcccactgtttctgcaggctttgaagttacagattgaattttaatttttaaagtgagaattttgcaaaactgagaattctacatatggatttcagtaattcttttgccactgtctgatttattgatatttactgcatttaggtaagtgtaagatgaaataataggtaaattaagaaaaaaataaaataatttcagccaaataaaattcaaggttgtgaaaacattatttctttccattatcagttatttgaaaaaatattatttctggcactggttcatgaaatacttgatttcaactaccaactagaagtacactatatttaagtaaaaaa

SEQ ID NO: 166861 - DNA, 502 bp, Homo sapiens
tctctttatcagctaggggcgatggagattgggaaaatggagcccaaagtccaatgtgaccacagggttttgggggaatcataacctaaatattacagctaacaccgcctcagccatcttgatgatcaattctatttaggtaaggaggaaatcataaagtcttagtgcaggctctgtgttaaacgtgttatttaaatgaactacaattttggggtgggtgtttgctgtgtggtctccattttagagaaaactgaggcttagagagaaaggaaaacttgcccaagatcactgagggagaggatgatgcaaacccaagtctatctatcactgatatcagcgccttggacctgtggaattctgaatttccatctgcccctgtgtctggtttgccgctgttgttttgcattgctaattcaatcttattaaattattagatgctgcattctcatgtttttcccttacgtttgtctcccaattaagtaacctcctacagaaatttgga

SEQ ID NO: 166862 - DNA, 328 bp, Homo sapiens
attctctagcatctaaaacattgaaaggagcaggcttgatttatttcttttcaatagaatgtttaccaaatatatgttgtccaataacaattccatcaagaaaattctggcagcaagccaccagaaaacctaactacattggctgaagagattcatttcattaaaactattgattgcccatttctctgaagtacttacattgaatttgtcatatcagacaaatgtggtttaaaaatagtcactgacaaagacagtagagtttgtgtatataatatatatttgtagcagacgtgcagaactttaaaatataaattcttagaaattgagg

SEQ ID NO: 166863 - DNA, 509 bp, Homo sapiens
aataataataataaagaaaagtaaaaggggattgtctttagagagttcctgtagagcttggtggctggaggagagtagaggggaattcctaattttcatgatccttttatttgctttcagttttgtttttgttttttaactacgtgtgagaagtggttctttgtaggaaagaggggagggtgggctctcagatcacattacatacccaggtgtccactgatacccacctgtaaggttttgggaagacaagatccaagagggagaaatagtgaatcaagcatgcggattgaagctctcattctgctgctcctaggggcatgacctctgcaggtaatgaaaatgggaagaataatagtcttacctctcaggttgttctaaggaagcagagaaattataaagtatttcataacggcaaaacaatattaaaaagcaaggtatttattagcaaacatttattgaacatttactatactccaggcactgaattaaaatggtaattatttcaatac

SEQ ID NO: 166864 - DNA, 510 bp, Homo sapiens
agtcaatagagtagaataatagaggcatgcaggggatactatgtgaacaccatgaaccctaagaaaagctacctaatccataagacattgtgggatgggggtagttggtcaatttatcagaactgatgatactggactgaatcttgagtattagtagaagttaactggctgtaggcagaagaagctacatgggtaaaggcagagccccaaaaaacagagtgctgggggatctgcaaacatctcagcttaggtggaagtagcatgggatgaaagtctaggcgtgtaagaggagccatgacaaggagtttggatgtgattcttagtatgctgagaatccatggagagatttatacaggaagtggcaagatcagatttgcattttagaaagaaccctctaaatgcagaactgaaaagggactgaagggaggcaagatttgaagaaagggaggctgttgcattaatccacataacactactactagagcctgaactaaggaagcagcagtaggg

SEQ ID NO: 166865 - DNA, 390 bp, Homo sapiens
cttgtagtcccaactacttgggaggctgagggaggagaattgcttgagccgagatcgcaccattgcactccagcctggtcgatgagagtgaaaccctgtctcaaaaaaaagaaaaaagaaagaaaagtaaaaaatactgagtaggttgaaatgctaatattttgggttagtaaataaaaatattatttaaatgattttttttaaatgtgacttagaaaacttaaaattacatatgtggctaatttttcttgtgggtagggttgtctattctatattcttaatagtaattttttgttttcttattatattgattacttagagttgttaaactctccaaatgtggccaggcatggtggctcatgcctgtaatcccagcactttgggagggcg

SEQ ID NO: 166866 - DNA, 856 bp, Homo sapiens
aaaacactggccagcgttctcagttggcgtaccttgcattctttcagcattgcactgtggttctagaccccggtctgacgcagtgtcgggcagccctaccgcgtgttcgagtgctgctcttcggtagcacttggtctagcagaatataccgagtcctgtctgcagaaccttgacaagtcttggaaagcggtctcagaatgcttactcacacacatctgggacatttccaatttaataaatgtcacggaaaaagtttggcagattgtttaattacatgtaaaagctgcttgtggctttccttgctaatatgagcctgaaaaatgctaactacaattgttatgaaatcagggaaagcttgtgcataccctaaggtttttctggagaattgcttacctgtgaactctaaagccattcctgagcggtgccaagtgtgatattgtagcataagaagagatgtacatttggtctgtgccctggcccctggcacagagcttctcaaactcctggactctctggagtactgagagtgtccttatgtgctgatcaggtgactggtgactggctaccccctaggtagcctcaaggtaaggactggtaactggaggcctggcacggtggctcatgcctataatcccagcactctgggaggctgaggcaggcggatcacttgaggtcaggagttcaggagcagcctggccaacatggtgaaaccccgtctctactaaaaatacaaaaattagccaggcgtggtggtgtgtgcctgtaatcccagctactccggaggctgaggcaggagaatcacttgaacccaggaggcggaggttgcggtgagctgagatcgcgccactgcactcca

SEQ ID NO: 166867 - DNA, 316 bp, Homo sapiens
ttaaagtgattcatagaacagggtaaaatcggccaggctcagtgacacatgcctgtaatcccagcactttgagaagcccaggtgagaagattgcttgaacccaggagttcaagaccagcctgggcaacatagtgcgaccctgtctctacaaaagatataaaaattatccaggtatggttgtgcatgcctgcagtcatagctaatggggaggtggaggtgggaggatcgcttgagacagggaggcagagattgcagtgagccaagatcaccactgtactccaacctgggcaacagagcgtgactgtctcaaaaaaaa

SEQ ID NO: 166868 - DNA, 426 bp, Homo sapiens
cagctcagtgaggactttggactggcataaatcataggaatatgattatgaggatacatccaattttcagattgggcaatgtatacagtttattatcatttctgattttgagtagagttagtactaagaacagcattgaagaaaagcagtataacattaaaattaagaagatttaaaatacaagaggattcataacagtcacttttaaaatattgttttggctttctactttggagctgtaattttaaaaaaccaatgaacaggtttttgtatgaatatgttagaatgactaattatagagcatctttcaactggaatacatgtagatactaacacctggttgtatttgatgtaatttcagtgcatacagtgtgtgtaatctgtattaagtgaaatacttatgaataaagttgtttctgcattgca

SEQ ID NO: 166869 - DNA, 313 bp, Homo sapiens
atctgagtggttacagatctcacaacagtgttccgttggctgcgtgacaggttacaccaggattccgagggtcagctggctgcagtaactaccacaggctacactgtcgtgggtttagaaccccctaaagttttgaactgatgacttttggaatgtcactggtagtgtgtctccctaaggatcttgagcaaacacttccctttaaaccctgcccgtctgctttccaagactcaaaagcagggttcacgaactatgccaggaatagtgtgagcgtaaccagcctaccaggacacaagtagaccagtcactaaat

SEQ ID NO: 166870 - DNA, 318 bp, Homo sapiens
cttgattacttctgcaagatggggagggtatgctagaaaggttacaaagactgtaggaagcaaggtaaaaaggtgagagagtttaggaacatgggatcatctgtgttgcacctttctgaagacttgggcagcacaaggcaccttttcttgcgcagtgcaaggaagcaaaatagcacagcatcatatttccattctcatgtgcctctacaaaattgggcagttacctgaactcatcaataaagaatcgtgaattttatgaatgtatcttggagtcgttgagtggggtagcaattgagaaaccacagtgttatttgtcat

SEQ ID NO: 166871 - DNA, 220 bp, Homo sapiens
cccagaaggaatggaggagaggaaacactagagcttcttcccatcctcactgaccaaggaaagctgttcttccttctgatgcctctgttttaacagctgtagaatggaggtaaatactaaaaatacaaaaaactagctgggcatggtggtgcacacctgtagtcccacccacttgggaggctgtggtgagaggatcacctgagcctgggaagtcgaggct

SEQ ID NO: 166872 - DNA, 364 bp, Homo sapiens
cagaacatgagggaacagagatgggatggcataagagaaggccagaaagataggaaggtgccatgttgggaagggcttgactttcaggcttgtgaagtgagggtgttttgtgtctctactggggaacatttgaaggcttggagcacggagaggcatggagtgtgggagtgggatttgaagtataatgaagtataaagcgttgagcgccacacattcagtttctttatctgtaaaatggagaccaccccccgccacgctgaacggtgattctgtgactggtaagagatgctacatttttggtgcttgttcaggtcgaggaaagatgatagttaacactcaggtaataagtattttgaaggcagta

SEQ ID NO: 166873 - DNA, 88 bp, Homo sapiens
attttatgtaatagtatttatttgtatattacattttattttggaaaatagaggtaacatgtttatttaaatatatttacctgtaatt

SEQ ID NO: 166874 - DNA, 354 bp, Homo sapiens
agcaatgctttctggtccctggttttgtgcagaggctcagagacatatctctgcctcagttcagcctgaagtctcatctcctctcttagtctccagttcctataatcaagtccaatatcctgtgacgtgttcattttcagcttccatcaattactccagtttgagttttatcttcactttgagctcttggagatttttctttccttgcttttaagcttggctttgtatttgaagagttttttgttgtattgtatccaatatttttatttgtttgggctggggatgggcagagtggacagtccgtctgtgccagctcagtccaccatatggaccgggcatctgaacatccacatt

SEQ ID NO: 166875 - DNA, 562 bp, Homo sapiens
tgtgaggagtgaagatgagatttggcgcatctttcaacggagtctgagcaaagctaaagggctccgattcgtgcaagccaagggctgcccctcctatcctgtcctccttgaggacctgtgctaaggctttctcatccaccaggccaccacgggctgcgttcacaaggaatgctccctgtctcatctgctttatagtaaagtcattgacgaggtggtggttatgttcattgagattgcagtgcaacgaggacacagtcactctgatacagcaaaccctgcagggtgtatcagggtcccctctgcatgccctgggacctctctatcttgtcctacaagtaggggtcataaaatacgacgctgaatccaaaggccttggctcaaactgcaaccgcctgcctcatgcaaccgaagcccatgaggcctagcgtcttccacgaatgagggccactcccatggccacctcgagaatctgctccacgctctgaacccgcgcgccttcccacagtgtctggtacagccacatattcctccggcagagattgaggatgtggcagatagtgga

SEQ ID NO: 166876 - DNA, 666 bp, Homo sapiens
tgccagacataaaactggaagagccccaattgccaagtaagtcctctctggacagtcattttttcacatgtaaattttgccaagtaagtgcagactggaaaaaagtctgaaaaagagaaacagatttacagtcgtgaaatatcacaattttgaagtctcactgtcttgcttcttatggtcttgcaacctcacagtcacaaattcctgtggtctgaggtcttaaagtatttcattggttggagagaaaccaatcaaattttgatgaactaaaacatacttacgtataactatatacatatacattaataagtgtatatattcttatataagaatatgtgtgtgtatatattactctatacgtgtgtgtgtgtgtgtgtgtgtgtgtgtgtgtacaaatcaatggttaagttgtttagtggcatgattactttggtggggccttagaatttaagcaccaaaagtctaataagacttctattttctttcagcctaggatccaatttcctgtgttgccacagggctgatatctttgatctattaaaatctgcattggtataggtaggtggcaggtatggttggattctgttcaactgtgtctttaatcactttgaatataaggcaaggctttctctctaggagggcgtaaggacagagcgtcatcaaact

SEQ ID NO: 166877 - DNA, 367 bp, Homo sapiens
ctgcagttgagagtggaaatcatattagctttattcacaaatccgtttactaaacattatggaatgtacataccctctgacaagaactggaatgtacataccctctgacaagaactgtagtaacactaggttggatgattatggtggggtgagttaatgagatgcaagggtagcagtgtagggatggacatcatcatgtcagatacaaatatttggtggctttatacaaaagaaatgtgagagatgcaagattatccattaaaataaaagcaaaacatcttgagaacctaaattatatggctatcattcattgagaacttcctaggttctgattaaggacttaacatacatttcctcgtttaacctt

SEQ ID NO: 166878 - DNA, 470 bp, Homo sapiens
tcattcaaagcgtaacccaaacgctttcagctagacagaaataagattcaagcctaacacttgctgagtctccatttcctcatcaggaagataagaatgccacccacctccttcatgcaatgatagggaaacgcaagtaacaggagggcgcttaacagtttgccagacatgtggcccacgctcgctcactcctggacaggatagggctgtgtcttatcttttctaatgccatgcactacctagcacagagcctaagtgtgtaattatttgctaaattttagcgacaaaaggtcaacagacagtaagtggcagaacaagtccttgaatcaacactttcagatcaaagtgttttccgcaacaccaggctgcctctctggtggtttgaaaatactttttaaaaatcccattgacagaacttggacctacctataaaatcaatgtaagcaaataaaatactttgtttagtcctt

SEQ ID NO: 166879 - DNA, 259 bp, Homo sapiens
ccaaaaagtagaattgctgaatcatatgataatatgattttgtattttttgaggaaccactatactgttttccatagcagctgtaccatttttatataaccaccaacagtgcacaagggatcttatttttctacattcttaccaacaattgttatttactatttgtttttctcaacatagcttacccatatcctaatgggtaaaaagtggtgaacaataatttctgaatgaataaatgagtgcttaacaattaaaatga

SEQ ID NO: 166880 - DNA, 248 bp, Homo sapiens
tatcatgatgttcaaattgcctcaaatcactaactgcatggacagcatgttatttcatttgccattggaaatatcataattttaaaacttgggggcttgagattgtgcattaatttttgaaaaatcagtattacttattcaccataaattaaagaggcatatggaacgaaggtcaaaattactgattcattagaaataaaaaacaaaaaccactcaccacacaatttctcaacttatctaaaatgctc

SEQ ID NO: 166881 - DNA, 423 bp, Homo sapiens
ttcctaccttgtggggttgttgtaaagattaaatgagctaacaactggcaatatttagtttgtagaactcagtcctggaaaatggtggggagaagtagtgaagaaaaaaaggcacaaattgggcttcctggtaggtttggtggctctgtggttttagagttttttatttgtttgttcttaccatttctctactcttcagtgcctgtgtgacctcagatgtgccactgaggtggggatctgagcatggacaccagagacgccctacatcttgcggttccctctggctggaatgttctttcctccagatagcctcatgcagtgaaccccaacttcctttaagccttgacttagaagccaccttcccctgaggccttccctggccactccccaccttctaaaacttcctatctcccgaccctactt

SEQ ID NO: 166882 - DNA, 418 bp, Homo sapiens
agaatttgcattaaccaaaaaatgtgcaaacacactactatgatttaccaaaagactctctgcaagtggtaaatcattagctctagtgttgctctttgtaacctcaggtctttggggaatggtgcagaattagtattgcttccttctttctgtgtgtgataatggtgggggaaggctagtaccatctctgtcatacatcaaattcccatatgtgaataaatttatgtatttttactgcactctttttataggtttattcattcctgcaccaacaacgaatgccattattataactttatagaaagtctcaatatatggcacagtgcttcattttctttttttcatctagagtgccttagccattcttggctttctgctgttccacaaatagcaatgtaaatttgtcagtataatagag

SEQ ID NO: 166883 - DNA, 489 bp, Homo sapiens
tgtgcaagaagtcaagcatcattatgatttgtgattaaagttacatatatcacatatcatggatatttttattccaaaagaattattacatacagtacttgtcaaaaactgatagacctatagatactcgtgtagcctttcctacacttccagtgaccagaaagcttattggagagttttactgataaagatcttccttttatagtttctaaaattgtttcctgtaacttcaacctatttgtctggctggactgataaagattaaattttttttttccacaagtcagcctttttaaaaatcagcataatctttgcaaatagtctccatgttaaatattcttagtcctggctgggcacggtgcctaatgcctgtaatcccagcactttgggaggcccaggcgggtggatggcttgaggtcaggagtttgaggttgcagtgagctctgatgcctgggtgacagagtaagaccctatcttaaaaatacaact

SEQ ID NO: 166884 - DNA, 119 bp, Homo sapiens
acactgacaacaactttaagcttaagttatcaaataaggactctcctaaccctgagcttgcataataatccattttttaaagtgtgtaatttagtaaccttccaatttcttgaccacaa

SEQ ID NO: 166885 - DNA, 328 bp, Homo sapiens
atttaatgttgaggaaatgaataaaaaaaagaagagaagagatagtacattctaactttcacctatttgtttattcatttacttaacaaacattgattgagtttgtactatgtctcatttagcatgtcaaagctctgggaataaaagatgactgaaacaggattcttttccctaggaaggtcacagtctgatagaggaggtaaaaacacatccagtcaactataacacaatgtgatatattaagcttttactctgccaccattatatttaatgtactgagggaagacaaatgagtgaacaactaattatattggggaaagtatttggg

SEQ ID NO: 166886 - DNA, 602 bp, Homo sapiens
attgggtgcttaacaatatgctgtatagcctcttattctgaagagtggttaccaccaagaatatccagattgcatctcctaaaatgacagtatttacttcatagggctggtgtaagaattacatgagatgtggcaaaaatcttagcagagttcctgacgtacagcatgtgctccacaggtgtcagctggtagtattactatttttactgtctgttcaagagagcagctagactgagactagactcttagtattgatttcaagttatctttgaagggattcagattggcaagcacaagagtcagacccaatcctgagccctcaactgtttgcaggaaggaataatctcttgtgtcagatgcagcttgctggggcttcaccttgtgaattagggacagggggagaagtgttggaaggcagcctaccatctcaagtgatgcaaattataatctatcaaaggaatgaatgaacgttggtctggcaacaaatatcaccatcccattttatttactaaacttactaaaccactttagcaagttaaaagtagcactgaaggcagatttacatattctgagctctgaagtgaggcttttcttttatgggc

SEQ ID NO: 166887 - DNA, 389 bp, Homo sapiens
gtacattagaactttgattcatgtgacgcctatcatgccatataaatgaaaattcagagtttagattaagaacagtaaagctttctctgttgtaccttaaaaggtacttccctcctcctcataataataagctacatgcttctggaagttttaccaagacttgagatcaggagggagcattctgacgctgagcacacctctgactttgcacatggtggtttcgaggggttgacagcagaagatctccagagtctagtaacagttctgtcttactgttcaaatttgccttttctacctcaatttctcctccattttaacagaaaacctactactactacttcatatgtatctaaaatatttcaaaatctttagtaatgggatataagcac

SEQ ID NO: 166888 - DNA, 463 bp, Homo sapiens
aagtaacatgatacgactcgagttagtacccggagtagtccactatcgctgatcattagagaaatgcaaatcaaaaccacaatggcataccatctcacaccagtcagaatggttattattaaaaagtcaacgccgggcatggtgttcgtgcatcaggtacggccaccagaggttggcacccagcaccttcagctggccctgggtcccagcctggttgtccacgactttgttgtctgatttcaaaagacacacttccaacttgaactggttactgcacttgacggagatatggtaattcaccagccctgcaggaggcaagagagaccagggcttagggagggacatgacctgggtcacacgaacaggaatgccccacaatgaccactcccaggcactctcatttgcttctgttgctttttttttttttttttgggagatagaatctcgctctgtctcacccagg

SEQ ID NO: 166889 - DNA, 136 bp, Homo sapiens
gcccagagcccttcattttctttctttaatctctctgacacagcaagaagcagccaacccacttacagtttctgcccatcacactgtgatatggcagtcaccactgggtccacaaaaaggcatttttttctaaact

SEQ ID NO: 166890 - DNA, 383 bp, Homo sapiens
ttttctgacctggacattttaattttgacaaaagctctaacatatctaaaacatttttccctgcagagttcctacttttataaacactggaagcacatttttcctaccttaaggcaaaaactcaaatgacaaaccaaaacataagccttccaaacccagcaaatggctaaatttatcaatgttctctgagtttatgtgaagtattaagttgaaccttaattggtgtgttttgtttatttttcttgctttatttgcctctttctaaaagaaatgtatcacagaacaaagaattgtatctccaaagttctacgcggttgagtatatttcttggagaaaactccacggtgatcaaactaagaatccactctattttgggactaggt

SEQ ID NO: 166891 - DNA, 328 bp, Homo sapiens
agtgtgctcttcactctgtcaccaactctgtgtcattatgtgcaactcatttgactccttgagctctcagattactcatctgtttttaattaattaattaatggtttctgagcaaggccttgttctgtcacctgttctggagtgctgtggcactatcacagctcactgcagactggacctcctgggctcaagtgatcctccttcctcagctacttgggaggctgaggcgggagaatcgcttgaaccctggagacggaggttgtagtaagccaggatcgtgccactgcactctagactggcgacagagcgagactccatctcaaaaaaa

SEQ ID NO: 166892 - DNA, 399 bp, Homo sapiens
ggtcttcattttggggtatttgctgagtcccaacatcattccgactaaatctgttgaagcaaggttgagaagagccagcccacttatccttagtgcaaaaaactcccaagtgcaaaaatattacttatcacatagatcacgaaatcctcagagaaaaagtcttctctgttattagttccaaaagtaagtctatgtcctctaaataactggtttgtttcagctaatgaacacagtatattgcatagacgacccttctcacataggctactagagagctgagccaaatttatgctttgctgtgcttttttttactttacatctggctccacttctatactccaattttttttcttgatttatcttctgtcatttataataaatattacgtgttttgttgga

SEQ ID NO: 166893 - DNA, 400 bp, Homo sapiens
ctggctggcttccaattccgagctggtttccacagaggagccagttataggattcactctcagccctctgggaacaaagctcaccttttatttttggaatttcctgaaatgaagtggaatggagggactgactgccttcattttcagcttatgcttttaactacagtggtagttggcagtttttgtcaaggatgtgctttgagaaaagccaaggagccttcattcactcctgggacacaattcaatgctgatactagccatctacagccaaggagcccagaagttgtcatgtagagttccctaatgctgactagttttgacaaacacatggacaaactgcattatggattaagatttacctgtgagatcactttagtctgtccgagagaccttcccaacc

SEQ ID NO: 166894 - DNA, 188 bp, Homo sapiens
aagcaaattctctacctggctccccaggaataaaactgagagaatcaatctttctatgtatgcatcagccccctaatccacagaggacattttaaagtctccatattctagctactatttcattacttatttgattgaaggctgtcaatcaagaattttacaaccagaaaagctacctataaaaaata

SEQ ID NO: 166895 - DNA, 543 bp, Homo sapiens
gggtgagaggaaggagagaaagctggagagttaagtagggccagatcatagaggccttgtaaccatagtagagtcagacttctattctaagtgtaatgggaagcagggagtgacatcatccaattagtactttttagaagatcactctagctactgtgtgaatggattacatagggcaatcatggcaatagggggaccagtgaggaggctgttaggtgagaaaattggtgcccacatcatttgtcatccagaccaagatagttgtgcaggtaaacaggggtgctacaaataattaagcagggacaacaggcataaccagatggtctctggcaaagtgggacatagggacactctggatatgatagattagggcagtagttttcaaggtgttgttcctagatcaatagcatcagcatcacctgagaacttgttagaaatgcaaattctcaggcccctgccccagacctttgaatcagcaacttgggatgagcccagtggtatatgttttaacgatcccgctaggggatgcaggctaaagtttga

SEQ ID NO: 166896 - DNA, 271 bp, Homo sapiens
aagaaaaagattgctaattccagaagatgacgcacgatacggagaagcatgtaaaattagtgtgctgttggcctctacactgagaagagcactggttctaagatgttattctctatttactttcagaatttcggttacggagtatcatcctctttatttagggctggaagagatgtttattgaatttttcatactacttaaatctgaactagctcgcaaacggtgttgataaaatcaaacatgctattagccttgatgtctatacaggtgg

SEQ ID NO: 166897 - DNA, 365 bp, Homo sapiens
gaccagagtcacgttttccagcggggaagggtgtaaactcagcgacggccgcccaagcacccacgggtccctcgcaggaccagagtcacgttttccagcggggaagggtgtaaactcagcgacggctgcccgagcacccacgggtccctcgcaggaccagagtcacgttttccagcggggaagggtgtaaactcagcgacggctgcccgagcacccacgggtccctcgcaggactggcgccacgtttagacagggctctgcgaggactcacccctctgccccttaggaacctggccatgggacagtcacgggggaggccttccacagcctttccaaggacacctgaggccacctaataggctcga

SEQ ID NO: 166898 - DNA, 515 bp, Homo sapiens
aattttcctaacggctaatgacgttaaatgttgtcatggacatttctgtcatttgtatattccctttggtaaatgtctgttcatatctctaccccattttctaactggatttttctttactgttgagatttaaaagatctttacgtattctagatatgtcttttgtcaaatatgttgttttataaagattttctcccagtctgtagcttgtctttcatccttttataggatgttcaaagcaaaacctaaattttcatttagttcaatatatcacttttcccttttaaggacagtgttttgtgtcaaggctttaaaactctttgtttaatgtttaaatgaaaaatcttaagacttttccaaaaatactagtagagcactttggccacctaagtaagtaaccttaatttattccatctgctgggaatatacttttgatccagctattgtttcataaactagtgtgttttatattatagtacctagcacatggctacagttttcaaatgaaagctaag

SEQ ID NO: 166899 - DNA, 535 bp, Homo sapiens
tcctactcactggctgcatgggagacatggtgggagtgagactggcctttcaggctgtgtgggagttgggcgaggccggtcactgctggcttttccccactcccctggtggcctgtataatgcagtaaagtcagccataatatccctgggaacataactccatcagcctgagaactacacccccatcccctacagcagccacacacagcaagctccgcccaaggagagcctgagctcagacatgcctaaccctgccccaactgagggtctttctctaccaatcctggtagctgaagacaaaggacatactctcttgggggctctatagcccccaaacttcagcatcctttatgattaaaacctcagcaacacaggcatagaaggggcatatcttaatgtaataaaagccatctatgacaaacgcatggccaacattacactgaatagagaaaagctgaaagcattccctctgagaactggaacaagacaaggatgcccagtcacaccagtcctgttcaacatagtactggaagtc

SEQ ID NO: 166900 - DNA, 341 bp, Homo sapiens
aaaatggatattttagaatgagactgattttatgttacaacttttatatttgttttcatttgagtaatagagataataagaccaaattaagttttttgaactccttatgtgcatagcaccccctaatacatgtatgaggccatttagtagttattgtaaactttagtattaaatattccatagaacaaagagcttaactaagcttataggtattttttcatactgtgggggcactaatgattaatggaggtggcattaatttagtcatggaattgtggactgttttatcatggtcaactacttcagagtttggtatgtagcttttaggactgatacaccta

SEQ ID NO: 166901 - DNA, 323 bp, Homo sapiens
gatgagccactgcacctagccatatatttatgttataatcccaacaatactgttttatacttaattattttacgtaattgtcttataaggtaattaagaatacatatatacctttccctacaagatgatcttttctggtattcattatttctgtagactcaagtaactggtgtaatttctttctaacctaaaagattttcttcagcatttcttataaaggcagctctaccagcagctattctttcagtctttttgtcattggtttattttgtttttaaatatgtggatgtctattttgccttcatgccttcatttttgaaggt

SEQ ID NO: 166902 - DNA, 392 bp, Homo sapiens
ttttagggcaagggttttgctgattgctgggaggagttcaaggtctgaagagtctaactctttcagagacattgagattttaataccacacatctgtcagtgttataaccatgtttttgacttgtgtagtaagtttattggttaaaaacaaggactctttattttttgtggagacggaggtctcacttatattgcccaggctggtcctgaactcacgggctcaaaaaatcctcccacctcagcctccttgggattacagatgtgagctgctgcacctgaataactggggggctgaagtgggaggtttgcttgagcctgggaggttgaggctgtagtgagccatgattgtgccactgcactccaatctgggtgacagagcaagaccttgtctc

SEQ ID NO: 166903 - DNA, 652 bp, Homo sapiens
tgtatcatggaaaatattagagatacagtgttagcagacagtgtgggaaagccaggctttccctgtgcagccttctgtgagctatcaaggttgtacttcttataccctgcaattagaagactggggccaggtgcagtgactcacgcctgtaattctcagcctcctaagtagctgggattacaggcacgtgccaccacacccggctaatttttgtatttttaatggagatggggtttcaccatgttgtccaggcaggtcttgaactcctgaccttgtgacctgcctgcttcggcctcccaaagtgaggcgtgagctaccgtgcctggccagcaggattatttttaagttactgtgtggttagtgatttcggccttcccagaagctctggaaatggactatacttctactgtatatatttgcactagctttgctttactccagaggtataaggttgctggagtaccagttttattcaattcaatgagtagggacaatacagttaggcctactgtgggaaccaagtgaaagtttaagacataattcctaccttcaaggacactccaaatttcctaggagaaatacgatttatgaatatgaagcaataagcaaatgaagcaaggtagcatgtgaaaaagtggcataatgtgactgg

SEQ ID NO: 166904 - DNA, 387 bp, Homo sapiens
actctacaggatctcgacggcttcaacggaactttatttgaaaaaggattgataataatgcatggttacaggtgactttttttaaaaacttcttattctgaaatactgtcccataggacaagggggaactgtacagaaaggtttcctgtaacctttacccagtttctcccaaatgctaacaccctgtataactctagcacaatatcaaacccaagaaatcgacagtggtgcaatccatatactttatagtccccccacccctgccccatcggcattttcaattacttgtggtcaagcccagtctgagaatattaaatggaaaataacagaaaaaataaacaattcctaagttgtaaattttgtgttgttctaagtagcatgatgaaa

SEQ ID NO: 166905 - DNA, 681 bp, Homo sapiens
cgggaagctgtttcgcctggaggctcgcgcgctttttggaattcagttatcaagctttagagcctggctactcacagttgaagcctgattgcagggttcttttaactcttctctccacacccgcactggagaccactggtaaccatctgtggccatcacctaaactctcacccagtagagatggggtttcaccatgttagccaggatggtctcgatctcctgacctcatgatctgcccgcctcagcctcccaagtgctgggattacaggcgtgagccacaatgcccggcccacgttttgctgttaataatgatggtgctgaagactatggctttgatgactagttctgctttaagaaaacattccgttgatttgtacaaatagcacaagaggacaccaactccatgcagatggcagcccagcaggtcacaccagtccttctgtcctcacactggcagacagaggcctcctctctggagtcttcacaggggcctgagctagagctggaaatgcagctggagctgcagccaaagctggggctgcagggccttgatttgagacttggccttggtcttgggtgggcagaggtaagacccttggcaatgcaggcaggagcacgcttcccgagcttggggtaggcaatgtaggcaagtcaattgagcttctggatgatgtgctttgg

SEQ ID NO: 166906 - DNA, 602 bp, Homo sapiens
ggaactgacctggtaacaccatagaatgctgcctctggcaatttcctttgacccagtaggaaaattaggagcagggcttgttttatttctcttatcgacagtgccagaatggtgtccactgtatattgtgtgcacacatcatcacatttttttgtgtgactgtttgtttgtttgttgttgttgttgttgttgagatggagtctccctctgtggcccagcctggagtgcagtagtgcaatcctggctcactgtaagctccgcctcccaggttcatgccattctcctgcctcagcctcccaagtagctgggactacaggcgcctgccaccatgcccggctaatttcgttttgtatttttagtagagatggggtttcaccatgttagccaggatggtctcgatctcctgacctcatgatctgcccgcctcagcctcccaagtgctgggattacaggcgtgagccacaatgcccggcccacgttttgctgttaataatgatggtgctgaagactatggctttgatgactagttctgctttaagaaaacattccgtaagtcttcatcattgcagtgatatatatttccttgcagtgatatatatgta

SEQ ID NO: 166907 - DNA, 358 bp, Homo sapiens
agacacaatgttccctgtttctaaataaataccaagtagatcaaagcttattttccaatctcttagcagtatatttttgacaccaattgaaaccacataagacagggtggaatattggacattttaaagtatcagaagtcccttgtactaacacacagcgtactaataacacaatgtgtctcccatgtactttagcatagtagagagcctgagcagggcatagcctataagacatctaaatctagatgtagaagtctaggacagtgcaggctatgggtatactgatgtgaaaggaacatccatagaacaatacatcaaagttgttgaagtgttgcaggggagggcaaaaaaaaaaaga

SEQ ID NO: 166908 - DNA, 451 bp, Homo sapiens
gtaggcgcccacttgcaaagaaatttgatattgtgcgtcacctaagtctgttactgagctctcatatcagacaggagtctcatttatttagctggcttcttagatcagaggtggtccttggccgacatcgattcaacgttttgtgacttggttgtttggctgcagttggtgtcactctcgatagttgtgtgactctatagttcatcagctgacatgtataaaccttctggatcaatgcaagtgggtgaacgcgcaggttgggaggagagtgagagtaggaattagggacacctggtgccctattccttggagacagaagtcacacaggctgtgtgaggttggggagggcgctctgcaaaggaagaaatgatttcatcaattggccaatggcttcagcaacctgaagtttactccaacgaagtttgtcatgcaataaaatcatagacaataa

SEQ ID NO: 166909 - DNA, 446 bp, Homo sapiens
ttgatagaccattagcaaggttaaccaagaaaagaagagaaaatccaaataagctcaattagaagcaaaatgggagatattacaactgacaccactgaaatacaaaagatcattcatggctactatgaacagctttatgcacatcaactgggaaacctagagatggataaattcctggaaagatataaccctcctagcttaagtcaggaagaattagacaccctgaacaataacaagcagtaagattgaaatggtaatataaaaattaccaacaaaaaaagtcaagaaccagacagattcacagaagaattctgccagacattcaaagaagaattgttaccaatcctattgacactactccacaagatagagaaacaggcaacccttcctaaatcattctgtaaggccagtatcaccctaatagtaaaaccagaagaggacataaa

SEQ ID NO: 166910 - DNA, 496 bp, Homo sapiens
agccagccagggtccattggctcctcctcgcactggtcctggcctggctgtcagggcagaggatgccaccagtctcaagacccagagtggccgcaggaacaagggagactctgccatttgagccaatgctccagggactagaagcctgggttctgactccagggcccttgctctgccctcagcgtctgccctcccaggcccagtacccatgcctccctcagccctaagacttccagtggcctcctgatggtcagaggccctcagaacactgtggtcgggcatcctgaagccccagcctggggtcggggatcgggggcagaagccttgcagccagtcccactcctgatctgaccactgcttccagagaattacagggtcaggaaggcccctgctatcccgtccctcataccattaaaatcagatacttaaaattatgcaagaaatacatgaacagcgtctcttcagatgattcagacaatacagaagtggggtaaaa

SEQ ID NO: 166911 - DNA, 341 bp, Homo sapiens
tccataatgtgtgcccaggaggtggaggctgcagtgagccgggatcgcaccactgcactcccagcctgggcgacagagtgagactctctctctcaaaaaaaaaaagcatattatttcaatagacactgaaaaagcatttcgtaaaattgaacatcactttatgataaaaacccaacaaaaataagtatagtagaaatatacctcaaaatgacaaactcacagccaacatcaatactgaatggggaaaaaaattgaaggtctttcctctaaggactgaaacagacaaggatgccccactctcacttactgttattcaatacaatactggaagtcccggccag

SEQ ID NO: 166912 - DNA, 379 bp, Homo sapiens
gtgggaaactgaggcttagagacagcagagctggggagtggcagcaggatattgtggcaggtggtggcagtcggggacttcaggctgtggtctcacaccgccacactgcctttcccttttctcacagagaacattcaaatggctgtctttctctggcaaggtagaaagcctctcaaataagtaaggaacatgctttggttaacagctaacgaggcattaggtctggacagggagacaagcagtgcagcagccaaatcccagtggacactagacacgaggaagaaagcacggtgctgccagggcaggtcctcctccctccttcctccttcctccattaggaggattcctgagcctgcaaacctgttccctttgtgcatcc

SEQ ID NO: 166913 - DNA, 293 bp, Homo sapiens
gcagagccaccaacccttcacccccaggggagtctctgggaccctccctctgccagggccagggctcagagttcagcccttactgggagccatgtgcccagccatgtgccagccgggagcagagtgggctcctggggagacaggaggaattcccctgaggctctggcctgaggcagggcccagtcccctcaacccacagagcccataagccccctgcccaggctctgtgcaagcctctgctggatccagagcccacaggaccccgccaccttcagctttccatttcccagtgc

SEQ ID NO: 166914 - DNA, 282 bp, Homo sapiens
gacattttagtatagttaactatccagtaggacattgagcatcttgctttctaccttttactttactttctctgccaggattttcctagtgagcatgtgttagttttgtaaagaggaaaaaaagcaaacctggttttaaaaaaaaaatcccattgccaagtacaacaatttacagcactctttttagtatattctgaaatagtctcctcatgatttctttctcttctgtactccaaatgtaacactaaatcacacacatgtacacacacacacacacacaca

SEQ ID NO: 166915 - DNA, 375 bp, Homo sapiens
gagaacggaacccgcatcccttctgggcttggctttctgcactgagtttgaagcagaatggagtgctctcacctcgcccgagctacttggggatacagcggtcccatcttcttgtctgaactcaacttcaagtgcaatgtgcaatgtattaggtttctggttcaccccaaggcaagtgttcagggtcccagaacatgtggaaactgcgctgggtgccttagtttgcccttgagcttgtattcataagcgagtcgaggtcttaatttctccctaaatcccacactgcagagagaaaagtatatggaaggtggaactgagttatttccaccaagatgctgaagtgggtgcgttcaccgtgaatgaacagcgcaccag

SEQ ID NO: 166916 - DNA, 326 bp, Homo sapiens
gagtgacagacagctcagaggcgtgctcacttgcttccacgtcttcctctccaggtttcccctcctctccagctgctcgtcagcctcccaggtgaaccccctgggcttatccctcgaatgcggctgtcatcgggccctgggcccccttctcctctcacgatatccctgcccgagccatctcgctatgtccccaactccaagtccctctccagcccaggttgccctcagagcttcccatacctccaaccggatgcctgatagatgattcaggctcatcttggttaaaatagaacttgctgcctccattccccccgtgaccagctcct

SEQ ID NO: 166917 - DNA, 272 bp, Homo sapiens
aaaatactgtatttttgctatcttctctggttatttctacatctctcccttaggatgacacctttgctcttcttctgccctgagcatttgccaaatggatacaacaaaattctcgttatccagtttggtttatatttaactcttgcaggtgcagcagtggcacagacgagggtattgtgttgcctgctaccctcttcagcctctaagccatatggcatggctattggggaagcaatatgactgtgataggatttttgtttttaaataaacct

SEQ ID NO: 166918 - DNA, 551 bp, Homo sapiens
gagaacgctggatgagcccgagcgaaggcagacacctccagttatgccccccccagtgaggtgcccccagcagccgccctcttccctctgggctctgaaagagctcaagccccaatccttaagcttcacgatggctgagaccaggaggcctcttcctggaggcaccagccctgtctcgctgtgtcacccaggttggagcgcagtggcacaatctcagctcactgcaaactccgtcccccgggttcacgccattctcctgcctcagcctcctgagtagctgggactacaggcgcccgccaccacgcccggccaacttttttgtatttttaggagagacggggtttcactgtgttagccaggatggtgtcgatctcctgacctcgtgatccgcctgcctcagcgtcccaaagtgctgggattacaggcgtgagccaccgcgcccggccaggcatctttctttctttcttgtttattctggtgaaatacacataaggtaaagtttaccgtcttaaccctttttaagcgcacaccttggtgacatgtagtgcatt

SEQ ID NO: 166919 - DNA, 301 bp, Homo sapiens
attttagaagaacaggggtgaattagagtaactgttaagatgacattctctaaactccacttcaacttctttacagttaatgccttcagactgttccattcatcatcccttcttcacttgatgtgtcatcttaaatttcttaatttaactactcaagtaataagatcatattttttgacatgagtctgagcctagaaccttagtttaagccattgggagacattagacttccatttttattaatagattatcttttatttgtaaacaaagtatctttcattgaaggaaaatggtgctttct

SEQ ID NO: 166920 - DNA, 488 bp, Homo sapiens
tgaataaaatgagtaacaataaatgaaataaaaatgaaagttcagctgttgttcaaatattcctctcttaagctgctgatcaaatattcctctctcttaaatatgaagattctgacaatgaatgctcatataacaagatttgtctgtgtacagaagcatcatttatttaggttcctgtgatacggatgatttaaaaaaaaaaaggactggattgacccagatatattaattgacatggccctatcttccccaaatagattaacttttaaatacaatttccccttcctttgggaagttttccatcttttacaagaaacaacacataactgctgttgtaattactgatgacggaacatttatttagtaaaaggcactatgtgactacgcttgtctgcaacatttcccctttggaagacgctgggccccaacacctcacgaactgtgtctaaacacctgcagcatttcccagcagatcactgtcacactgg

SEQ ID NO: 166921 - DNA, 487 bp, Homo sapiens
caattcttcatcaattccagagtctctgtccattatttaaaccaatattttattaaaaccctcatactcttgtccttctccctaattcagccttctatctcatgtgctcaatgaaatcccaaatttggatcaatctaactaactgcatttactgcacctttatttctgctgctgggttctaaaatcacatacaaaaaattaaatcatacgaattaaaagtctccttcttcacctgggcccgcaatgctacatacagtccctccacatgtgcttagtcagcatcctctctcaaagaactatttcaaattttaaccacttgtcaggcccgaatctttaccacatctcttcttctcactctcaggagataagcttatatgctgtttcacagagaaggcaaaaatcattaaatggaaattatcttgtcacaaaaaatgtatccatatttaaactcacctagatcaatttacctagtaaaaagcatcactcc

SEQ ID NO: 166922 - DNA, 165 bp, Homo sapiens
acctgccttggccttccaaagtgctgggattacaggcgtgagccactgtccccagccaggtaaagaagtaatttagtccttcattctgcagttggggattttaaagttgtctgccagttctcttccctggccctcgtcatcacttaaaatatctttcgtaaagcc

SEQ ID NO: 166923 - DNA, 479 bp, Homo sapiens
agaatggctaaaatcttaaacactgacaatattgtatgctggcaaagacacagagcaacaggaactctcctggtgcaaccactttggaagacagtttggcaatttcttataaagctaaatatagtcttaccatacagtccagcaattatgcttctaggtataggtattaacccaagtgatttgaaaactgtccacacagaaatctgtaaacaaatatttatagtgactttattaatgatcaccaaaaactaaaagtagccaaaatgtctttcaataagtgaattgatcaataaattatacattaataagatggaatatgtatggaatactatttagcaataaaaataaatgagctctcaagcaaatgctaaaaggcatggataactcttaaatatgtattttgtaagtgaaagaagccagttcgaaaagtcaaaatactatatgattctatttatatgatatatgaaaaaggcagaact

SEQ ID NO: 166924 - DNA, 213 bp, Homo sapiens
atgactaaatgaagtcctgagttcagagtactcatcctagaaatttctcaggggacagatacatcctgtgatcaaacaagattgggacccatcgtaccccgtcttcccttagaaagtcctaatacgcattatgtaggggactctgaggtgcgctccaactagaaaacaaaaagcgtcagtaagctaactttcttcacctcatgtttcctaaac

SEQ ID NO: 166925 - DNA, 371 bp, Homo sapiens
ctcattttgatgaattaccataagtctcgcacaggtcatcatgaatccactttctgcccaggtgatgtgtacctaggtgagtcagacgcccataagttaaacactcttctctcttttcagctcctccaccctgacgactcagtgctatgtgctctggtctggccccagctcccaggtggttagtattgatctaagaaagcaagggcaggaagggcaggctgagaaggaagatagaggccacgaggcatggaaagagacaggtggggctgtcattattcaaaggccatactctgggtgtgttttatgactgcttctggatttgaaatcttctcctctttgggaccattccaggaagtcaccctcctcctact

SEQ ID NO: 166926 - DNA, 386 bp, Homo sapiens
atcctgcatcctggacatcataaactagatgattcctttgcagaattacatattcaacctcttccttttacatgattccttcccatcgtattttaaacattcacaagtttgtgcaatcaacatatgaaaacaaacctaaatcaataatttttaaaaaataccgatcctgtgttctcctccagcgaatgccttctttcttccatagcccaatttttttaaaggagttatctatacttatagtctgtattttcttttctctagagtatgccaatctggcttcagttcccaatagtccactgaaatagtttttttgtgaggacggtgctgactttacatcaccgaatccaatacatattttttactcttcttacctgacctctcatcag

SEQ ID NO: 166927 - DNA, 310 bp, Homo sapiens
gcctcacagagtgggtgtgagaattaaatgagaataaagggacttgaatgtatctccagcagccatgtgattattgtcatcagggggtggcagcaagtgtagagaaggcagggacacgtttggggttgacattgcacattatagagtgaaacataagtggagcccaaatgctatgcttatgtgacacacattgtcctagtaatgatctcatgcacctgctgcacaaataagaaaggaattgtagcctgctgcgcatggctgccccttgagagaggaggagaggagttatttctggaatttgccccaaggt

SEQ ID NO: 166928 - DNA, 224 bp, Homo sapiens
ctcctgagaattatggttttataaagggcttccccctttgctcggatatcaactctctcctgtcaccctgtgaagaggtgccttctgccatcattgtaaatttcctgaggcttcctcagccatgtggaactgtgagtcaattagaactctttcctttgtaaattatccagtctctggtatgtctttattagcagcatgagaacagactaatacatacggttttg

SEQ ID NO: 166929 - DNA, 904 bp, Homo sapiens
atggtgggagtggggaagacagtgaaaagttgtgcagggaattcacagaactacagaacccactttgtacttctggaactgctgagtggggaactagttctaaggaacaaggttagtgccccagcagttggagcagtttggtgagagagtggcacaaagctgacactggtacatggccctggccactagttgttaagttccacccatctccagcactgccctccccatgagtgacagtgaaaggtgggagggacgttacaggactgtatcaggcattagacctgctactccaagtgcagtctggtgcagtctgcaggccagcagcctccctgctgtccagcactttccgcatcacttggaagcttgatggaaatgcagaatcttggaccacactttaaagcttctgaatcgggcggcatgcgatgcctcatgcttgtaatcccagcactttgggaggccaaggtgggtggatcacctgaggtcaggagttttgagaccaccctggccaacatgttggccccgtctctactaaaccccatctctactaaaagtacaaaaattagccgggcatggtggcgggcgcctgtaatcccagctacttgggaggctgagacaggaggatcgcttgaacccgggaggcagaggttgcattgagccaaaactgttccgttgcactccagcctgggcaaccaagatgtcccttcttaggaacctttgtagttaataccactgtatacagtcagaccacaattttgtttcatgaaaaaggctggaagtaaacataatgaaaggttaaagatgcttgggggtgctaagaatcattttctacctatcttttcccttttccccccacgtttttgaaactctgtctcaaaaaatttaaaaaataaagcttctacatcaa

SEQ ID NO: 166930 - DNA, 330 bp, Homo sapiens
aaagagtttaatggacttacagttccatgtggctggggaggcctcacaatcatggcagaaggcaaagaggagcaagtcacatcttatgtggatggaagcaggcaaagagaagagaagagagcttgtgcagggaaactcatccttataaaactgtcagatcttatgagacttattcactatcacgagaaaggcatgagaaagaactgcccccataatttaattacctcccactgggtccctcctacaacacgtgggaattcaagatgagattttggtggggacacagccaaaccatatcaatcagttaacctcccagggtctcagttttct

SEQ ID NO: 166931 - DNA, 167 bp, Homo sapiens
tacacatgtgaatcatctttttgagtcctccttataactctatgagatagtgtttgagtttttctattgctgtgtaggaaacctccaaagccctagtgacttcataacaagaatcactcattatctcacagctctgtgggttgccaaggcatttcttctgcctcctg

SEQ ID NO: 166932 - DNA, 315 bp, Homo sapiens
gcttgataccctttgaattttcagtcagacattctggagttctagcatcctgtacctaggaccttcctctgtgtcactcttggcctcctaaactctaagaaaataactatattctggagcttgggcagtgtgttttgcataatccagcaatctcctcatgacatgcatgtgttgatagtcctgaaacattcattgagagggtaaatgcagttgacctagaatgaccaataccaaacagaattttaagaacaggtggccaactcctatggagcttactcacatattactattcttttaagaacggaaagtaaaatt

SEQ ID NO: 166933 - DNA, 451 bp, Homo sapiens
gtccaggttgggggtgtccacatcctgatcctagttccagcggaagcgctggaaggagatcagcagcagctgtgagtgttcttcttccctgggacgaggtggccgcccagcacgaccggcggcggcagcagcagctggagggcgccgagccatgtcatcccacgagcacctgtcatgcactcctcacacagttcatgggcttcgccctctttagtccgttgttgaacaaagtccacattaataattcagcccagctctgttgtgggacaaacaacctggagtgaagcaaggtgctgcatatttgcaggacaggatgaaagcgttctggggatggatgggggacatggttgtacaatgtggtggacgcacttaacaccactgaatttttccttcgaaaatggctaaaataatagattttttatgtactttaccacaataaaaaatcaaactg

SEQ ID NO: 166934 - DNA, 393 bp, Homo sapiens
gcctgtaaaacctgtgacgacatgttgcttttccctttggtgtcacaaattccaaaatgaagtcaaaagagaccaattcagatgtgagcatgttttatgcttcagttgattttctatgctgtcgtgagctcctcaggttccagagatatcatatatcacaaaggcttgaaattgagctacaccaaccattttctgagatgagatctactctatctatgccttaatattcttggcatccaattattgtttgacatataaccttcagaaccagatgagagcaaacaacactctctactagaaagttttctagttctttatcttcagcatgcctaactctcagtcataaaaatgactgtttaccaactacagctgtgtagttgttcagtttttttt

SEQ ID NO: 166935 - DNA, 326 bp, Homo sapiens
acaccggatggattaaggtagggatgggggaaggagtagaaggtgagttgggagggaggggcttgtgtggcactgagacccccagcagggatggggagaaggggtgttggccacctaagcttcctggtttgatccttttttggctggtttcagctggggaagtgaagggtcctaaggcttggatatggagaggtgggaatatggagaggtggggatatggagaggcggggataaggagaggtggggataaggagagtggccccgcagctcccctggtgaaccagaatactttctcagggttgttcccaggctggagggagggaatt

SEQ ID NO: 166936 - DNA, 393 bp, Homo sapiens
ctttatcataggcctgactcagaacctatatataaaagtaccttcaaactttagtgttctttcagatgccaagtattttacttaatccatgtgaatgaaaagatatttggactgggtatccattgagttaagctctagccttggtatttgtgaacttaggaaagactgtttacccagtcataaaattgaaaaaatcatacttggcttgcctacttcatataaattgttattaaaattaggtataatagagtgacttttaacatgccttgcaaaatggaaaatgctttgtaaaatagaataaccatttaaaattgtcatttatgtatcattctcccctaaaccgcacaaataggaaataattctatcccccaaggaaaatgttctttgtttaaa

SEQ ID NO: 166937 - DNA, 371 bp, Homo sapiens
tgaaggcacaaagaacggagaacgctgcgtgaacgcacacacgtgggggagaaagccaggggaacgcacagagtaaatagaacgcaatgggaacgcacaggaaagagaacgccacgggaacacaccgggggagaacgccaggagaacacactgaggagagaactccgcgtgaacacaatgcgggagaactccaggtcaacgcacggagaggagaacgcctgctgaatgcacggggttggagaacgccggtgaacgccggtgaacgcacggggaagagaacgccacgtgaacacacgggggagacgccgcacgagacaatccagcagcccaggaggttgatccggccgcgaatttagtagtagtagtcgacc

SEQ ID NO: 166938 - DNA, 370 bp, Homo sapiens
actaaaaaatttgagttctagtttggttctgcaactgaatagccctgtgaacttggaaagtgggaaagtgactttaactctgagttttgttttcctcaactctcccaaagagactggaccagaattgtttttttttcacaccttattttcttgaactgtagtgttgattccatagaggtgccagaaaagaactaaatagaaacctaagcaggtaaaatgctgagcctctagctctgtttcagtcagagcgctttcactttatactctgtaatgaggtgtagcacttggccgggtgcagtggttcacacctgtaatcccagcacttttggaggctgaggcatgcagatcatgaggtctggagatcgagacc

SEQ ID NO: 166939 - DNA, 315 bp, Homo sapiens
cctggatgttcccgctgcaggacagccccggggaggcggaagggctgcaccacttctctgcagactcttctgccacctgctgcctctcctcctccctgtggctctcccagggattttgtgccttactctctgctttctccagggcctggccaaaggaggaggtgctggggattccatcagtaccctcccacctctcccagaggaggtaaaggcaggaaagtctctggacaggtgcagagaaccgacagctatgtcagcaattccccaggaagcttcccaggacctccccaggcggagcaggtagtgtggatgtcc

SEQ ID NO: 166940 - DNA, 312 bp, Homo sapiens
aattatccaccgatgaggcacacactgctgccacgtcctgacagaaccaggcgtccatgtgtgcagcacagatgtgtccacctaagactgcgtgtgcatgctgacgtaagcactattatttacaacagcccacacggccgtcaactaatgatggatacacaacatgtggtccgtccacacagtggagtattactaagccataaaaacgaacgacgttctgatcgacgctacagtgaggatgaaccttgaaaacttcattgtaaataaaagccagagggcggggcgtggtggctcatgcctgtaatcccagca

SEQ ID NO: 166941 - DNA, 408 bp, Homo sapiens
gggttatgtggattaataataatgtgtgtaagatacctaacacagaagatgacatgtggggaatgttcaatagttgttagctgcagtaatcaccccaacatatgacatcttttataaaggtatgtgattatccccttatgacaaattcctaagaataggatttgctcaggcacatgatacggacgttctcagtttttatttgcatcaccaaatagctctccagaaaagttgcagcaatttatgtactcccacccaccgtagaagaaggtgctctggtccctatgccctcactggatacattttgtcaagtcttttaatctttgccagtctgaaaggcaaaaatgtcatatttttctttttctttcttggctcactacaacctctacttcctgggctcaaaacccagcg

SEQ ID NO: 166942 - DNA, 500 bp, Homo sapiens
cattccagggccatgcagtggacaactgaggaccaccccaatagcccagagcccatagaaattattcaaaccatccaatcctacccctgctttgctccttaccctttctctcccatcctttcccatgacaaccacaatcaaggcttctgcccgtgctttcccttttctctttctgcctctcctctgacccacatttcgaaatctatgtgtccctgtgtggtactgcaagctccctcctcctgagaactgtgagaaacagactaccttttcagtggcaactgtctcctcatgtgttggcctcaccatacctgaataaaaacaatatcccaggtgcatttccaaacaagtgcatttcacttaggtaagctccacgctgtctatgaaacttttaagaattcatgactaattttatttaaagtgctaaacagtactcaatggtcttgaagtgtccaaaatgaaaaataaaataaaataaaaataaagtgctaaataggtttact

SEQ ID NO: 166943 - DNA, 247 bp, Homo sapiens
ggagtttgtgtttttaggactttagcgtgaaactgagaatcatcttgtgtttcgagcatagagataacgatgaaagaacacaaagaaatgataaatgcttgaggtgatggataccctgtttaccctaatgtgattattacacattgtgtgcctgtatcaaaatatctcatgtaccccataaatagatacacctactacggaccataaaaattaatttttaaaaagaaatactgatgaaagcacagat

SEQ ID NO: 166944 - DNA, 299 bp, Homo sapiens
gcaactggtgccgtccagaaatgtcgggtgagtgtcgttggattatctcatttttcaaaagaaaccaaagtccagattttactataaaatcccaatattcattgttagtcctaattaaaaccaaccaaccaaccaaccaaccaactaaccacattttgggccaaaaccaaaaacatgttagagggcaaaatacagaacttaagccaccagtttacaatatctgttccatcaattcttcctaggcagccaaatctacttctgtggctacataacaaaaattcccccatttttctcagtag

SEQ ID NO: 166945 - DNA, 248 bp, Homo sapiens
gagaatcgcttgaacctgggcggtggaggttggcagtgagctgtgatcgcaccactgcactacagcctgggtgacagagcaagacttcgtctgtgtttaaacaacaacaacaacaaaaaagtgagattttgtgtattagcacccttggaaatggggagcttctacaaaggatgctcatgcctcaccacaaaccaatcaaatatttagtgggcagtcaaggcattgatagtttttaaaagcttccaggt

SEQ ID NO: 166946 - DNA, 713 bp, Homo sapiens
gagcatttgtggtagggcaatgatgtgtatcataattataacttatttaaagggcctctgtgggaaacactagtaacattttattggctctctacctctgatccttcatgtggaattggaatttaaaaaaataagagcagtttggggatatgatctaataatcttcaaggaatccttgatagttggtgtgataatcaaattagggccatggctgtattttcattatttctataactttgtttgatgtttgataacgttaggaacaggataaactttggtcagcattttttcctgtttagctgaggatttaatctaccctaggccatagttcttgaatggtcatctttactgacagtgtcttcgaagcctagaccatagatttggggggttttgtttttaaggctaatacttttatttttgaacatgaagtttaattttttacttgcatcttcatgtatccagagaattttttttttttcttgattagaaagtttactttttaaaggctgggcgcagtggctcacacctgtaatcccagcactttaggagactgaggctggtggatcatttaaggtcaaggtggcctgcgcctgtaatcccagctacttgggaagctgaggcaagagaatcccttgaacccaggagccggaggctgcagtgagccaagatcgagccactgcactccagcctgggcaacagagcaagactccctc

SEQ ID NO: 166947 - DNA, 216 bp, Homo sapiens
gggggctttgttccaagtccttcctaggggcatgggaaggtgcttaatggagagaagcaagcagcatgagtaggacactttgggtttcttttctctcgccagtatcaaaaggaacttttcttaggagagaaaggtaactgggagctttagggtggatatagtacacacttcattctctggggtccaagaattatgtctttttcctactaggtgggg

SEQ ID NO: 166948 - DNA, 351 bp, Homo sapiens
agcataaaaagatggaaagcttccaattcacgctgccaagcataactctgacagcaattcaacaaagcagcaccaaaaaatacacctacaggttaatctcacttgtggaatatataaacacaaagtaaaagtctaggctggctgtggcggcaggtacctagaatcccagctccttggaggctgaggtgggaggattgcttgagcccaggagtttaagaccagcctgggcaacacagtgagaacccctgtctcaaagaaaaattttaaaaatccatggtattgatcttgtgtttacccaagaatgccacaagacaacacaaaataagggagagataagatatcaaaaggaaa

SEQ ID NO: 166949 - DNA, 481 bp, Homo sapiens
tccacctcccaggttcaagtgattctcgttcctcagcctccagagtagctgggattacaggcgcccgccaccacacctggctagtttttgtatttttagtagagaggggttttcgccatgttgcccaggctggtctcgaattcttggcgtaccaaagtgctgagattacaggtccgtgcctggccaaagcggtatacttttaagaatcaacctgagacctccctgtgcgttcatgccaagtgtgggcttgagggaatttccagatttttctcaacgcacagtgccccagcagactgcatcactgagcagcaccacagtgatgttagctttgaaggctaagctttcaaagtaagccttacccacccttgccatagaaaattctcagtcatgcactcattaaatgagctgacttaaagcaaaagactcagggtgcgaaaaggaacacatgtcagttcgtttgtggaaaataaataattatagt

SEQ ID NO: 166950 - DNA, 200 bp, Homo sapiens
gcctggctaatttttttctatttttagtagagatgcagtttcatcatgttgttgaaactggtctcgaactcctgacctcaagtgattcacctcccttggcctcccaaagtgttgggaatacaggcataagtcaccacgttgggccgggactgttccttttaaatcatgggggtttttacctctatccttatagtttattc

SEQ ID NO: 166951 - DNA, 291 bp, Homo sapiens
aacagttgtgcattgctggtggaaatgcaaactggtactgccttttggaagggtatttggcaatatctagcagctttccttcaacccagcatcccacttctaggaatttattccaaagatataccccaacagtatgaaaatacatgggcaaaagggtatttattcattgtagcattgtttataattgtgaaatactgaaaatcatctaaatgcccagataaaagtgattgaattaattttacattcacaaaatgaagttctctaaaactgttaataaggtatttgaactga

SEQ ID NO: 166952 - DNA, 563 bp, Homo sapiens
ctaactggttcccatttgtgttcattcccaacacagcatacccagtgatcctgttaaaatgttaattagaataagacattccccttctcaaaaccctattttgtctcttcatgttactcaaagtcagaattcttagggttgtctgtagactctacatgattgaaccaccctgtttcttccctcatttttagctgctctctctctcattcacactgccttccttgagattccttgaacatgccagggacattccaggtctcagggcttctcttaactgcttctgcctgaaactctttttctagctatacacttggcttgttccttcatctccttcaggtcttgaatgccattctctcaacaaagccttccctaaccacttattcaaaattgcagtttctgtcctgccattccttatctctcttgcttgttttatttttctcaatagtacttactgccttctaatatactacatcatctgttcattattttatatagtaattgcttccttgcattttatcacccaaatgtatatccctaaatagtatagtttattcttgcctctt

SEQ ID NO: 166953 - DNA, 340 bp, Homo sapiens
caaaattgctgctcgttaagctcctagagtgtgggactagatttactcttcttgttctccctggtctttaatactatgcctggcatacacagggggtgccataagtattttgctgagtgagttggtgaatagatgtgttcctttacaaagtactgttttgatcatctcataagaaagtcacatggtacctgggtggcctgagggaaaagcaaggcaggtctccagggttgagtttagcatgcctgatctttgctgagattcaggatttccaattgcactggagaggattgtgtaggtagtagcaagagggtggctacatttagctgacgtttctcatgcg

SEQ ID NO: 166954 - DNA, 444 bp, Homo sapiens
accaagcctaagacagaggagagaaaatgcagacggaaggaaaagatgaaaagaggaaggaaagaaaagagcacacctcaattaggccattttcataaaatcgagaggagccgggcgaccccaagcagttcagccagacctgcgcggccggcgggaccgtggagccaacctttcgggagaggggagcgtcgcgctgcagagaaatcctctctattcatcaccaccgacctgacggccgccatcgtcgccgccacagagtttgctccagttgggagaacgaaggcagcgggcgctcactttacaaaaaaataaaacgtagtttagcaaatgcccactagtgcgacgggtgggcgcctcccgcccccacccctcgttggcgggtccctagcctgggtgggggcgggagctgacaccgaggtgccaagtccccgttgccggaacccc

SEQ ID NO: 166955 - DNA, 490 bp, Homo sapiens
cctggagtggtgatggctactgaccttattccttgactacatagtctcttctctctcagtggctctcaggagtacttgtgattaacatagtccttgagcacaactctttaaataacgaactcatttaaaaaaagaaattcaaactccattaagggctagtcctcagtaagcctagcagatgtttccacactttcctacggtttataagctgtctatgtaatgcttctgttgcctcaacaatccagttaaagactgacagtacttgtttataacagcagtctaatacagcctttttacaatttctctttagatgtttttttttttttttgagatggagtcttgccctgtctcccaggctggagtgcaatggcgcgatcttgtctcactgcaacctccacgtcccggggttcaaatgattctcctgcctcagcctcccgagtagctgggattacaggcacccaccaccacacccagctattttttgtattta

SEQ ID NO: 166956 - DNA, 427 bp, Homo sapiens
agagagtaggcaccatcctaaggacctagaacgctacaggtcattttggctttaaagacttagtcttgccgaaactttaaattgtcaaatgactggcaaccatcaggaaaatatttcttccacacagtttattcagaaaagcctggaatgcagcacacacatagagtcagtggacacctctccagtgtaacctgtttcaaagatccctctgactaagttataatcctgggcttatttccatccaccactcaacatattagcaagtgtctctcccacggcccagccaccaggctaacaattaaaaccattgtttcaactgacctaacaagacacttgacaggttaaatctactaaatgcgctccaagctaaaaaagatccatttttggagtatttattttggactctgagctaatctgcccctttcat

SEQ ID NO: 166957 - DNA, 361 bp, Homo sapiens
ggtgcagtcattgaaaggtgtttatacagagaaacgtgcccatacagagaaaggtgccctctctggtgggaagaggagtttcctcaatcaaaaaaggaggtcatatggaattggggagttcaaagttttcagcctgcccaggcgcagtggctcacacctataatcctagcattttgggaggctgaggcaggcagattgcttgaggtcaggagttcaagaccagcctggccaacatggtgaaaccccgtctctactaaaaatacaaaaattagctaggcgtggttgtgtgggcctgtagtcccagctactcgggaggctgaggtcgacgcgcccgcgaatttagtagtagtagtagtcgacc

SEQ ID NO: 166958 - DNA, 280 bp, Homo sapiens
gggttttgcctcaaagcatcttgtctcaggcagcttacagtccgaaggggagaaaaatgtatagaagttatgcaataaggtttaaaaaatgaaataaaaggcatacatattagaaaggaagaagtaaacctttattagcaggttacataattatatatctagcaaatctgaagaaatctatctataaacaactacaagaatatgtgaagtaaggagagaaacaaaatagagttagtataccaaaacaaattgtatttctatatactagcaatcagcaatc

SEQ ID NO: 166959 - DNA, 263 bp, Homo sapiens
aatttatcatgtgatggggtctcaggttttacagagtaaatccactctaacagttccatccctctgtgccttctgaccccttcttcagaactatgctgaggaagtttcaatatcttcacccaatttactgtaggccatcattctgctcatggttcaaggagccctcccagtatggtatcaggactggttccaggtatccttatcagctaattgaatcccaagtctcaggttaatgttctcatgtcaatcaccatccccatctg

SEQ ID NO: 166960 - DNA, 429 bp, Homo sapiens
caagctatccggttcaatatccaatgccctgggacagcgggggaagtgggattccagcctttcatttattctttcacctatttgtcctctttactctgtgtacaaaaaaagagaggattatactatcatagactgttgtttctaaacagaaactcaggctgggcacagtggaatacgcctgtaatcccagctagttgggaggctgaggcaggagaatgaatcgtttgaacccaggaggtggaggttgcagtgagctgagaccgcaccattgcactctagcctgggcaacaagagcaaaactccgtctcaaaataaatacatacatacatacatgcatacatacatacatacatacggggattaaaatagtctagtagtgacacctgaacagagagattgaccggatagctgccggatcctctaggtcag

SEQ ID NO: 166961 - DNA, 322 bp, Homo sapiens
ctaggcacacacaagagctctgcagtgttttaagtaagacagcacacagttcgattctttcttattttgcattttaattttttaactttttttttttctcttgagactgagtcttgctctgttgcccaggctggagtgcaatgacacaatctcggctcactgcaacctccgcctcctgggttcgagtgattctcctgcctcagcctcctgagtagctgggattacaggcaccaaccaccatgcctggctaatttttgtatttttagtagagacggggtttcaccatgttggtcaggctcgtctcaaagtcctgacctcatga

SEQ ID NO: 166962 - DNA, 362 bp, Homo sapiens
acagataaattgaacttcatcaaattttaaactctttgcgcagcaaatgagactatccaccaggtgcggtggttcacacctgtaatcccaacactttgggaggccaaagcaggaggactgcctgaggccaggtgtttgagatcagcttgggaaacacagtgagacccccatctctactaaaaatacaaaaattaactgggcgtggtggcgcgtgcctgtaatcccagctactcgggaggctgaggcaggagaatcgcttgaaccagagaggcggaggttgcagtgagccgagatcgtgccactgcactccagcctggcagcagagcaagactccgtctcaaaaaaaaaaaaaaaaaaaaaaa

SEQ ID NO: 166963 - DNA, 703 bp, Homo sapiens
caactttttgtcgcttattaagacttcagagatacaaaccagtagctcagtaattgctttcttgaatctgcctttaataattacatttagtaaagctgtatcgaaaattagaaaggcagagactaatggaaaactagatttttcactgaattagaaagcaagacaatccatatattgacaacacttcaagttgaaacagatcaggaaaactgttttggactgtttgtgcaaagaggcaaacctgggcctgatgggcagtggcttccgtattttatggaagcagagaaactctaagagattgcatgtaaatcggcatattgggaagagagagtccaggtctgatttagatacaagtcatttgaatcttttaaagcctggaatttctccatggtactagcaaagaagtagaatataaagaattgtgttaatgaagtgggaatatctttgaatttaaaaaaagtacaaaactcatttagggtcatatcttgcagtcaaaaagaaacgtgtgcaggaagattatagtagcttctgtagtagttgatgtggtgttttgacttcatggtcagaaaaattagtcattttagttttttttttttgcgtttcagaaagcatattaaaaatatcccaatggtggattaactcaggattttttacatgttaggaaaataattaaaactaaaatataatgatattaattgaaata

SEQ ID NO: 166964 - DNA, 524 bp, Homo sapiens
  misc_feature (512)..(512): n is a, c, g, or t
tttttcaagtttatttattattcttcttaaatttcttttagagacaggatcttgctccattgcccaagctggaatgcattggtgcaatcatagctcactacatcatcaaactcctgggctcaaacaaccctcctgcctcagcctctgaagtagctgggactacaggcatgagccactgcactcgacctgatcacccattaatttggtagaactggatgttttcagtgggaataccactggaccccagtctggtgggcattagaaactaggcttcccagaggcatttgaaattagactgccatttcttaggcattctaagatccaaccaataatattgaaagaacagcccattttacttgaatttctttgatcccaaagtaaggaatgacttgaaaagatttactctgttcctgtgttttcaggttcagaatttcagttgtctttaaagagacaagaaagtactataaacccctctagtgacctaatccaaaatccgatttacatatatgtantttcttgtacaa

SEQ ID NO: 166965 - DNA, 682 bp, Homo sapiens
aaaatgtaactgagacagaaaaattgtctcaatccttccagtgaaaatagttttggtcaacagttattgtgtgcatttcttcctactcagtatatattttttggatttcactttttaaatgtactatggatatatttccattcagtattatacatcattgcttttaaagttcctgtgggtgtgtatatatctatatctcatcccattgtttagacaaaacaattacttagacaaagcacagtttaatcattctaccttttggtaatataggttctcaaattttctgtgtactctttcaatgaacatcctcatatatatatatatattgtgctgagagcagtatagtatagtggttaagagctcagttgtgtgatctgggggaagttattaaatctccttgtgcctcagttttctcatctttaagtagggaatagtactttacctgagtgctgtttatggattaaatgagttaatacatataaaatcttggagtagtgcttacaaacattaaatatttaataaatgctgctagtattagcagtatttagtcattttaaattataagaagctgaattgcttcaacttttaagtgtgtaataagcaatgagtttcttattgccagatccttcgtatacccttatttttgacctgtggcatattccaccagatccctttttcttat

SEQ ID NO: 166966 - DNA, 388 bp, Homo sapiens
ctttgagtccccagccccaaccaacccattcattttctgctttggtgtatccaccgtctatcgctgttagaataatgtccatgtgccaattacagaaggccgtgggcagcaaaacttgagagcgctggcttcagcctgctttgtccatactctcccccgtgactttgtggcactttgaaggatagcaactagcttctctgccatctctgcacttgcagctgaccaggacagaagtttttgtctaacatacaaatgcaaccatcccagggaaattgatgaattacagtcctgttagttctccactctatatcatgtggaatgctgaacaatatgtcaggtaaccaaaaacagcatcacttaatggaccaaaataaaattgaacactatc

SEQ ID NO: 166967 - DNA, 409 bp, Homo sapiens
agcaatgaaaaataccttagtagattcaatgagcctcttggttttacaaaaactgggctgatcctctctggaatagtgtggctggctctgcataattatgtaaaagccttcttcctttgggtggggaccatctccagaacattctgaccaaagcattttcactcaagaatatttagatgtccacccccatcccagcccagctaacgttctttgttccacacaagaaatgtcaatgctcagtgtcctatccagctgtcaaccaatactcaggatctggctagtaaagaataacctacaggagaccaggcacggccactcatgcctgtaatcccagtgctttgggaggctgaggcaggaggattgtctgaggccaggagttcgagaccagcctgggcaacacagtaagacc

SEQ ID NO: 166968 - DNA, 218 bp, Homo sapiens
tttaaagcttcaccttcataaaaattctaaaataaaacttataacatcccattatggcactaacaccataattatagctcatggcatgaacccaagaggctaacattatgatatgtgtttcaaaacagttatagtatgataaggagtattttaaagccaagtaagttaaaatatattccagaatgtcaaatactctagcctacacctctacaccagta

SEQ ID NO: 166969 - DNA, 376 bp, Homo sapiens
caggaggggtttggagaatgttccaacgccccgaacccacgggagtaggctgtggtggggagggagtgcctcgttttcatccctcagcccccacccaccaggagagccaggcaggctgctgccgtgtgatgcgccgctgtgccgatgagaggcgacctgagagcagcagcggccggaaggacggccctctatccacatcgcagcacgaagctcactggcacagaacacccccacctcctgctgtcctggcagcccagaaacacccagcaccagccagtcacccagaagtgtcaccaccgtatgggtgtccccagccaccacttccaaatggctcagttggtcccttggttttattgttggtgcactggaattctta

SEQ ID NO: 166970 - DNA, 414 bp, Homo sapiens
gggcgaaggggcaatccctggcactccagggcctgggctcaccctaagatgacagggaggggctggcagctgaggagatgagggagaggatgagaggtgttttaggaagaggtactgctcctgaagctccagtgggatcacagttgggaggacacttgggcccagaagctccatgcatcaaggcaggctccacactgaggctctgatggcctggagcagaggccagtatgaatgaccgtgaattgtcaaatcagggtgattatgagaagagcggagcaagtgacaagaacaaagaaatcaagaacaacaactgattgggaagaagaaaacacacatctggttttggttcatacacccggagcgtgaggtccaagggaagaggcctcaaggcatgcgcagtcactgccatccctg

SEQ ID NO: 166971 - DNA, 354 bp, Homo sapiens
ccatatatagtatagtgtagtaaaaacttttcatctgttttctggaaatcttgattttcaactctttctaatgtatttttcttttgggggcccactcagaccttacaatatgtcttctagaggcacagagtgaaaagccttgttagtctgctgatgtgccttcagaccttctccggactattccttgaccagaaccatcccttttctagctggcttttctggtagagtctatccacactcctagaactgtctactgtttgcttggcaaggtctacctagatccttccttggcctgcatcctcctgggagctgtggggtcaccatgagccttgttacttctttcttttcccccct

SEQ ID NO: 166972 - DNA, 262 bp, Homo sapiens
agaagatttttggggtgagaaatcttgattgtggtggtagttacatggatgtataaatgtgtcaaaattcgttgaaaggtccactttaatgtttgcatcttatttgtttacattatacttcaataaagttaatttttaaaattcaatttaggtctgggccagagagaagtaaacatttgtgagttagtggtgtttaaatcgtggctgaaattccaggaatggatgaaatcatccaagccacatattgaggataaaaaaagga

SEQ ID NO: 166973 - DNA, 506 bp, Homo sapiens
ttaataacctctgttatagaagaagtagagcaggaataggagggcagaaggcctgtgtgaaggtttgtttgaaggagttagaggggctggagagtcaggtaatgtgctagatacagagttctaagaagggaagtgctttgggaattgtgccatttatctgaaagcagtcaagtttttttttttgttttttttttttgagatggagactcactctgtcgcccaggctggaatgcagtggtgtgatctcggctcactgcagcctccacctcctgggttcaagtgattctcccacctcagcctcccaagtagctgggattgcaggtgtgggccaccaagcctggctaatttttgcattttttagtagagactgggtttcaccatgtaggccaggctggtgtcgaactcctgacctcaggtgatccacccgccttggtcttccaaagtgctgggattacaggtgtgagccacggcacccagcctgatatttttttcatttaattaaattg

SEQ ID NO: 166974 - DNA, 709 bp, Homo sapiens
tccgcggccccagcatgcagacgcagagaaattaaagtgacggggcaaggtctctggggagggaacgacctcccacctagaagcaatgacagcagcgggggcgaggaggccgtgagcgccagggaggctgctccaggggaagctgggagccccacctgaccccggctggatcatctcattgtcccatggcggcagtcacttatcacaatgtatttattcttatcagcctcccctactagaatgtcaggcctcattcactcctatctcctagaggcccagaacagtgcctggcgtgtagtagatgctcagtaaatatttgtcgaatgaatgagtctgggtctctgtagacaaaagaaagaagaaccaaaaacccagtagtatgtgctgtacgtgctgagcactgaccttagtgagcacgtctgaaactgagccctagagggcaagtgacttcccacagggacacacagctagtcaaacagccaggacgagctgcggtcccacttgaggtccctgtgtccagccacatggtgggacggggcctgcacggggcctcccttcccatgtcccagcactggacacgagacagtttctgcagtctagcatgagcggtcacaaaacatcagagcctgcaaggagtgcagggtgcagaggctgccaagggcagcttcctgggcactgcagatttcctgaacattatgcaccctcagct

SEQ ID NO: 166975 - DNA, 358 bp, Homo sapiens
ggatgagaactcaagcaagccaggaaatgtttcagtggacatgaaagccaagggaaaaatcctagggcatgaatcatgtgggatttcaatttccctgatgccaagtatgataactatcatggattccaaacagtgttgacaatacatgttttctttgactgcaaaatttcatagaaatgtgttcctacccttaaaaatcctgggtccagaattcaattgttataggaagtaaaagttgccaggtggcagaggaatgaagagcaggaacactgcaatgttagagatgccttcttacctccccttctgtgtgacttctacagtttctttcaagatagccaagaaactccaacaatttaag

SEQ ID NO: 166976 - DNA, 181 bp, Homo sapiens
ctgggattacaggtgtgagccacccggcccggccggggttcaactttttaagattcaacacattggtgatatcacgtggtaattgtttttctgaggtgatagatatatgttagttagcttaacttaatcattccatattgtatacatatatctaaacatcacatggtacccataaatgtat

SEQ ID NO: 166977 - DNA, 403 bp, Homo sapiens
ggtttgtaagggtagagagttagattccagctttttttcttcttctaccatctgtggtactttactatgtgaatatacagttcaagtcacagcaagaactctaaaaaactgacaagcaaaaacaatgtcaaaaatgaggctgatgctgggcacagtgtcatgtgcctgtagtcacagctactcatgtggctgaggcaggaggatcacttgagtccaggagaccagcctgagcaacatagcaagcaagacccagtctcaaacaaatacccacccccacaagaaaaaaaaaaaaacaactattgaggttgaaaaagagaaggaccaaaatgtgttcattggacttagccataatgaagtttttggtgactttggaaagattggattcagtgttgtgaaggtgaaa

SEQ ID NO: 166978 - DNA, 377 bp, Homo sapiens
acagactgtcacgtgagtgggaatgaaacttttgctgcgtttagaccattatctttcttcactctgtcacatagtctatccccgctaaacagaacttgacctcctccagaccatttacatcaagacctgtacgtgcggtgcagtggcctgagcctccaatccatgccccacctatccaactggccttaccatattcttattctgagagtggtattctgggggcagaagctcagtgcatagaattgactaatgccagatccttcaggtgctttgcactttgaagtatatcagtcctagcacattccaagtacaaagaagacacgtcagcagtacaacctgccctacactcagttcaattccttcttcaaaaacctagg

SEQ ID NO: 166979 - DNA, 494 bp, Homo sapiens
tattgtctttccatatgataaaataataaagtgactagtaatttttgaattgtatgccatacatgttatgggcccagactgcttgggttcaacattctgctgcaccagctactggctgaaggaccttggcaagtcacttagcctctctgagacttggttttctcgtctgtaaaatggggatgataatacaggtcaagtagccctaatccaaaatttcaaaatctgaaatgctccaaaatccaaaacttgttgagtgccaacatgatgctcacagaaaacgctcatcggatgtggggcatggtggtttacacctgtaatcccagcactttgggaagccgaggtgggagaatcacttaagcttgggagttcaagaccagcctgggctggataacacgttcgcgagctcgcgaacgtgttatccctgcactttaggaggctgagcagggtggatcacctgaggtcaggagtttgagaacagcctgggccacatggtg

SEQ ID NO: 166980 - DNA, 822 bp, Homo sapiens
tgccaagccagtcagcacagacctctgccatttgctgtcattgccatgcaaggaaagagtcccagctcacaggcagacgtgctccacaaggcagccaggacctgcaacctggccacatccatccatcatctagggtcacctctccgtccagacccatgcctggttattaagaagtatttagtgatggcaggagacccacctggagactggatgggtgatggtggcagtgatgatggtggagttagtgaagacagtggaagtgagaatggaggtaaggacaggtgtgaaggtgaaggtaaaggtggaagtaaggatggaagtgaaggcagaagtaaggatgaaggtgaggataaaggtgaggttgaaggtgaggataaaggtgaggttgaaggtgaggatggaggtgaggatggagagcggaggaaggggaggacagaagtgaggttggagaggagaatagacgggaggacagagatgaggatggaggtgaaagagggacagtgagtgagaagagagtgagaatggaagggaagattgaagtgaggaagggagaacagaggggaggatggagatgaggaacgaagaatggaggggaggatggaggggaggatgaaggcgaggatggtggtaatggtggaggtcagggctgggtgcggtggctcacacctgtaatcccagcactttgggaggccgaggtgggtggatcctgaggtcaggagatcgagacaatcctggctaacacagtgaaaccccatatctactaaaaatacaaaaaattagccaggcatggtcgcacgcacctgtagtcccagctactcggga

SEQ ID NO: 166981 - DNA, 449 bp, Homo sapiens
  misc_feature (217)..(217): n is a, c, g, or t
ctgtagaagttatgttggaaaaaaggagagtaaattgtgtgattaatggggaaggatattggataatgttataccccggactatgaaaaaagctggtggtaaatgggaagaatgtgaaattttaaactgctctcaacgtaggaatcttggtggaaaagttcctacctgaggtctgatatgattcaattatagaatgcaatgggcttggcccaggggnctttggtccagggggggcagtgaattggtggcggcaggtgtaagtaattgctgagatttgggtttggggagtgggctcacgagtgtttatgacattattataaatgaatatatgagtgcataaattagcaaaataaaagggggcttttctggaccaatgatgagacagtgtttatgaacaaaagatcatgattaatccagttctgcacaaaacactgaggtccattagaaga

SEQ ID NO: 166982 - DNA, 144 bp, Homo sapiens
ttaggtattttgttatagcagcaggaacagattaagacagacagctataacatcaagatacaaaagtcactacagtaaacagctataaaaagttaattttagaaatgcaccacttgtaggagttccacttctacagggtataga

SEQ ID NO: 166983 - DNA, 503 bp, Homo sapiens
gaatgacagttcaacaagaatagtgttagagaaagaaggaatagcctgcgatgagacttacttagtaagaaaaatcagaaagacttggtcattgactagacaaagaaagaaataaaaggaaagaagttgagaatgatgtcaaattctagctgagacaactgaatgaatgatggctcataggagtcacaggaagagaaggggcgtatgatacagtccagctatgtacggaaagatccatggtacaacaaaggggagatgggccactggtcagggtctgaagctcaagagcaatctaggcttgagaacaaaatggtagtcattaacacagagatttttaaaaaatgagaaaatataaatgaaaataatgatggacatcttttatctgttagattaataaaccaaaaattaattgtaatgcccattatcaatgagaggatggcaaaattgatatcctcacaactagtggaagaaaagcacaacttttctgaaattatatgtgatag

SEQ ID NO: 166984 - DNA, 560 bp, Homo sapiens
gtgctgtcgtgttatcgattacagaacaggctcctctagagggtatgaagcaccgccagttctttgagtttaaagctgtgcttcgtagtgtctgggcgagcagtttggttgattaaactgttgaggtttagggctaagacatagtggggtatcaaatcccagttggggtctaagctatggtgtgtccagatatgtaaaagccactttcgtagtctatttaggtgtcacctggaagtttttaacacactcaggtgagtttaagctttacattggggacagggggtgatctcaaaacactctttacgccggcttctatggacttgggttacccacgacacagtgtccagttcaagtggtacgtggacggcgtggaggtgcataatgccaagacaaagccgcgggaggagcagtacaacagcacgttccgtgtggtcagcgtcctcaccgtcctgcaccaggactggctgaacggcaaggagtacaagtgcaaggtctccaacaaagccctcccagcccccatcgagaaaaccatctccaaaaccaaaggtgggacccgcggg

SEQ ID NO: 166985 - DNA, 615 bp, Homo sapiens
gaacataaactgaaaagaaaaaggaaacattgagagatgacacaggggtcaggaccaccaacttgctttatttatgttctactccatctgttatattcattagatgtattttctaaataaacatcttaatgtgactaagaaaattggttaacatttcaggattccatattatatctagtacactagaagaggaaaaaactctttctggtttgcacataggaatgtaagagatagccatctagtggtctctctctcatgtaacaagatgtttgtacagattctgctctgaaactttattctggcaaggcctgtgcaactgtgtgcagccaagcctgttgcattattttaacaatttttgctttcctaacccaataacaattttaaatgataaattcacatgaactggagtgctctacctttggtattttatcacagcttttagatttcctcttacaaacctgaatgactatgcatagttctgaacctgtcttcctccatcaagattaccctaaacacagaggttgcagtgagccaagattgtgccactgtactccagcctgagcgaaagagagagaccctgtctcaataacaataatagcttaaacatatggattc

SEQ ID NO: 166986 - DNA, 1043 bp, Homo sapiens
agagttcagagagatcatagaggcagaaacaacaggatcctatcactaggaaagtctggagacactgggagagggattggagcaggacagcccagggttatgatgtaggtgtctgattaaatggtacttctattcatcaaagtgcagaacacaggaggaaaaacaggtttaggggtggggtggggtgacgatgattaatttatttgcagaccagttgaatttgagacacttgaggtgtccaagagacaactgaatgatctagaactcaaaatagagatctaggccagagatagaaagagagcatacggggataactgaatccatggggttggatgaaggtagccatgaagactgcataggaagggcagagccctaaacaatcatatttaggcaatagagtatgagctgctcacagaggagattaagaaggaacagctagagagatgaaaggaaaacaaggagaatgtgctgtattggcaccgagggaaatgagtgtttaaaagaatggcagagtggttaaattccacaaagtaaacaaatagaataaagactaaaaggtgtgttcagataaagcaacaaggaggtccccagttacctcatcaaggctgatgtctgtgcagtgcgggggcagagacgtccagggtgatagtgagcatggatgccatttcctacagcttagctaagacggaaaggagagaatgtgggaattggggagaaagagccagtaaaagggaatgttgaagagagagagagatgtttaaaggagcaaaggtcgtgtggaggcaggagagaaaagattctaaaaagtgggtttgggtaatagtctgggacagaagagggatatcctttccatgggataaaagagaaacggaaggccgggttcggtggctcacgcctgtaattccaacacttcgggaggccaagacagatggatcacttgagggcaagagttcgagaccggcctggccaacatggcgaaacctcgtctctactaaaaatacaaaaattagctgggcgtggcggtgcgtgcctgtaatcccagc

SEQ ID NO: 166987 - DNA, 427 bp, Homo sapiens
gctagaggtctcatccccggttctgggtgatagtgagcatggatgccatttcctacagcttagctaagacggaaaggagagaatgtgggaattggggagaaagagccagtaaaagggaatgttgaagagagagagagatgtttaaaggagcaaaggtcgtgtggaggcaggagagaaaagattctaaaaagtgggtttgggtaatagtctgggacagaagagggatatcctttccatgggataaaagagaaacggaaggccgggttcggtggctcacgcctgtaattccaacacttcgggaggccaagacagatggatcacttgagggcaagagttcgagaccggcctggccaacatggcgaaacctcgtctctactaaaaatacaaaaattagctgggcgtggcggtgcgtgcctgtaatcccagc

SEQ ID NO: 166988 - DNA, 457 bp, Homo sapiens
tcactgcctctgcgcacattttacattaggaaagtgttgcatcgtgctcgagtagaagatttcatgggaaacagactaccatctttggaacaggatccgatatgaataattctttgaaacatttttctctgcatgtctgtatcttagtcaactttcagtttcccctgcttgaggagagtggggcatgtagacaatccaaatgtcatctatatttggctttagagtgtgttttctacttagctttgagttctggatagatctgcgattctgggaactgactttaaacaaaatcacgaagctttgcagtgaagacacatctgactcacaagtaagttgaatgctttccaagggcccatttttttagaacttgctcaactctttcctgcaataatgctgtgcttggatcagcccactttctctcagaccctggcaaactggccattccaatattccttcc

SEQ ID NO: 166989 - DNA, 795 bp, Homo sapiens
tgaggccggcgattattcagcccttcgggagctttgagttctggatagatctgcgattctgggaactgactttaaacaaaatcacgaagctttgcagtgaagacacatctgactcacaatgtcctttgctgcatctgcatttgagctgcccaagagcccaactaaattaatccctccagaagtaaaggagatgaaatcaaccaatctgaggaaagcctgaccaaggcattcatgtatcaaaaagatatggaatacctacccactgcatacatgatactagaaatcctacagcttccctgcacagtggctgtggttttcatttatatgaaactgaggccagagaggtaaagaacttggcctgaagtcacatggggcactgggtattatttgaagcagtttttttcaaaaaagtcacggagaaacattactcagagcctctccctcacaccctgcagatagagctctgaatctcggcatctgtgagttgtttcttttgggctttttaaaaagtcttccagaattgtggaatgggatagtttcagttaaaatatctgtttttgaaaatcatgaccaataataaaaatcaagaatgtcctattacatatttcatacctttaagaattttgttttgctctaattggtcttattggattaaatgatttctaaagtcttctctgggacttcacttttgtgtttcaagtttcttatccatctgaaagccatatatttgggttaaaccaaattattagcaataggtatctttgtagaatttctagtagtttggaaggagttgaa

SEQ ID NO: 166990 - DNA, 213 bp, Homo sapiens
tctcttgaattgtaactatcacaattcctatgtgtcatgggaggaactggcgggaggtgattgaattatagtcttacttgtgctgttcttacccgtgctgttctcgtgatagtgaatgagtctcacaagatctgatggttcttacctgtgcgggtcttacctgtgctgttctcatgatagtgaatgagtctcacaagatctggtggtatagct

SEQ ID NO: 166991 - DNA, 576 bp, Homo sapiens
aacttccaccagaaaccattggtttctatcccacaagaattccactgaaatgcttctctttggaagccctactgagctgtttaaactgtgtttctttagaacttccaacattttcagcttttccttgactttttctctaatagacatgctttagttaaagctccttcattctgagttgttctgtgaactagatttcatggtttactaactcatatcctaaatagaatcatccaaaagaacgcatagaaacattctgttgattccattttggttggtatgtgactattaagggttcttacagtatggtgaatctcagattcctcagggggctccctgaggctgaggatgatagatctgacgattcacaactctcatctctttgggatacattggtcattgttacagagttaaactgcccgggcagataggaggttctggagttgagggctggtttaactgatcagggcatttaacctgtgtggcattggacctgtaaaatatgacaaatctttgggctggaggaataaggttctgcaactgttaaatttgattaatgattaccctgtgtatggaaaa

SEQ ID NO: 166992 - DNA, 126 bp, Homo sapiens
atgaggttctcaatatatatttgctaaacgagtgaatgaagtggtaacaagtttctgaaaaaataagttggccatctctgctctggtcctatggggccatctcacagatggaaacactgaggtttg

SEQ ID NO: 166993 - DNA, 518 bp, Homo sapiens
tcccgaattcaagcaattctcatgcctcagcctcccgagtagctaggattataggcatgtgccaccatgcccggctaattttgtatttttaatagagacggggcttctccatgttggtcaggctggtctcgaactcccaacctcaggtgatacgcccgcgttgccctccaaaagtactgagattacaggcttgagtcattgcgcccggccaactcactagactttttaaattcaaatataagtagcagctaacatgttttgaatttttactgtggaatttttactgtgcatatatattggtggtttctcattcaaccatcatcacaagtctatgatataggtatttattcctattttgcagatcaggctactgaggcacacacagatgaagtcacttgcttgtatgttggacacacacagctgctatgtgacagagtagaaatctgggccatctgactatctacactcataatcactacacaattctgccttcccaaaggaaaaaaagtattaatgag

SEQ ID NO: 166994 - DNA, 671 bp, Homo sapiens
tcatttgttaaagagattatcctttcactattgtatgttctcggcacctttgtgaaaaataagttggccataaatgtatggatttatatctgggatacctattctattcctttggtctatgtgtctgtatttattccagtaccatgcttatttgtttaccatagctttgtagcatatttggaagtaaagtaacatgatggctccagctttgttatttttgatcagtattgctttggctatttgtgctctgttgtggttccgtatacttttttaggaatgttttcttctatttctgtgaaatgacattgatattttgaaagatattgcattgaatctgtattaattcttctaattcatgaacatggaatatttttccattttattgtgtcttcctcaatttacttcatgagtcatttatagtttactttgtatagacctttcacttctttgcttaaattaacttctaggtaatttatattatttgaagccattgtacatgggtttgcttcttaatttatttttcagattgttcactgttggtatatacaaatgctactgatttttgtatattgattttgtttactgcaactttactgaatttatcagttctaacaattttttgttagagactttaggtttttctaagtataaaactatgttattttcatata

SEQ ID NO: 166995 - DNA, 646 bp, Homo sapiens
taataattgcatgcatttctgaatgcatatttacttaatatttttcataattaattttggaatttctaacactaaatgcatcacctactctgaactttaaacagacaataataaattgtataacagtgtagattctgaattaactgtatcagatattatgttaagaactaatatatattgcatagtctacatctagtgataaggactgaaactggagaaatagttctgagaaactatatagaatagtgatgaacatttaaaaataaaatcaaattgagtcttcaactaaaagagacttctgaatcaaagaaggcagatggaaaatacgaaagaaagaaaagaatagaatttttaaaagaggcaaagtaattacaggtagtgcagaatgtggacaaatggcaagccctaatcattaaggtaggcataagatgagacacacatgggacataaaattgtgattcacaactttgggaataagaatttcaaatgcaattgataaatacattgaatgctttcacaatgaataggttttgctcaactggctttgtgagatatcaaatactatttaaagagctgattaagtggattgacgtttaagaacaaaaaactacaaaatcatatacaagattgcaattcaataacgggt

SEQ ID NO: 166996 - DNA, 200 bp, Homo sapiens
acctcagatgatccacccgccttggcctcccaaagtgctaagattacaggtgtgagctactgcacctggccccctctagtttctttcgggatttttttctttatctttgattttctgtagtttgaaaattatatgcctggttgcagttttctgtttttgttttttatatttatctgcttagtgttctctgagcttcctgg

SEQ ID NO: 166997 - DNA, 295 bp, Homo sapiens
agtgtacacagtatccacttcaaatcctgaggggacaatatttttactcaaatatatgcaacttatggggccaggtctatgttcaacactccagccgcgtttatctctgggtaagtttccctctctgtgtgccatgttcttggttggctgagtgagcagcaggttatactagaggcatcagacattcagggtttaagaattgagtttgaaacctgcccatgctgtatacaaccggtgtggctgtggggaaggcccaagacatctctggacctctgcacaggtcctgcaaaagagg

SEQ ID NO: 166998 - DNA, 339 bp, Homo sapiens
ttaagcaaataaactcatgaaagagaatacaaaaacaaacagagaagtgcactctacaagatagaaatagtgtttaataactgaccttgatggggaatcaaggtaggcttctttggtaagtgactcctgagctcacatgtgaaagacgagtgttagctaggctggtgtggaagcaagcagaggtggcacagacctccaggtagaagggactgcatgggaggaggggccttgtagtagaaaggagcatggcacagttaatgaagcaaagaaagagggtggatgcatctggaggtgggctggggtacgtcccagaaagcacagcaagccacattaaggaca

SEQ ID NO: 166999 - DNA, 204 bp, Homo sapiens
agcactcaggacccaacagcccgcatgagactcagcggcttcccagtgctgctgaggagcagggcggcatcaacggaatcccaaacccacgtgaaagctccccaagaatgggtgccaatttcaggcccatcgtcacgcgttggccccacctctactgctccccgttttcggaggatttactcaaggctacttggtgcctgtgga

SEQ ID NO: 167000 - DNA, 174 bp, Homo sapiens
ggttgagatatttgtcccccttggaggtagaaatgggcccaggttcaggttaaggtcagagagctcagcgggtgtcatgttttgcctcaggttctagacagagttgttctccttcattaaccatggattccctacagttaatctccactcatgaattctccattcatcaacaat

SEQ ID NO: 167001 - DNA, 362 bp, Homo sapiens
ctaggttcatagaaaaatggagaagaggccaggcactgtggctcacacctgtaatcccagcactttgagaggctgaggcgggcagatcacgaggtcaggagtttgagaccagcctgaccaatatgatgaaaccccaactctactaaaaatacaaaaaaattagccaggcgtggtggtgcatgcctgtaatcctagctacttgggaggctgaggcaggagaattgcttgaatctgggaggtggaggttgcagtgggctgagatcttaccactgtattccagcctgggtgacaaagaaaaaaaaagaaaggagaaaagagagaaagaaagaaagagagagaaagagagaaagaaagaaaagaga

SEQ ID NO: 167002 - DNA, 869 bp, Homo sapiens
cgacatgtgatgtctcccccggacacccagctttaaaatttctctcttgtactctttccctttatttctagaccggccaacacttagagaaatagaaaagaacctatgtgaaatatcgggggctggtttcccctgatagtgaaggagacaggttagatacactggagcttccacacaggagagagggaaggagctggagaagaaggtgagttggaagatttgggggttttgtttttaagtgagagagctttgaataggtttaatgctgatggtggggatccagttaagagaaacactgaaaattaactagagggaaaggtaactgacagtatagagttcctaagaacccaagcagtaaattctagcctagctgggggtggagtgtgaagaagtgaagaaccttttttattttttttttaatgggctgggtgtgaagctacatttgtagttttgtggcaggaagttcccttactgtaacttctatattttctgtgaagcagaagacaagaactctgttcaaagttagggagatgatagattgagggctagaagagtaaggcaggcttgaaacaatcattgtcacgaatgggagttgaccagagattagtaacgttgctgggccatgtgtaggggcccatttgaaaccagcgattacaaatgtgcagtggttccaggccgtgcggctgtgtgaatctacctgatgaccctcggctgcttgggtactgccatggatagcgcatgtgttggctttgtccagctttgggctttttcccacattgattttaaaaagacaggagccacagattttggagtactgcaaaatgactttccaaattgatgaaccatggactccaagctggatagacaca

SEQ ID NO: 167003 - DNA, 337 bp, Homo sapiens
taaacatggatgaatttttaggtatcgtgaagtaaattcagagaaaaaaatactgtattacttagttaacttaaagtccacaaaaagtcaacactaaaccatatattgtttaggattgccatttggaataatagaataagagatggctacatgtgattgggaagaagacatggtgtgttcctaaggtacatgtaatgttctatttcacaggctgagggaggtagcaacgatgtttattttatcatttttcttaaagtatgtgtatacagcaaacctttgaataatccaggagttataggtgccaatctcccatgcagttgaaaatttacgtgtaaca

SEQ ID NO: 167004 - DNA, 611 bp, Homo sapiens
ttttcctgtacacagatgggaacaagaggtacaggagtgagagtggtaccccttctagaatggtggcccactcattcattcactcactcattcattcataagctcaacagatacttactgcctgccttgcctagccatctgcagcccagggaggccaagtgagtaagctgatgtgggcctcatcagcctctctggagagtgacagctatgaccaaattgctgagagagctaagcaccagtaggggagggcgggactcatgcacgccgtggccctatgcttgtaccatcctgcgtgtgcacagcagcctgtcctgaagggtgtatgggagatggtaggccttggggttggggaagacctgggttcggctctgtcttactctgctttgtgctcacaggctgggtaatttacgactaacacaaatgtattggctcatagttcttggggctgggcagttggacagcaggggccgttgcacagcaggggccggtatctgtcaagggccttttgctgtgtcagtccatggcagaagaacaaagagaaggtgagagaagaagaggggctgggcttgtccttttattgggaagctgctcatgtcatacgctgtttcctg

SEQ ID NO: 167005 - DNA, 460 bp, Homo sapiens
tactctgtttgtaaaacaagtcttgtgtctacaaattgttcactggcatgtattaacgagatgataataaggcccctgatattcatatttgtatgaaagcattgaatatatttgcatttgtctatatctaataaatgtttatttttgcttgacactttatactagttacttaggtgagtgcttaaattgatttttcttttctggaaaattgaatcattttgaaaagcaaaatcttgcagttctggctgtaaaaaaattcttttgctctttttgatacatcagctgattctcattttgaaattttctatttgacttctctctgctgtctttgtgtgttctctctctccagcccccctctccccaaccctagttacacattctcttacacttggtattctctttttctcaggaatagtaaactattattcatatatttgtttcatgacagtctctcctcccc

SEQ ID NO: 167006 - DNA, 1275 bp, Homo sapiens
cagctacgtagaactgtgagtctattaaacctctttttctttataaattacccagtctcgggtatgtctttgttagcagtgtgaaaacggactgatacagccttggagctcgtggcataaccacgatgtatagacccacccatcactgggggatgtacagaaccccccatcgtggcacagccagggatggggggtgtacagacccccccatcgtggcacagccaggggtgaggggtgtacagacacccccattgtggcacagccaggggtggggtgtgtacagacccacccatcacgggatgccacagatgccgagacagagagaatgggttgtgggagagcttgcaactgcttcactctgggcccaagccctctctacacacttggctgtgaacccacctgacccacccagggccccggccctgccctgccaccctgcctgagccccgcgctcagctccatctctcccagtagacatgtcgctgccttttggctctgccagacctatcagcctacacatccctctttcatcttaaaaaaccttccaaacactaaagtagatccctagacccatgtgctcctctccctgcatggcaaagtggctctccagcttcttccccacatccttgctcaaacctaacaggatccgatggctcccttgcctgctccgtgaaacaaccaaaggtgccctgtgcgatggtcggagctctctgcacaggcctcctgctacacccatgtgctctcgggggatgaatgtaaacccagctgcaggccgggggtggggacatggcttccctaggaccccagccctgacacaggacctggccattgcctggaactggagagccgcaatggtgcagacctggtccctgccttcagagtaatttgcccaggagcaaggaggagctgggccttgtgagccacccgagtggccaccagtgtcacctctggctccgactgtcccttgagctctttctgatgtgacctgtcaggggcaccttgcaggctcccccacccactcaatataggactccctcgaggaaggctcccggagcccccaccctcaggggagaggctggtggagacctacaggggccaagcgtttccctccacaccccaccttcctcccagggcaggcgcctgtggagccaacacaccgaccaccccggccccactgttgagccctgggaggagtgctctacaaggcaggaagggtagacagcaggtgcttcataaaggccacggagattcaacctgcagctgacaagtagcacc

SEQ ID NO: 167007 - DNA, 200 bp, Homo sapiens
atattatattttaccatgttatcgaagctgagcttgaactcctggattcaagcgatctgcccctcagcctcccaaaatactgggattacaggggtgtgccaccacgcctagcctgaagcccagatttgtatcatttgcctgtttctgtggtataaatactcccaccaccatgacataacaagataaggtggtggagtata

SEQ ID NO: 167008 - DNA, 697 bp, Homo sapiens
tctatcccctatgaattaaaaatgacatctatacatttagaaaaatagatgttaaaaatatttagcatatccaccagcaatcaattaatgtttaggggcaatttaatgaattaatgttctgagaggtgatttaacactcccactagcaaaaggaaagtagtctacctgtttacaatgtaatgttaacatataggtaagaccaccaccaccatcttcacgtggatttaggtctggaggccctgcaacatatgctcatatgcacacagggctccaacaccccaccctcttatctcctaaatccacatctaatattgcctaatactaacaaagccatctaagagtctaaacactcctatcagtaaccaatgacatcattgtgtaacaatttaatgtcccccaaaatgcaaaatgtcagccatctctatgctggttaagattcagtaacacaatcctgtcggttatatacacaaagtaatacaaatcccacccaacccttaacatgtaagtgttctagaggctggcctttttggcaattccatcatgaaaagaaaatcttacaccacgtaaattttaacagaaagaccactgacaaaataacatccacatccatgactttcatacataaagcagcattaataaaacttcttagttagaagttgtatacattaagttcccccagaaaaacatccatagcaat

SEQ ID NO: 167009 - DNA, 670 bp, Homo sapiens
cctactttgcagaattgtcgtgacgattaaatgagagtgtgtgtgagtacctagcacatcgtaagagagagctcagtaagttatagtagctgttattgtttaaacttcaggaattagctaggttttgctagaactttcatctgtgcttgtaagatctttttgaatccatatgtatttttagcagctgtggctaagatagtttttttcccttgctgtgataatattccttatcttttatatttcaggctattgttagaattaaatgcgtttgcgagtgaggaatagatttaagagttatttcaattcagaccgtggaacatctcttcacaaaatgggttagtttggattggcagtatacttttaaatctgccttcgatcactcagaatttgtccagttctgtatttattaacatcagtttgtttatttattcagtaaatattgaatgcctgttctgtgtaggtcattgtcttggcagttattttgagctcttgctacctgctgaattatatcttaaaatgaagaaatttacatgatagagtgatatttattcatctgtgctgaagattaaagtgagaagtatgtggcaggcgcggtggctcacgcttgtaatcccagcactttgggaggccgaggtgggcggatcatgaggtcaggagatcgagaccatcc

SEQ ID NO: 167010 - DNA, 371 bp, Homo sapiens
aaaaaagctccccataacctcgagaaacgtttctggatctgagatatccattagcacatttagaaggtacctatttccattattgtgaaggagttgtaaatgaaataaacaactttaaataatacctcccttggtcaaactgcattaagtattccctgatggaattcattcatcatcattcaaacagaatggtttgcaactcaacctgcctagtgtggggtctggaattcccaccacagtcactgtgccttaagcactgttgcagcagaaggacttgaagtaacacatgaatatataatgccaatttgcatgtcagcatggattgttgaaattgaagttagttaattgtcacattgtaacaggaaaagaat

SEQ ID NO: 167011 - DNA, 466 bp, Homo sapiens
acatgtccttcaaagtccctgttggttgatattataaaagaatgtaatgggcatcttttggaaacaaagatccatcacattttgtgtggtgttctcagctggtggagaggtgtcaatatccctgcagagatttaaaatatacacgtttcttttacaacctaaagatcagagagccttcctcagaaccttcatgatttatgcggtgtgagaaatgggttggtattcgattattttctgttctaactcattcattcattcattcattcattcattcattcgcttattacatgccaaggcctattccatagtcaatattatgtagttaaagaagggtcatctggccgggcagggagccttatgcctgtaatcccagcactttgggaggccaaggagggtggatcatgaggtcaagagttcgagaacagcctggccaacatggtgaaaccctgtcgctactaaaaataga

SEQ ID NO: 167012 - DNA, 142 bp, Homo sapiens
catctcttcgtgatgccaagcctaatttcagcactaaattatacgctttgtagcagagaagcaggaagtattaagaagagcattgatggtggtggtggtgggggcttacatagatttgaagttgattccaacccagataacc

SEQ ID NO: 167013 - DNA, 271 bp, Homo sapiens
gaactggattgtttgtaactccttttttgcatcttaatcactgtactttaggaagattcctccaaatgttctggcatttcttttatgttaatggctgtgtcagagccagttgtttgtatcacaacttattcagctatttcaaattaatgggcattccctttgttttcatttcttaaacattgcaaattatgctgcagctaccatctttgtacatatgccataggaattggtccttttgtttctatggaataaatacttcagagtacaattt

SEQ ID NO: 167014 - DNA, 274 bp, Homo sapiens
ctgagggggtgggcggtgcaacgttagtgaggagaaccagtgtgttatgagacccaggcggttggttgctggctagtggagggctttctccctctaggttaagaggacaatggatgggggctccagcaagggttgaaacctagttcttaaacgggtataaccctggatccttgggtcgggtttcagaggatccttacactgaaatttttgggaacttgagtattcatttttagggggaaggaaccgtggcttacctggccttcaaaacactgag

SEQ ID NO: 167015 - DNA, 257 bp, Homo sapiens
gaacaacatctggcacaaagtaaggtgtaggtgaccagtaagtatttgttgagtagatggattcatttctgtaatttgctaccatgcccacctacctgttagcatctgcagtgacatactggccttcctgccagttcttatagataaactctccaagggcagaccttccacttgtattcgtcttccaaactccatcacctcttgcctgctaagacaagcagttctctcctctcctgcatcatcaagttttcccctct

SEQ ID NO: 167016 - DNA, 342 bp, Homo sapiens
tgagttggaggcagcatcgtaatgacaggatgccaccaagtgttaagttggtgttcattgttggggctggaggaagctggtctgcattccattcagagggatttggatcactccatggagatgagggtgtggcctggattattccaatggggcagggatggacagggaggctccatgaagagtagtgaaagggggtattgtgctatttgagggagatggaggaactgatgtgctaaagagatggaggtggagagtactggattttcccacctgcctgggagggtactgggacgaggggatccagatgagagggatggcctgtggtgacaggaatagagtggc

SEQ ID NO: 167017 - DNA, 611 bp, Homo sapiens
ccaccccagcatgatttcacactaaaatggctatttctcactcttcagatattaagtttcttaacatgtaagaaaagatgaaagaatccaaggcaataatggaaaatattctttttttttttagcagaaatatgttagagtacaaactttgccaggcactggtagctactgtgttttcacagccctagtcacatctaaccattttcctttaaaatgacagacttaaataaaaaaaattcctctgaggtgtcataatagaatcctatgaaaaagtagccagaatttaaaaacttttctgtttcagagagttctagcttcccatgaacagcctgagtctgaaagcatatcaaagcaatatgacttcaccatccatcttctggaattaatgaagtagcagtgacttttccttatgaaaggtctgtttggagggcaatgttggaaacacagtgcattcagctggcagaccttgaaggcaagatgtgcagaagaactgactgcacaggaatcagtcctgagcagagtgattaccccacagtgtttggctaagctgctgttatccaaggttctgctgaataaaactcatagaagaacaaatgaacaaagtctgtctt

SEQ ID NO: 167018 - DNA, 451 bp, Homo sapiens
atgggcatttacatcatttattcaccaagaactgtaattaggcattttctttctcttttattatattttaaaatttaatatagagacagggtctcacgctgtcccccaagctagagtgcaatggtgcaaccattattcactgcagcctgaactcctgggctcaagtgatcttcccacctcagcaccaccacgcctgtcttgtttctgttttacatgctcttggctagtttctgtttcccactggtgttagggttttaacttctgttgattcacaggatgcaggtgggggagagatggcaagggggaaaatatgaatttgattactcaagtggaacaaggtgaaaccattagtttaaaataattttaggctgaaaaattaaaatcattaaattatttccttcatgctgttattacactgtttttgtattaaagaagtaagcataaatatgag

SEQ ID NO: 167019 - DNA, 240 bp, Homo sapiens
taagacaacaaaaaacctgtgctttcttctactacattcaaatttgaaaggcacttctactcggacacaacagcacagtcagaaaaatgaaacagactcccaagattgctccttcaaagcagtaacatcaaagcatctagaaatggaattggagaatgccacagaaatacgagaagacattctatagcttctacttgggctttatagaaataaatgttgtaagtggataaaaagggattt

SEQ ID NO: 167020 - DNA, 202 bp, Homo sapiens
acaaaatggtgcctcaactagagataaattttctttttgagaagttagtttttgaaggagtgagttcatgccgtagtttcctgtttggtttctacagctttaacttgccctggaaaactcagaaggaaatggttcattcaaagtctacttactcttttctacttgaaaacatacccatgccctccaccccccaacccccggc

SEQ ID NO: 167021 - DNA, 393 bp, Homo sapiens
tgcatagatatggaggggtcaatcaaagataatcttaaaaaacaataaaaacaattacatgcaaaaattatttatggtaaagagtcagaacagatatggaggattggttattaagggagaagggacacgagggagccttcaagaatgctggaaactttccataacttaatcttagtagatacattggttaaaaaaaaaattcacttaagcactttattgtttgtacatcacaactgaaaaaaatacacacaaatggttgccagattatgatatagaaagtacttctgtaggccaggcacagtggctctcgcctgtaatcccactacttgggaggctgaggcaggagaattgcttgaacgtgggaggcagaggttgcagtaagctgagatccta

SEQ ID NO: 167022 - DNA, 468 bp, Homo sapiens
aatgaatagaaaatgcatgggaaaacaagatggacagagctttagggacctgtgggactatgaacaatgatctcacatctgtgtcataagggttccaggggagatgggaaaaagtgtggggctgaaaaatcaaagaagcaatggctgaaaatttcccaaatttgacaaaagacataactctgcagacttcagaagctgaacgaatcccaaagagaataaatccaaagaaattccacactaaaacacttgagttaaacttctgagaactattaaataaaaaaaaaaaaaaattaactgagcatggtagctcatatctgtagccctagctacctgggaggctgaggtgggaggattgcttgagcccaaaagttcaaggttacagtcagctatgattgcaatgctgctctgcagccagggcaatgaagggagaccctgtctttaaaataataataataatgataatcatta

SEQ ID NO: 167023 - DNA, 132 bp, Homo sapiens
atccatcatatatagggtgttttgattgtccaatttttacttgcttttgctctatcccccatcctttccaatgagagagctgtcatgcagcagatagtgaacaagccttggagtcggacgaccgtgttccag

SEQ ID NO: 167024 - DNA, 304 bp, Homo sapiens
ggcctgagtttgtgtttgtgcactgacagccttacagagtgtagggaggtgctttgtgatgatacctgagtcaagaaagttctgggaagcccttaagtgcttctgcagttcttggactaatgtcagtgttcttgaggaagcagtgcggtgttgagaggcagggtgttgcacttctcgggagagggaatgtgggtggtgctgggttaatcttgagggttctgtggcgttgttcaggacgctcttctctctcaaggagccaaggacctgccagcatcagatgggaacagcttggcagggatttgag

SEQ ID NO: 167025 - DNA, 482 bp, Homo sapiens
agcctccagacatagaagttgttacctaaaaagaataggagtccgctggcattggacttcttcacagcagcagtagttggtagaaggcagtggagtaatacattcaaagttcggagtttctaatccagaatttgataacagccaaatgatcactcaaatgtgagaacaaaaaaagacattttcagaaatttaaggacttgggaaggttaacttaaacgagttcttgaatatgtacctagcaaaatgaaatagaagttcaagaaagaggatgaaatgagaccccagaaacggaattcctaactaacacaccagtgaaaatctcaggataacaactatgccataggcctagaaagcagttggttcaaattagaacgaaatggcagagttgtctgtgaagaatgtcttcaagaagaaagtaaaagccgttatatgaattatgtggtggaattttttaatgttaagataaaagtcaacgagagaaa

SEQ ID NO: 167026 - DNA, 407 bp, Homo sapiens
cacccacccacaaagaccatgcgtgctatttgtgtgccctcttgtttcccaggccatcagttatttgcagttgcatcatccctgaaggacctgaggttgctgccccacaggcccaggagctgccacccaactgataaagatgtaccatgttttaaggggtatctttggaatttaaaatctaaaatgtgaactccaagtagaggatgcgacacacccgctttgccagccagggctccaaagcaccctgagtccacggctcctgcatcatttgtggagaggcacttccagaggccagagaggctaaagtgcaccccattcctgcctttcccctgcttgctctcccacctccctcccaggtgacacaggacagacgaaaagccagctgcttttggataataaatagcctt

SEQ ID NO: 167027 - DNA, 644 bp, Homo sapiens
tgtgtacatggaataaatgccatagcatgtgggagagggaaaggaacaatacttaattaatttaataccttaaagggccttctgctcaagaatggacttattgctaggaatcaatttgccagctgagactttgagtgtccacatacctgcctaattagaacatgaacccacaggaaacactagtttctcctcactgtggaggattaagttgtgtagctggtttgaatcttcttactgaccatacatgactgtggattgctgccctagatgattggttttcaagtattttaagaacatgataaaatatagatgatagtaaaattatgttgaactggatttggcctttctttgattcactggcttggcaggtctctgagagccttggtcattttcatgagcattagtggtcagagtccagcctgaagcagtacaaaatgcctaaaagtacactcaatttttcctgaccctttgacatactctggggaattagttttttaaatattaaatccctgatatcaacttgcacagtattcttgcttttcatataagcagaaggcagactatgaaatgatctatctctttgtgttgtttttggtggttttaattttgcgcaagtgagcacttaaagcatatttgggaaggta

SEQ ID NO: 167028 - DNA, 169 bp, Homo sapiens
acaaacagcagacatatgaaaagatgctcaacatccttgatcattagagaaatgcaaatcaaaactacaatgagatagtatctcaacccagttaaagtggcttatatccaaaagacaagcaatgaaaaatgttggtgagaaagggacacccttatacattgttggtgga

SEQ ID NO: 167029 - DNA, 195 bp, Homo sapiens
atggaccaataccaggcttttaaggtagctgagcaaagggttggtggaccctaggggactgtgtctgcctttctccttgtgttccccaagaggccagtgtggcatggacctctgtgagatgatatgtggttgcagtttttaggtgcgaaagggacttaacttgctcatggtctcagctagtaaatggcacaagag

SEQ ID NO: 167030 - DNA, 408 bp, Homo sapiens
actggaactctacaagttgtgcagtcaggatgctgagcaaaagaagccagatgggaagagcacacactgtgtgcttccctttatagaaagttcaaaaccagcaaaagtcatctatggggttagaattcaggacagccattaaccttgggggtggtggtggggaggatttaccaggagagacatcaagggggcttctggaatgtcctgtgtgccgagggactgctgggacagtggtgggaggtagcaggagagcggctctcagacatacccctccgttgggaaccacaggggcagcaggccagggagtagggtagggatagggcaccccttctgtaacactgcagtgtacatggaggaaaggggcagcccagaggtaaggccaggcaagtgacaatcagcacaataatc

SEQ ID NO: 167031 - DNA, 236 bp, Homo sapiens
actggaactctacaagttgtgcagtcaggatgctgagcaaaagaagccagatgggaagagcacacactgtgtgcttccctttatagaaagttcaaaaccagcaaaagtcatctatggggttagaattcaggacagccattaaccttgggggtggtggtggggaggatttaccaggagagacatcaagggggcttctggaatgtcctgtgtacatctgggtgctcattccacgaatg

SEQ ID NO: 167032 - DNA, 227 bp, Homo sapiens
cagtcagcacacaaattcagctaattctctccagtgtgaattgggcatccttctctccttttgtcggctcattctgatcagaaaaggtcttagaaacaaaatatttctctatccttatggttgctgtatctggaaagcccaagagttatagaaaggctggagaaaagctaccaaaatgaccataaggtggggtgaagagcaattctcctaagatacagcaagaagga

SEQ ID NO: 167033 - DNA, 146 bp, Homo sapiens
atacaggttggtgggggctcagttgcagtcatagggatgggctgtgggaggtttcaccctctagcagttgaacctcttgtactgtgtgtcctcttcatttaccatcacaggagaagaaagacagacaagcaaaagcctgtatgcct

SEQ ID NO: 167034 - DNA, 343 bp, Homo sapiens
gcagctgattaggttgtgcccaccagattaagggtgggtctgcctttcccagcccacagactcaaatattaatctcctttggcaacatcctcacagacacacccaggggatcaatactttgtatccttcaatccaatcaagttgacattcagtatcaactgtcacataaatataccagagtccctgactatctaagcaaactgttagccactgtccatgaatcaatgttgacctactcctctgccatgtctctttttagtctaagtggactgctagatatacagtctgaagttctgcctacttggagaatctcccttctcagtttttaaagactatttctgag

SEQ ID NO: 167035 - DNA, 199 bp, Homo sapiens
atcgagctggtccgcagttaaagaaagagagagagacagagagagagagagacagacagacagacaggcaggcagagaaacagagtaagacagaagataggcacagagagagagagacagagagacgcagaaaaagaaagagagggcgctttatttttttagtgcgtctgctggactgcggcgcactgtccgctgcgcg

SEQ ID NO: 167036 - DNA, 238 bp, Homo sapiens
atcaggtaattaaataaaagaaacatctagaggattctgggtacaaatagagtcattttggagaaacttccaggtgaactctttggtggcagctgtctgtcataagtcaccctcggcagtggagttcactgttattcttggaatcaggaatcgagtagatcacagggagtttggccccagggtacttgggttgtcttctccaagcatgggatttttggaatgaagtttagaggctgtc

SEQ ID NO: 167037 - DNA, 130 bp, Homo sapiens
tcctttacatggcattccgtgttcatcatgatctttgttcctgcctcaatcctcaaatgccagatcttttatcctcttatcctctgtcctctacaccccagctcagatgcttgacgacggcatgctattt

SEQ ID NO: 167038 - DNA, 378 bp, Homo sapiens
cattatgtgatccgccgcttagctcccaaagtgctgggatacaggcatgagccaccacgcccggggtcttttttttttcttaaatagaaatggggtttcatcaccttggccaggctggtctcaaactcctgacctcgtgatccacccgccttggcctcccaaagtgccaggattacaggcgtcagccaccgtgcccagcctcaactccaaattttaaaaagggcttaaacgaagaggatgaaattctggaaggctaaatgaaaagagaatgtgtctgttgaattcgataagcaattccttgcatttgagaaggcaaggagccgacgggaacctaccgacagggctgccacgcactgctgcagagctttccgtgcaaag

SEQ ID NO: 167039 - DNA, 553 bp, Homo sapiens
tttgcaataaaaacaagtttggtcccctggctctccctcacccttgccctctcttgctctctttctctcttgccttccaccaagggactatacaaaacaaaggctctccccagatgccagtgccatgcttttggacttctagccccagaaccatgagccaaataaatttctgttcattataaattactcagcctatggtattctgttttaacagtataaaacaaactaagacatgcatgttttaaagcataactagattccccttcttaaaaaatgggtatttggggacaggcatggtggctcacgcctgtaatcccagcactttgcgaggccgaggcaggtggatcacctgaggtcgggagttcgagaccagcctgaccaacatggagaaaccctgtctctactaaatatgcgtggtggtgcatgcctgtaatcccagctactcaggaggctgaggcaggagaatcacttgaacccgggaggcaaagtttgcagtgagccaagatcacgtcattgcactccagcctaggcaacaagagcgaatctccatctc

SEQ ID NO: 167040 - DNA, 652 bp, Homo sapiens
gtatgtcagagctggcaagatacgtcagaagagaaaggagaaactcttaactaaatagagttggaaataaaataattgtctgtatggaataagatcaaaggtcccacatgttaaagtcaaccccagatgaattaaagtcttacatgtcaaaaaaaattgaaacttttagaagaaaattaaggtggatatattttagaccttaaggtagagaaagatttcttaaagaagacacttacaggattgattacaaacaaaaagactggtacatttgaatgtattatgttaagaacttttccaccaaaagaaagcctcgatttcctcatttttaagatgaggataataatccctaccttatagaattctaataagatgaaatgaagcaacatatacaaaatacttagcacagatcctaacacctacaaaataataaatggtaacgattattattcttctcaaacaacaatcctattatttatcaaataatactgagtaatatgacaagacatatttaaaccacacaagccatatgcagacaagtgtttaatatcatagtgatagtttcaagagagagataataatttattctacatttatcagaggtctatagcccagtagtcaataaatacttatctatagtcaataagtactatca

SEQ ID NO: 167041 - DNA, 397 bp, Homo sapiens
gcctggccagagcatcaggcagagcaggtggaggcttgttcctccaccccaacacgaggagtccctcagcccctgccctcaagtttgagaaccacatacttcccagaaagtggaggctagcatggtgagggcaccctgcagagccatctgccatcccctgcacccacagaccaccctgccttgtagccccaggctgtgggatactcaggaaggggtgaatggtggagtcaacagactgaggggaaatcaaagcttttagagacatttgcaggatgaacagatgttcaaacgttcctttatttggtctccagacagacgcagaggcctcccttttatcccagtaatcggtgcattatgctttaatttgcaaatggcattaaaaatattaacaggggca

SEQ ID NO: 167042 - DNA, 532 bp, Homo sapiens
tgaagagtttggtcactattaaaaaaactattaaaaaaaggatgactttgcaatctaagaaggacatgagatcaggacacaagagtaaaatggtatattttagatgatggtccctgctaaatctcaaggtgaaatgtgattcacagcatttgcggtggggccgactgggaggttttgagacatggggaaagatccttcaggaatggcttggtatccaccccatggtaattagtgaattatttctgtattatctactgtgagatctgattttcaaaataatctagcaaccatcctcccctttcatgtcctccctctcaccatgtaacacagcctgtttcccctttgccttccaccatgactgtaagctttctgaggccctcacatgatgcagatgctgatgccatgcttctcacttagcctgcagaactatcagccaaataagccaaatagactagtacactgtccaaagcaatatacagattcaatgcaatttctattaagtaaccaatataattgattacatattttaaaa

SEQ ID NO: 167043 - DNA, 473 bp, Homo sapiens
cctcaggcttcccatctgtgaaatggggcaaacagttttactccataaatgagggtgatgtgggttaccatgcttagaacaatgcctggccataattggcacaaggtaaatgtcagccatgtaaaatgactattcttcagtgtcaaatgggacagtcactctcctacaactacacctcacttgagttccaatggccacccttcgtcttgaccttaaggcctaggggaggtcggactttcagctgttgtgagcccggtgcttccctttccgttgttggctttgcttaaccctgtactcttctctgtaatcaggccctccatttactcagtccttgctactctgtgtgtaccatctctttgctacgaccctaactctggtgcctgcacacacatcacatagacacatagcacagacacgcacaacacacagacacacacaacacacacacgtacacaacacatgcacacagttca

SEQ ID NO: 167044 - DNA, 288 bp, Homo sapiens
cagcaacacgcactcttccaccttcaatgttagggctggcattgccctcaacaaccactttgtcaagatcatttcttggtatagcgatgaatttggctacagcaacaaggtcgtggacctcatggcccacatggcctccaaaaggaagaccaccagaccaccagccccagagagagcatgagaggaagagagaggtcgtcactgctggggagtccctgccacactcagtcccccactacactgagaatctcccctcctcactttccatgtagaactcctgaagaggga

SEQ ID NO: 167045 - DNA, 317 bp, Homo sapiens
taggaagctgatgattttaggtaggggtggggcggtcagggaaaaaagtcaactactggctgggctcagtggctcatacctgtaatcccagcactttgggagaccaagctgggaggatcacttgaacccaggagttcgagaccagcctgggcaacatggcaagaccccgtctctacaaaaattagccaggcatggtggcatgtacctatagtcccagctactcaggaggctaaggtgggaggattgcttgagcccaggagattgaggctgcaatgaactgtaatcgcaccatggcactccagcctgggtgatagagt

SEQ ID NO: 167046 - DNA, 440 bp, Homo sapiens
gcaacaacataaaaaccctagtttcttgggccctaccgccgaccacttgaatgagaatttcctggggatggtcctgggaatgtgtatttttaacaagtgcccatgagagtcttaaattaggtaagtttgggaaatgagatatcagtagaaacaggatactgtggggtcagaggaggaagttgctcagtctgtctgtaggtgggaagattagccaaagcctcacagcaatgtttaggccacaccttaatgagtgagtaagcacccaaggagaaaggactttccaagcaaggagaattttaaaaattagccaggtatggtcggtgcacacctgtagtcacagctacttggaaggctgaggtgggaagatcacttgagttcagtgagccatgaacatgccactgcactgcagcctgtgtgacagagtaagcaagaccctgtct

SEQ ID NO: 167047 - DNA, 144 bp, Homo sapiens
ctgacaacttgggaggctgaggtgggaggattgtttgggtccagagttcaatgctgcagtgagctgtgatcctgccactgcacttaagtagtctagatgatagaggaaaaaacaaaccccacaatgatatagtacttcatactc

SEQ ID NO: 167048 - DNA, 866 bp, Homo sapiens
tccaaaggagtggtctagagttgatatagaaaaagacttctttagtaagaaatgttcagcaaagagctcattttaggtgtatgactcaccttctgtacccagttctccctcttttttttttaaggctagtggttattccccagacagagagaatcctgcctcacctttgatcatttccttgaacaacatctcaactttgcactaatccttttatctccatcttttaactctattaaatagagttaaaaaggtgtgagctacctttttttctaaccacagggcacttctatatactcctctaaccaacgggcacttatgccagtatttacacctactaatcttactgattagaatctactttttttttttttttttttgggagacatggtctcactttgtcacccagactggagtgtagtggtatgatcatggttcactgcagcctcagcctcctgggctcaagtgattcttgtgcctcagccccccaggtaactgggtctacaggtgcatatcatcacacctggctagtttttgtattttttgcagagatggggttttgccacattgcccaggctggtcttgaactcctgagctcaagcaatctgcctgccttggcctcccaaagtgctgggattgcaggtatgagccactgcgcccaacctagaatctactttcacgtttctgacgtgcagttccagtaaatgaatggaacttttatcttgatttgagagctcttggatatggatgtacctgtttttattaatacatcttggatctgatcaactgtagtactggaggcatatgaaatagcatccaaaatttgagaaattaaggcatagactgatctataggatatttggattcta

SEQ ID NO: 167049 - DNA, 408 bp, Homo sapiens
ccattggaaagaaaaggaaagaagaaagaaagaaaggaagaaaggaaggaaggaaagaaagaaagaacgaaagaaagaaagaaagaaaaagaaagaaaagaaagaaaaagaaagaaagagaaagaaggaaggaaggaaggaaagaaagagagagaaaggaagaaaggaacgaaggaaggaaggcaggattgcaggcaggctgaggcaggagaatggtgcaaacccgggaggcagagcttgcagtgagccgagatcgcgccactgcactccagcctgggcgacagagcgagactccgtctcaaaaaaaagagaaagaaagagagagagaaaggaaggaaggaaaagaaaggaaagaaagaaagaaaggaacggtcgacccggccgcgaatttagtagtagtagtcgacc

SEQ ID NO: 167050 - DNA, 428 bp, Homo sapiens
ctctctcttccatccttggtatttcaaagaaacacttgcagctccttcaaagccacatagcctcacttcccctcttctccctggtaaactcagcaaaaaagggacatccacagcaaaaggaactcaagaaacagtaataatcctggggacctggactcactgagacagcccagagaccgtagtgatcagggtgcggcccttttcagtgccattgagaacaagggagggagaagtcaccttctcttgccacatctttgtcattgcactccttccccaacctggggctgcagagaaggtctgcccacctggcttctgagtcatccaagtctaggaggttgctctttgcctatgtcccctggtccccaggtaggtgccagttaggagtgaggtgtgggcagtggccgccctggtgggttcccctctctctg

SEQ ID NO: 167051 - DNA, 1098 bp, Homo sapiens
ctatttagattttcaatacatatggtccaccttttctaggcatagtgtattttgcgagatggtcttaaaatgcatcagcataaagcaaaatccaggctgtgtctccaatagtacatataattagttgcattgttcttagctattagaagaaacttttaaatgtgtgcgtaaagactggaagaacagaagtgtcagtattaatttactaaatgagtagagtgaggacatcacaatggtgaaattcagggacaacctgtaggaaacaatagtgctttgtgtgtgtgcagggagcagtgcagaatggccagaggagcaagtgcagtagcaggacaaagcttccccagggagacgcaccctgagctgagttcgagagttgaccaagagaagggacagcattgggagaaagttacctgaatgtcacagaagtaaacagaaagagagagagcacatacgatgttttgggcaatgcaggggagacacccattcatcctctccttcagtgaatacatactgaactcttacactgtgcctggtattgctgtaagcctcggggatatggcagggaaccaaacaaaaagatctgctctcatggagctttcgttctaatggagagagacaagacatttgacaaattaaagaaacagaatgtatagcacaccagacagcactaagtatctagcaccttctgtagagagaaagaaacccagatgggtagtcaagaatactggagaaggaggtatgatcttaagtaggataattaggaaggtctcactgagaaggtgctgagccaattcccagggcctcagggagggaaatatgaacaatatatcatctgcctcaatgatatataactttctaggaggatattgacattgtaatccaataaattctataattttaaaatctaagatgtgctaattatttaataaatatttttcaacaagtgtgtggaaagtaccattcaaagtatgaaaacattaggaaactaaaggacaaaagttcttgtcctcataagtcttatattttggaggaggacagacaaaataaaaaaaaacatggttatacataattatctagtgtgttcaaaggtggtaagtg

SEQ ID NO: 167052 - DNA, 483 bp, Homo sapiens
ggcgtgagccactgtgcccggcctgccttggttattttcataagatttctagaattaggttcactgagttaagtgatataaacatttttgaggcttttgctacatatttttagattgctctacaggagtggtctagtttatacacccctaccaggtcgccatgtatgtttctacacaatagccctgctcgcaacagatagtatattttgctctgttgcccaggctggagtgcagtggcgcaatctttcttggctcactgcagcttgaaatctcaggctcacaagtgatccttccgcctcagcctcccaagtaactgggactacaggcatgcaccaccatgcctggctaatttttttttttttttgtagagatgggtttttgagaccagcctgggcaacatggcaaaactccgtctttactaataataccaaaattagctgggatagtggtatgtgcctgtaaatcccagctacttgggaggct

SEQ ID NO: 167053 - DNA, 1094 bp, Homo sapiens
ggcgtgagccactgtgcccggcctgccttggttattttcataagatttctagaattaggttcactgagttaagtgatataaacatttttgaggcttttgctacatatttttagattgctctacaggagtggtctagtttatacacccctaccaggtcgccatgtatgtttctacacaatagccctgctcgcaacagatagtatattttgctctgttgcccaggctggagtgcagtggcgcaatctttcttggctcactgcagcttgaaatctcaggctcacaagtgatccttccgcctcagcctcccaagtaactgggactacaggcatgcaccaccatgcctggctaatttttttttttttttgtagagatgggtttttgccatattgccaaggttggtctcaaactccagggctcaagtgatccacccaccttggtctcccaaagtgctgagactataggcgtgagccactgtgacccactgtatgtttctcaaaaatacaaaatgtcgtaaaagtgaaagtctatatattcctatcatttagtaaatagtaaaatactggctttttttttttttttgtctgccataaggatctgaattatgactaatgtctgcactgaagggaaggtacctggcgtggcatctgggtgcctcccttgtaggtgtatcagagcatgattcaggagcagcaggttgcccttgtattctgggcaggaacacggcgtctgtccaggcagatggccatgctcagaggcctcacggtggggaccgctgtgctgtcgtcacaccctgtggcagcagattgttgcccaggagggtgctgcttcagttgctggtttctgcccttcctctttcctgtcgagcaggctttctgcttctgaacaggctggattcagaaaggccgaatgaatctgtccttgaattcatagtgacactgtcagttggtggtgggcagagatgcaagttgagcccaagcaccagactctcaggggtgcatttaagcagcaagcatataggctgaaaacagcttccaggtattttgttcgatcgctgttaaaaatctagaaagtgtacataaaaatgggctcttcta

SEQ ID NO: 167054 - DNA, 315 bp, Homo sapiens
ccttccctgccagggctccctgggaaggccagagccaggacaggtatccgaagctaagctgggagcgctctcccctgcctcccattcctgcttggcttgggggactggggagtcccggagtggagtctgagatgctgcattcaaagcctggggaccgtgcaaggcagcctccacaagcactgaggaggccacagggactgtccagctcccccaagccacattccctccagcctggctagagccacgcacctcctgtgctatgatttccttcatatgttttcctttcaatcaatggacttttaaaaaacttagcct

SEQ ID NO: 167055 - DNA, 427 bp, Homo sapiens
ctgaactttcttttataacaagctcactggtgataacctcctcctgagatactgacagtaatcttttcctaatcacctcttattaggccctacctcccaacactgttgcgttggggattaaattacaacatgggagatttggagggggacacagtcaaaccatagcaatgtctgtttaatttttgtaattatggcacagatatccatttgaaatatgtgtaatatggaatactataacttccatatcttatgtgtctatgtaagccaaatggaagtattatatgaattaacataatatgatgtcattatctagttatgttaacaacacctttaaaaatttaaccttggaagcgaggtgaagaccagaatagttactcagtgtatgtttattctgcacttgactagcattgtactctgctagttacca

SEQ ID NO: 167056 - DNA, 291 bp, Homo sapiens
gtgggttgaccgtggcttgtgggttgaccgtggcttgtgggttgaccgtggcttgtgggttgaccgtgggttgtgggttgaccgtggcttgtgggttgagcgtggcttgtgggttgaccgtgctttcctgagtgatatttggcagctctgggccagcattctatcagcccagcattggattccagttacctcacgcttatcagcagctgattcatctgtgctttcattcatgcccctgtccaatcatccttccatccgttcattcattcagtaagcatttgccacggtcca

SEQ ID NO: 167057 - DNA, 377 bp, Homo sapiens
caagacaagctagcttagataagaagacaggggaggagagaaactcagagggttagagtcctcctggggcgatgttttggggtgggaatgggctgcctgagagtcactcatagtgaccgggcctggccttcccagcagatgccacatgccctggagttaaggggcaaatgttaagtagagcgatgcctggttctggtctagagatttctgaaggcaggaagttgttggaactgtccacgatgtaatgtacctgggaagaggcagaaccaccctgcccctccctcccaggtcttcacagcccagaaggcagtggaaggaaagttcagcacttcccggtgggagggcagagaccagaaccctcaactgcccagttacct

SEQ ID NO: 167058 - DNA, 414 bp, Homo sapiens
gagaacattctgatttaccataagaactgtttttattaaaaaaggcataggaaaaattggatctcatctaaatgtttaaatgcccccaaaaacctcaataaatatggattgtaaaaatctactctcaggacaatatacatgtaggattactaattttgaacaattactatactagttcattctttagaggtacagtttttccaacctgagaaactaaacatttcagtgatttttactctcctgataatattgagtaaagaaagccattctttttcttgttatttatgtccaatggtgggggagcacaacgttttcatttgttttgttttgtttttgagacagagccttgctctgtcaccaggttggagtgcagtggcacaatctcggctcactgcaacctccacctcctgagtt

SEQ ID NO: 167059 - DNA, 221 bp, Homo sapiens
tcttctgtacaaccccatattcaacactactgctaatctagataattttgaagcaaatctcagatgtcatataatcaagtctttaaataatgcagaaagtaactagaagggacttagagccagaaaataggaatgacagaaaaaagtcataatagtttataagaggaaaagggcagttgaatgtctcctcatatctgcagtgctgggattacagacatgag

SEQ ID NO: 167060 - DNA, 403 bp, Homo sapiens
taataaaagaaaagaaataactagaatcaggctggaactgtacaaaattgagacccaaaaatccatacaaaggatcaatgaaagaaaatgttggttctttgagaggataaaacaacattcatagactgctgctagattaacaaagaaaaaaacagagaagatccaaataggcacaatcagaaatgacaaagatggcattataactaatcccacaaagatacaaaagatcctcggagacttttatgaacacctgtatgtataaaaactagaaaatttagaagaaatggataaattcctgcaaactccaaacctcctaaggatgaactgaaagaaattgaaatcctgaacagatcaataataacttctgaaattgaatcagtaataaaaaacctatcaaccaaaa

SEQ ID NO: 167061 - DNA, 317 bp, Homo sapiens
ggtcgactactactactaaattcgcggccgcgtcgacgtgtgttccaggtcagggaggccacggggtggctagaagcagagagcgagtgaagaggttggtgctggtagggccacttggggcctttgtcatgaggggtggggagaatcctttacagcagtgtaagcagggcagtgacataattcacatctgcttgtgtcggaaatgctttaggcactgtggagatacaggggtggcggtagagaggctacctggaaggccactgcagttgtctaggcaagaggtggtgggggcagggactgctgcagggttagatctg

SEQ ID NO: 167062 - DNA, 307 bp, Homo sapiens
ttcctgtttcccagcattctaaagtttcagacttatgcaatgacatcagtcctcatgttttgtaaggtgctaagcagttttgcaggccacacatctcaatggacagcaacacattttaaacaaggactctaccttccaccacatcaattatatccattccccacatctcatttaccatcagatattcaacaatattattgtaagtaggttgggaactgaactgcttgggaacaggcagaggtcatgcctcatttatttctatatttcttgtactcagtagagaacgaagtttgcagatcattttcaa

SEQ ID NO: 167063 - DNA, 340 bp, Homo sapiens
tcccgggcacgggtcaggctaaccgcgggaggaatttaatctagagtctaacttgcgtggctgtccccactgagtcccgggcacgggtcaggctaaccgcgggaggaatttaatctagagtctaacttgcgtggctgactccactgagtcccgggcacgggtcaggctaaccgcgggaggaatttaatctagagtctaacttgtgtggctgtccccactgagtcccgggcacgggtcaggctaaccgcgggaggaatttaatctagagtctaacttgtgtggctgactccactgagtcccgggcacgggtcaggctaaccgcgggaggaatttaatctag

SEQ ID NO: 167064 - DNA, 445 bp, Homo sapiens
attagcaaagcatttttgaaataaaaaaaaacccatagatgtgccaaatgtaatagtagagcaacaataataaatatttgtaataaaaatcagaacttgttaggcattatgtggtttctggtcaaatatggttgtactaatttttctaatgctattttctgtacaaatataagaattttttaaattaagctatggtaggtatatgaacacatcttgatattactggaggtaggatttaccactcactttttgtgaccccaagtgtaaccctgaacagacttctgtcttaacaccaataacacatgattgcactgtcttctccagtgactggggaaagggacagtgctttgttcatttttgctttaccagcattcagcacatcgcctaaaaacaattgtgggaattcataaaatgtttgtaaataaatgagcaattgagtggacta

SEQ ID NO: 167065 - DNA, 111 bp, Homo sapiens
aaatggagaagcccttccttctggctgcctgaattggagctcttttcacacagccctatcaataacccggctgatggtagcaaccatcattcactgagcatttagtaccca

SEQ ID NO: 167066 - DNA, 192 bp, Homo sapiens
tatggctcactgcagcctcaacctcccaggctcaatcagttctcccacctcagtatcccaagtagctgagaccacaggcacacaccaccacgtttggctaattgctgtagagatggggttccatcatatgggccagacgggtctccaactcctgggatcaagcgatctacctgccttggcctcccaaagtgc

SEQ ID NO: 167067 - DNA, 299 bp, Homo sapiens
gttacacgatttcatgtctccatctactaattttgccttctgtgtcaattctgggtagcttttgattgacttttttttctcctatgtaatcatattttcttatttacatgcccaggaatttttttcaatatactttttatttttgaaaaattttaggtttacagcaaagttgtaggtcgggtgtggtggctcacgcctgtaatcccagcactgtaggaagccaaggtgggaagattgcttgagcccaggagtttgagaccagactgggcaacgtaaggagacctcatctctactaaaag

SEQ ID NO: 167068 - DNA, 338 bp, Homo sapiens
gagtaagtatagacatagatgagtgaatggaataatgtccagaacagtcatttgatttttgacaaaagtggcaggtaattaaataggtgaagtatagttttttcaacaaatggtgctagaacaactgcggtatcttttggtggaaaaataaatctttactaacatcatacataaaattaactctaaatggataataggcttagcataaacactaaaactatgaaactttaaaaagaaaacgtaaggttatatccttaaacttgggatagaaaaagatttcttagataaacacccaaaccacaaaatcttcatcaaaattggaaatcttttgggaaaat

SEQ ID NO: 167069 - DNA, 139 bp, Homo sapiens
gtctcaagccggttctctaataaattcctcaggaagtgcttataggatccgagttcttacatgttgtggacagttttcttgtgtcctttgctagacattagaaggctgtattttctggaaataaaatccatgtctcgtg

SEQ ID NO: 167070 - DNA, 186 bp, Homo sapiens
gagctcagtattctggtgacccgaaataacccccattgctcagtagagcctggatgccgtgcatggggccagaggggcctgtgctcatgcttgcagggaagcactgtgcagctggcgggtagtgggcagtgtattttcccagctaggatgcactttctccatgtgttgtcctgggagtggcccatg

SEQ ID NO: 167071 - DNA, 544 bp, Homo sapiens
ttagggtaagagcattcagtcatttacaatcattgttcatgactgctctttatcaggatgagggattcctattctttctctaatttcctgagagttttcacaagagctgatattagatcttgtaacatgctttttcttcttttttgagattgtcatgtgttttgtttttataataatttgttaatatgtggaattaatgattgctttttgactattataccaactcttctccacttgatcacaatgtattatcctttatattattgttgagtttaatttgctagcctttagaatatttacatctatgttcatggcggatattggtctgtagttttcttttcttgtaatatgacttcttgcttttagcaccagaatatggctagaagtatttcctcctcttcaaatttcccgaagaatttaattagaattggtattatttttctttcaataactgattgaatttgcttgtaaaactgtcaaatactgggtgttgtattgagcatgttaaactacaaattaaattagtagatattaaatattcaga

SEQ ID NO: 167072 - DNA, 372 bp, Homo sapiens
aattaagccaatgggacaattaaacaatgctagatgagaaaggaaaagtgttgaaaggttactatagggctcaattgtgcagtttccacataatcccaataatgtgaattgaatattgagctagacaaaattatggcataactatattggaaatatgtgtgtgcatagaaaagagctaaaccctcattttccatggcggggagtcagtgggtaacgctgaaacaaaattcaccaagcagcgtatcatctagagacaagagggtaaattgaaaataaaaaaaaagctaaaagaggtgcctgcaagcactgtgaggggagtgtctgcttttcttatccttttaaaaaaattgtagaattgtttgattcttaaat

SEQ ID NO: 167073 - DNA, 4394 bp, Homo sapiens
  misc_feature (108)..(108): n is a, c, g, or t
  misc_feature (295)..(295): n is a, c, g, or t
  misc_feature (1670)..(1670): n is a, c, g, or t
gagcaggaaaatatataccctaaacagaaactcttacttgttttatgagcaagtctgagtgagtcctaaaatggctggcgaagagctaccaatactgactgacaggtnaccttaaagcctctaggtgtgccaagtttgatttatcttagggactagaacctagtcttctaaatgtgattttgccttgctgtttcgtcctgatgtgaaggtaaccacacagagagattgggctgcatcagtaatgatatgcatacctttcgtgcatcagtgagcttcttccctgttaactgtatgnccacaaaatttagctggagtaaataaatatgcgacagaaatcctggaacaagatggtgaaattgcttaagaatcgagacttcagggctcaatgacctctgagcatgtttcccaaagtgtgacccacatgaccatctgtctctcagtctcctggtccctccgtagagcttctgaaactgaatctttgtggggtgggggtagcgttcaagaatcaaaagttgaaccaagctctttgggtgatacttatgtatactgaggttcaggaactgctggagagatgactgggcaccaagaggatgacagtgactcagctggcatcccttagctggttcatggcagagctgagtgggcactcctgtctctgaccccagcttcagtgctctttatctcctccatgcctcctcagtcgtgctgctctaagactgcttactggctttccttcatgtcctgggcacagagcagttcttttggtagcagatttgagtccacttcccccgtgcacagatcactgctcaggacccagagaggagcagctctgctccagcagggttttccattgcatcacacacccaaacggtaggatccaacagtcacacttgaaagcaaccataattgtgaggtttctgatgctgtagacttccttacatttctcacaacctagttagagagtcacatgggggtgaagtgtggctcgcgacctgccccaacaagtgcgtgcagaagccaggaaacaaaggagtaaattcacttcaaatgggatgcacatggtgtccgtgatgaagagacacattcagaattgcccaaggacaggaaaatgaccagagagagccagagctgagctggtaataaagagactccgagactgagtggagttaatgagggaagcatgcaacgagtggggcaatttcagttggtttctctcattgctttaagcgaaatgaactatacggacaggagaacagcctgcttgccccagtctctccttggccgccctctgttgtccctgtcaactcaggtgcccacggtgctcagaggaggtgctggcaaagcccctggagccttatgtaggccatgggggctcctaaaaggaacctgaatgaatcatttacagcaggtctctcttgtaaagcccagccacagtaactcgtacactgactgtttcaaaagacagcctttcttaatcatttaattgtttcatattcaaatatatctcctaattgtttttattttttcctgatctagaagatatgacaacagggtagaacttgggaagagggaataggaagctcgcccttcctccttccctcctcccctctctactttccttccttccttggtcatcaggtaccttctttgtgcctgctgttgtaggctanaccctatgtttggtggaaggcaaaaagaaaaatcagtaggatacaactcagtagggaagacagagatattcaagccccttgtcctcccagtgtgataagtgtggtggttgaggtgtgaacaaggggctctgtgaacagagaggacgaaagaggagctcctcctgaggctgttgggaaaagcatcactgaagagtgactttcagaagaagagaagaaaaagaggagaacatgcgtgattttataatgaaatagattagataaggggaaaaaaggcatttaaacaaggcaaaaagaacaggagaatagagaagagatgtggaggagaaggagcactgtagtaaacacgcagaaggacaggaacacttagacatgcaacccactcccaccctccgtcttgggggaggaaagcacactactgtcccaaagaactaatactgaaccagtgctgccttgtggagagaggcatggccaaggcgttcagagacctgggcctggtcccaccgctgcccacagcactcagcctctgagcacagcctggggtcatctgtgtgccctctggccaaggctgatggtagttctctgagtaattgagagtcattgcctgtctgtgcagtattgtgaaaacaagtcaccttttaactttaaaactactttaaaaaactttaaagttttaaaaaaacttctttaaaaactactcatgagatgacagtttctctgaccctcagaggaaggctgggctgcgcatacgtgaggaatttttacatgaacatcccaggacttgctgttcgcaggtgataaactgcacctccccaggactcccgctgcactcacatgcagctccctggacttctggtatctgacccggcccatttctgtgtttcaggggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaatttttcaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgacccaatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggtggtttttcatagctagataagatcttttccaaagtttttcttagaaccaaccaaaaaacaatccgagtaggcccaagaatttgataatgctggatgccttgcagacatcattcagtttctaatattgggcaacaattattattaaatgaattatttctgtagttggaatctgtaccttctgaacctctacaccaataactgctgcaggtgtgattttggtctgtcacactgtacatctatcataatgtgccctgtatctattggcagtgaccttggaaaatctggccaagcctaggggtttccttttccatttgccaagttccattgtgccaggactgccgtgctccactgagctcctctgtcacaccccattcttgcccctcactgggcaggccatggcctacagcttgcagggagtaaagcaggcccgcctccctttcttcccatccacatactcctcttctgctttccagtgactccaccagtttgatgtgggaagtgttagcttcctttccttcttccatcccttcttccatctttccagctgtcaaatccaatccagtctctaacctaaatgcagatcatttatttaaaagtaccaaacataacccagagtatgtggaatatgggcaacatatatatagccttctgtatttaacgatcttctgcttcttaaccgtaccagttttctatttataactcttatctatccatgatgttttaaagtctccacttgctgttatttacaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgta

SEQ ID NO: 167074 - DNA, 1268 bp, Homo sapiens
ttatagatgttcacttgggccagtgtcactgcctgagaggctcccggtgttagtgctatgtcgtttagctcggccaaccggtcttggtgttgacccaaacgagggtgcccaatgtcgtccttgttgtgttcaggcagcggttggaaacgtgtgcctccgtaagtctgtcccgaggtggccccgtgttgtttgccacagaccggcgccgatcacctgggcaagggggtgctgccaaatgcccgtgttcccatgcaggccccgttcaagaaaagctcggtgtaagctgggaatgttggagttgcttccgtggtctgttaaagcgctgattattgatggaagttactggcgctcaatccccaagtaccccaaagttgaaagcttgctcggaacaattatgcgaaatgggaatctggggcccttacaatcaaaggcacatctagttcccatgtttaaaatagtctccggggtccatttggagtgaggagtaaggaagggaagggacttatgcaggtctttccatgcggccttgatttagtccacggagtccaaagcccattctgaggcagggtctctaggttcttggtttacacctatatacaggcgagcgcgcccccgagcggggaccgcgcgcacagcccgcactgccccacgccgcgggctagggacacccggcccgccaccatgacttccagcaagatagagatgcccggcgaggtgaaggccgaccccgccgccctcatggcgtcgctgcacctcctgccgtcgcccacgcccaatctcgaaattaagtacaccaaggtaagcggccgcccagcgcccgtcgtccacggagactttctagaaccttcttcggtttccccgatctcttcagcgggtgagggctgcgggacggggccggggtcgtcggggccagcctgtcatcccggcgcagcagagggaccccctgcctgtcttcgggactggggcgtttgaagccccgccgtggtctgaggacgccttggggacttaacccaacccgaagcgcagcgttgaggggcagccgtcaacggctcctgccccggactctgaggctggtttctgtccgattctcccggtcccgactgccgcgggggaaggcgtcggaaccgcttagtatcctcagatggaggccggggttccccgtcagcttggccacgcagcctggccgtcgcctctcggtcctccgccttccgggcccctcggctgttggtcccaatcaggtcctccacagcccggagggtgctgagggg

SEQ ID NO: 167075 - DNA, 4006 bp, Homo sapiens
ttatagatgttcacttgggccagtgtcactgcctgagaggctcccggtgttagtgctatgtcgtttagctcggccaaccggtcttggtgttgacccaaacgagggtgcccaatgtcgtccttgttgtgttcaggcagcggttggaaacgtgtgcctccgtaagtctgtcccgaggtggccccgtgttgtttgccacagaccggcgccgatcacctgggcaagggggtgctgccaaatgcccgtgttcccatgcaggccccgttcaagaaaagctcggtgtaagctgggaatgttggagttgcttccgtggtctgttaaagcgctgattattgatggaagttactggcgctcaatccccaagtaccccaaagttgaaagcttgctcggaacaattatgcgaaatgggaatctggggcccttacaatcaaaggcacatctagttcccatgtttaaaatagtctccggggtccatttggagtgaggagtaaggaagggaagggacttatgcaggtctttccatgcggccttgatttagtccacggagtccaaagcccattctgaggcagggtctctaggttcttggtttacacctatatacaggcgagcgcgcccccgagcggggaccgcgcgcacagcccgcactgccccacgccgcgggctagggacacccggcccgccaccatgacttccagcaagatagagatgcccggcgaggtgaaggccgaccccgccgccctcatggcgtcgctgcacctcctgccgtcgcccacgcccaatctcgaaattaagtacaccaagatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcatagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaatttttcaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgacccaatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggtggtttttcatagctagataagatcttttccaaagtttttcttagaaccaaccaaaaaacaatccgagtaggcccaagaatttgataatgctggatgccttgcagacatcattcagtttctaatattgggcaacaattattattaaatgaattatttctgtagttggaatctgtaccttctgaacctctacaccaataactgctgcaggtgtgattttggtctgtcacactgtacatctatcataatgtgccctgtatctattggcagtgaccttggaaaatctggccaagcctaggggtttccttttccatttgccaagttccattgtgccaggactgccgtgctccactgagctcctctgtcacaccccattcttgcccctcactgggcaggccatggcctacagcttgcagggagtaaagcaggcccgcctccctttcttcccatccacatactcctcttctgctttccagtgactccaccagtttgatgtgggaagtgttagcttcctttccttcttccatcccttcttccatctttccagctgtcaaatccaatccagtctctaacctaaatgcagatcatttatttaaaagtaccaaacataacccagagtatgtggaatatgggcaacatatatatagccttctgtatttaacgatcttctgcttcttaaccgtaccagttttctatttataactcttatctatccatgatgttttaaagtctccacttgctgttatttacaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgta

SEQ ID NO: 167076 - DNA, 4185 bp, Homo sapiens
ttatagatgttcacttgggccagtgtcactgcctgagaggctcccggtgttagtgctatgtcgtttagctcggccaaccggtcttggtgttgacccaaacgagggtgcccaatgtcgtccttgttgtgttcaggcagcggttggaaacgtgtgcctccgtaagtctgtcccgaggtggccccgtgttgtttgccacagaccggcgccgatcacctgggcaagggggtgctgccaaatgcccgtgttcccatgcaggccccgttcaagaaaagctcggtgtaagctgggaatgttggagttgcttccgtggtctgttaaagcgctgattattgatggaagttactggcgctcaatccccaagtaccccaaagttgaaagcttgctcggaacaattatgcgaaatgggaatctggggcccttacaatcaaaggcacatctagttcccatgtttaaaatagtctccggggtccatttggagtgaggagtaaggaagggaagggacttatgcaggtctttccatgcggccttgatttagtccacggagtccaaagcccattctgaggcagggtctctaggttcttggtttacacctatatacaggcgagcgcgcccccgagcggggaccgcgcgcacagcccgcactgccccacgccgcgggctagggacacccggcccgccaccatgacttccagcaagatagagatgcccggcgaggtgaaggccgaccccgccgccctcatggcgtcgctgcacctcctgccgtcgcccacgcccaatctcgaaattaagtacaccaagatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcatagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaatttttcaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgacccaatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggtggtttttcatagctagataagatcttttccaaagtttttcttagaaccaaccaaaaaacaatccgagtaggcccaagaatttgataatgctggatgccttgcagacatcattcagtttctaatattgggcaacaattattattaaatgaattatttctgtagttggaatctgtaccttctgaacctctacaccaataactgctgcaggtgtgattttggtctgtcacactgtacatctatcataatgtgccctgtatctattggcagtgaccttggaaaatctggccaagcctaggggtttccttttccatttgccaagttccattgtgccaggactgccgtgctccactgagctcctctgtcacaccccattcttgcccctcactgggcaggccatggcctacagcttgcagggagtaaagcaggcccgcctccctttcttcccatccacatactcctcttctgctttccagtgactccaccagtttgatgtgggaagtgttagcttcctttccttcttccatcccttcttccatctttccagctgtcaaatccaatccagtctctaacctaaatgcagatcatttatttaaaagtaccaaacataacccagagtatgtggaatatgggcaacatatatatagccttctgtatttaacgatcttctgcttcttaaccgtaccagttttctatttataactcttatctatccatgatgttttaaagtctccacttgctgttatttacaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgtaaaaaaaaaaaaaaagaggagtggcccttttgtgtgacatcaagtaagttcatttccatctgctcagggcaccagaacccacatagacagcctgtgctattgagggactcagtgatgtgtgtgtcttttctccccagtaattccttaattactctttctacattaaaaagttgatgttct

SEQ ID NO: 167077 - DNA, 3943 bp, Homo sapiens
ttatagatgttcacttgggccagtgtcactgcctgagaggctcccggtgttagtgctatgtcgtttagctcggccaaccggtcttggtgttgacccaaacgagggtgcccaatgtcgtccttgttgtgttcaggcagcggttggaaacgtgtgcctccgtaagtctgtcccgaggtggccccgtgttgtttgccacagaccggcgccgatcacctgggcaagggggtgctgccaaatgcccgtgttcccatgcaggccccgttcaagaaaagctcggtgtaagctgggaatgttggagttgcttccgtggtctgttaaagcgctgattattgatggaagttactggcgctcaatccccaagtaccccaaagttgaaagcttgctcggaacaattatgcgaaatgggaatctggggcccttacaatcaaaggcacatctagttcccatgtttaaaatagtctccggggtccatttggagtgaggagtaaggaagggaagggacttatgcaggtctttccatgcggccttgatttagtccacggagtccaaagcccattctgaggcagggtctctaggttcttggtttacacctatatacaggcgagcgcgcccccgagcggggaccgcgcgcacagcccgcactgccccacgccgcgggctagggacacccggcccgccaccatgacttccagcaagatagagatgcccggcgaggtgaaggccgaccccgccgccctcatggcgtcgctgcacctcctgccgtcgcccacgcccaatctcgaaattaagtacaccaagatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcatagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaatttttcaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgacccaatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggtggtttttcatagctagataagatcttttccaaagtttttcttagaaccaaccaaaaaacaatccgagtaggcccaagaatttgataatgctggatgccttgcagacatcattcagtttctaatattgggcaacaattattattaaatgaattatttctgtagttggaatctgtaccttctgaacctctacaccaataactgctgcaggtgtgattttggtctgtcacactgtacatctatcataatgtgccctgtatctattggcagtgaccttggaaaatctggccaagcctaggggtttccttttccatttgccaagttccattgtgccaggactgccgtgctccactgagctcctctgtcacaccccattcttgcccctcactgggcaggccatggcctacagcttgcagggagtaaagcaggcccgcctccctttcttcccatccacatactcctcttctgctttccagtgactccaccagtttgatgtgggaagtgttagcttcctttccttcttccatcccttcttccatctttccagctgtcaaatccaatccagtctctaacctaaatgcagatcatttatttaaaagtaccaaacataacccagacgtaccagttttctatttataactcttatctatccatgatgttttaaagtctccacttgctgttatttacaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgta

SEQ ID NO: 167078 - DNA, 3447 bp, Homo sapiens
ttatagatgttcacttgggccagtgtcactgcctgagaggctcccggtgttagtgctatgtcgtttagctcggccaaccggtcttggtgttgacccaaacgagggtgcccaatgtcgtccttgttgtgttcaggcagcggttggaaacgtgtgcctccgtaagtctgtcccgaggtggccccgtgttgtttgccacagaccggcgccgatcacctgggcaagggggtgctgccaaatgcccgtgttcccatgcaggccccgttcaagaaaagctcggtgtaagctgggaatgttggagttgcttccgtggtctgttaaagcgctgattattgatggaagttactggcgctcaatccccaagtaccccaaagttgaaagcttgctcggaacaattatgcgaaatgggaatctggggcccttacaatcaaaggcacatctagttcccatgtttaaaatagtctccggggtccatttggagtgaggagtaaggaagggaagggacttatgcaggtctttccatgcggccttgatttagtccacggagtccaaagcccattctgaggcagggtctctaggttcttggtttacacctatatacaggcgagcgcgcccccgagcggggaccgcgcgcacagcccgcactgccccacgccgcgggctagggacacccggcccgccaccatgacttccagcaagatagagatgcccggcgaggtgaaggccgaccccgccgccctcatggcgtcgctgcacctcctgccgtcgcccacgcccaatctcgaaattaagtacaccaagatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcatagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaatttttcaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgacccaatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggtggtttttcatagctagataagatcatttatttaaaagtaccaaacataacccagagtatgtggaatatgggcaacatatatatagccttctgtatttaacgatcttctgcttcttaaccgtaccagttttctatttataactcttatctatccatgatgttttaaagtctccacttgctgttatttacaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgta

SEQ ID NO: 167079 - DNA, 2334 bp, Homo sapiens
ttatagatgttcacttgggccagtgtcactgcctgagaggctcccggtgttagtgctatgtcgtttagctcggccaaccggtcttggtgttgacccaaacgagggtgcccaatgtcgtccttgttgtgttcaggcagcggttggaaacgtgtgcctccgtaagtctgtcccgaggtggccccgtgttgtttgccacagaccggcgccgatcacctgggcaagggggtgctgccaaatgcccgtgttcccatgcaggccccgttcaagaaaagctcggtgtaagctgggaatgttggagttgcttccgtggtctgttaaagcgctgattattgatggaagttactggcgctcaatccccaagtaccccaaagttgaaagcttgctcggaacaattatgcgaaatgggaatctggggcccttacaatcaaaggcacatctagttcccatgtttaaaatagtctccggggtccatttggagtgaggagtaaggaagggaagggacttatgcaggtctttccatgcggccttgatttagtccacggagtccaaagcccattctgaggcagggtctctaggttcttggtttacacctatatacaggcgagcgcgcccccgagcggggaccgcgcgcacagcccgcactgccccacgccgcgggctagggacacccggcccgccaccatgacttccagcaagatagagatgcccggcgaggtgaaggccgaccccgccgccctcatggcgtcgctgcacctcctgccgtcgcccacgcccaatctcgaaattaagtacaccaagatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcatagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgagtatgtggaatatgggcaacatatatatagccttctgtatttaacgatcttctgcttcttaaccgtaccagttttctatttataactcttatctatccatgatgttttaaagtctccacttgctgttatttacaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgta

SEQ ID NO: 167080 - DNA, 1194 bp, Homo sapiens
ttatagatgttcacttgggccagtgtcactgcctgagaggctcccggtgttagtgctatgtcgtttagctcggccaaccggtcttggtgttgacccaaacgagggtgcccaatgtcgtccttgttgtgttcaggcagcggttggaaacgtgtgcctccgtaagtctgtcccgaggtggccccgtgttgtttgccacagaccggcgccgatcacctgggcaagggggtgctgccaaatgcccgtgttcccatgcaggccccgttcaagaaaagctcggtgtaagctgggaatgttggagttgcttccgtggtctgttaaagcgctgattattgatggaagttactggcgctcaatccccaagtaccccaaagttgaaagcttgctcggaacaattatgcgaaatgggaatctggggcccttacaatcaaaggcacatctagttcccatgtttaaaatagtctccggggtccatttggagtgaggagtaaggaagggaagggacttatgcaggtctttccatgcggccttgatttagtccacggagtccaaagcccattctgaggcagggtctctaggttcttggtttacacctatatacaggcgagcgcgcccccgagcggggaccgcgcgcacagcccgcactgccccacgccgcgggctagggacacccggcccgccaccatgacttccagcaagatagagatgcccggcgaggtgaaggccgaccccgccgccctcatggcgtcgctgcacctcctgccgtcgcccacgcccaatctcgaaattaagtacaccaagatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggcctcacgatccttctgaccttttgggttttaagcatgtggggtaacgaaaatt

SEQ ID NO: 167081 - DNA, 446 bp, Homo sapiens
gcttcagaaaggggacgtctgttggataagcttgcagacttggtggaacgggacagggcagttcttgcagtaagtaacctaagaaaacattaagtctttaacccacatttgccattctgctgaaatttacattcttcggctgtattttattttatttttatttattttattttttgagacggagtctagctctgtcgcccaggctggagcgcagtggcacgatttcagctcactgcaacctctgcctcccaggtacaagcgattctcctgcctcagcctcctgagtagctgggattacgtgcacgtgccaccacacctggctaatttttgtatttttagtagagacggggtttcactatgttggtcaggctggtcttgagctcctaaaaggatactttgaagcagacctggggaaaaagcaaaggaataggtaatacatatgaaaa

SEQ ID NO: 167082 - DNA, 3146 bp, Homo sapiens
  misc_feature (318)..(318): n is a, c, g, or t
  misc_feature (694)..(694): n is a, c, g, or t
tcggtcatttagcaactaatgcacgtcagattaagctgttttgaagtgtaagatataagggatgaatatggaagagttatcataggattttacacaagtccatgtcaatctagaggaaatttagtgtcttcaaagaagacccattggtgttacggtttaatcccccaagtaccaaacatacagccccaaggccctgtagatttaggagttgtaaattggccaaatacaaaatatagacatgtttacctgtctaaacattacactatgttcaaaacaagaactgcacattaaaatattgatttctgtgaaaattgagangatctggcaacctggggctcatatttatgcatggcaatgattaaatgtagtggctttccttcttagcccctccattacattgctttaccacctggcagactcatacctgtaccttatctcccaagccctgtggtatataggggtttgagactcctgttatacacgaggttcagtacctctgtttgcagaataagaaagagacccaaagaagtgaagttgttcaagttcacatagcatgtcagggtgtagttagaactagttgcattcccaatccagggctattcatggttatgtcatgcagtgagcacactatacctagggctttggagaggggagggaggcggcttcatagacaggcccctccccaggcaaagcngtgagaacatggctgtttcctcttgtagtggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcatagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaatttttcaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgacccaatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggtggtttttcatagctagataagatcttttccaaagtttttcttagaaccaaccaaaaaacaatccgagtaggcccaagaatttgataatgctggatgccttgcagacatcattcagtttctaatattgggcaacaattattattaaatgaattatttctgtagttggaatctgtaccttctgaacctctacaccaataactgctgcaggtgtgattttggtctgtcacactgtacatctatcataatgtgccctgtatctattggcagtgaccttggaaaatctggccaagcctaggggtttccttttccatttgccaagttccattgtgccaggactgccgtgctccactgagctcctctgtcacaccccattcttgcccctcactgggcaggccatggcctacagcttgcagggagtaaagcaggcccgcctccctttcttcccatccacatactcctcttctgctttccagtgactccaccagtttgatgtgggaagtgttagcttcctttccttcttccatcccttcttccatctttccagctgtcaaatccaatccagtctctaacctaaatgcagatcatttatttaaaagtaccaaacataacccagagtatgtggaatatgggcaacatatatatagccttctgtatttaacgatcttctgcttcttaaccgtaccagttttctatttataactcttatctatccatgatgttttaaagtctccacttgctgttatttacaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgta

SEQ ID NO: 167083 - DNA, 3131 bp, Homo sapiens
ttcagttgtgcctcttcctctctaacaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcatagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttcctccttccaggccctcctcgctcacccacccctccctctcttccaaggagatgtcagctgagctcattctggggcagatgtttgggccgggaacaatttttcaaggttgtaaagccaaattatcatttcatgttatccatttcttcaaagcaaaacatgaaatggttttagctagagtcagaccagaatgaaaatgccaggagctggtacactacagatgtagtaagaacctgggatattcctgacccaatctggttttcttttacccataaataacatgaatgaaaaaagattgggacaatagagactggaagtcatcatgtgcagttcaccgcttctgagcttgctgcagttttggggtgtgtgtgtattagattccttctcagttattctggaataaggcaaggagtgggtggtttttcatagctagataagatcttttccaaagtttttcttagaaccaaccaaaaaacaatccgagtaggcccaagaatttgataatgctggatgccttgcagacatcattcagtttctaatattgggcaacaattattattaaatgaattatttctgtagttggaatctgtaccttctgaacctctacaccaataactgctgcaggtgtgattttggtctgtcacactgtacatctatcataatgtgccctgtatctattggcagtgaccttggaaaatctggccaagcctaggggtttccttttccatttgccaagttccattgtgccaggactgccgtgctccactgagctcctctgtcacaccccattcttgcccctcactgggcaggccatggcctacagcttgcagggagtaaagcaggcccgcctccctttcttcccatccacatactcctcttctgctttccagtgactccaccagtttgatgtgggaagtgttagcttcctttccttcttccatcccttcttccatctttccagctgtcaaatccaatccagtctctaacctaaatgcagatcatttatttaaaagtaccaaacataacccagagtatgtggaatatgggcaacatatatatagccttctgtatttaacgatcttctgcttcttaaccgtaccagttttctatttataactcttatctatccatgatgttttaaagtctccacttgctgttatttacaaacgacagtgcattcagcagcccagtgccgtgagccctgacagatgccgtatttctgagtgcttccatgtgaatgctgccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgta

SEQ ID NO: 167084 - DNA, 2765 bp, Homo sapiens
ttatagatgttcacttgggccagtgtcactgcctgagaggctcccggtgttagtgctatgtcgtttagctcggccaaccggtcttggtgttgacccaaacgagggtgcccaatgtcgtccttgttgtgttcaggcagcggttggaaacgtgtgcctccgtaagtctgtcccgaggtggccccgtgttgtttgccacagaccggcgccgatcacctgggcaagggggtgctgccaaatgcccgtgttcccatgcaggccccgttcaagaaaagctcggtgtaagctgggaatgttggagttgcttccgtggtctgttaaagcgctgattattgatggaagttactggcgctcaatccccaagtaccccaaagttgaaagcttgctcggaacaattatgcgaaatgggaatctggggcccttacaatcaaaggcacatctagttcccatgtttaaaatagtctccggggtccatttggagtgaggagtaaggaagggaagggacttatgcaggtctttccatgcggccttgatttagtccacggagtccaaagcccattctgaggcagggtctctaggttcttggtttacacctatatacaggcgagcgcgcccccgagcggggaccgcgcgcacagcccgcactgccccacgccgcgggctagggacacccggcccgccaccatgacttccagcaagatagagatgcccggcgaggtgaaggccgaccccgccgccctcatggcgtcgctgcacctcctgccgtcgcccacgcccaatctcgaaattaagtacaccaagatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcatagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttggatcaattgttacaatgccttaaatgcccagagcccctttgggggattcaagatgtctggaaatgggagagaaatgggagaatttggcttgcgggagtactcagaagttaagacggtgacagtaaagatcccccagaagaactcctaagaaggccaagaaggaggatgaagcccagcctgcacgtctgtccctctctgctttctctgtagggcccagctctcaggaatacaaagttgagccacggtccttacttaaagattgaaaagataacatgtaggccaggcaggtcactgcacaactaaagcaaaccagctgggtacagtttcttggcactctgtaaggggccaccttaatcataccaaatattggggaaagtgggataaagggaggaggaggagctagcagacacatccagtatctccttctggagcacaggatgaaataagggagctgtattatttcatgtctttgtcacaaagaactttcctctcaaggaaaggtgacctttctcctgtcttcattttccctcctgtagcatgtgtccaagtggacatagccactaaccaactagttacctttggactgcaacaaaaaatgtgaaaatgaagatttatttcttttaatttacttaaaaagaaacctctgtgctagcaataaagcatttatattgtgta

SEQ ID NO: 167085 - DNA, 2282 bp, Homo sapiens
  misc_feature (2109)..(2109): n is a, c, g, or t
  misc_feature (2119)..(2119): n is a, c, g, or t
  misc_feature (2126)..(2126): n is a, c, g, or t
  misc_feature (2128)..(2128): n is a, c, g, or t
  misc_feature (2133)..(2133): n is a, c, g, or t
  misc_feature (2144)..(2144): n is a, c, g, or t
  misc_feature (2152)..(2152): n is a, c, g, or t
  misc_feature (2164)..(2164): n is a, c, g, or t
  misc_feature (2168)..(2168): n is a, c, g, or t
  misc_feature (2172)..(2172): n is a, c, g, or t
  misc_feature (2176)..(2177): n is a, c, g, or t
  misc_feature (2182)..(2182): n is a, c, g, or t
  misc_feature (2185)..(2185): n is a, c, g, or t
  misc_feature (2192)..(2192): n is a, c, g, or t
  misc_feature (2202)..(2202): n is a, c, g, or t
  misc_feature (2214)..(2214): n is a, c, g, or t
  misc_feature (2235)..(2235): n is a, c, g, or t
ttatagatgttcacttgggccagtgtcactgcctgagaggctcccggtgttagtgctatgtcgtttagctcggccaaccggtcttggtgttgacccaaacgagggtgcccaatgtcgtccttgttgtgttcaggcagcggttggaaacgtgtgcctccgtaagtctgtcccgaggtggccccgtgttgtttgccacagaccggcgccgatcacctgggcaagggggtgctgccaaatgcccgtgttcccatgcaggccccgttcaagaaaagctcggtgtaagctgggaatgttggagttgcttccgtggtctgttaaagcgctgattattgatggaagttactggcgctcaatccccaagtaccccaaagttgaaagcttgctcggaacaattatgcgaaatgggaatctggggcccttacaatcaaaggcacatctagttcccatgtttaaaatagtctccggggtccatttggagtgaggagtaaggaagggaagggacttatgcaggtctttccatgcggccttgatttagtccacggagtccaaagcccattctgaggcagggtctctaggttcttggtttacacctatatacaggcgagcgcgcccccgagcggggaccgcgcgcacagcccgcactgccccacgccgcgggctagggacacccggcccgccaccatgacttccagcaagatagagatgcccggcgaggtgaaggccgaccccgccgccctcatggcgtcgctgcacctcctgccgtcgcccacgcccaatctcgaaattaagtacaccaagatctttataaacaacgagtggcagaactcagagagtgggagagtgttccctgtctataatccagccacaggagaacaggtgtgtgaagttcaagaagcagacaaggcagatatagacaaagcagtgcaggcagcccgcctggctttctctcttggttcagtgtggagaaggatggatgcttcagaaaggggacgtctgttggataagcttgcagacttggtggaacgggacagggcagttcttgcaaccatggaatccctaaatggtggcaaaccattcctgcaagctttttatgtggatttgcagggcgtcatcaaaacctttcgatattacgcaggctgggctgataaaattcatgggatgaccattcctgtagatggagactattttacctttacaagacatgaacccattggagtgtgtggacagatcatcccatggaacttccccctgctgatgtttgcctggaaaatagctccagctttgtgctgtggcaatacagtagttattaagccagcagagcaaacaccactcagtgcactctacatgggagccctcatcaaggaggctggctttcctcccggggtcatcaatattttgccaggatatgggccaacggctggggcagcaatagcttctcacattggcatagacaagattgcattcacagggtctactgaggttggaaagcttatccaagaagcagctggaagaagtaatttgaagagagtaactctggaacttggaggcaaaagtcctaatattatttttgctgatgctgacttggactatgctgtggagcaggcccaccagggtgtgttcttcaatcaaggtcagtgctgcactgcaggctctcgcatcttcgtggaggagtccatctatgaggagtttgtgagaagaagcgtggagcgggccaagaggcgcatagtggggagtccctttgaccccaccactgagcagggtccccagattgataagaaacagtacaacaagatcttggaactcatccagagtggtgtggctgagggcgccaagctggaatgtggaggcaaaggactgggccgaaaggggtttttcattgagcccacagtgttttccaacgtcactgatgatatgcggattgccaaggaggagatctttggccctgttcaggaaattttgagatttaagacgatggatgaagttatcgaaagagccaataactcagactttggactcgtagcagctgtctttactaatgacatcaacaaggccctcacagtgtcttctgcaatgcaagctgggactgtttgggatccaattgttcacaangccttcaaancgcccananccccntttgggggganttcaagangtcttggtaatngggnaganaaannggganaantttgggnttgcgggganttactccagaantttaaaaacggtggacaattnaaaataccccccaaaaaaaactccttaaaaaaagcccaaaaagaggg

SEQ ID NO: 167086 - DNA, 417 bp, Homo sapiens
agaacaattatataatataaaaaagttaaatgaatgtgatctctctctcaaaacacctcttgtactgtacttcttgtgatctgtcagtctgataatcaagatagttactaatgtgaataaggggtgggtagcatatgtagcaaggatatcatgtcccaggtgggatggagcgggatgtcagaaaatttcatcacactcctcagactggtgcccaatttaaaacgtatgaattatttatttctggaattttccatgtaatatttttgtactgcggttcaccatgaataactgaaactgaagaagaagaaaccgcggataaggggagaactactgtagtttcttaagttgtatgattgaatgattcattcatttttacctggtgatgctgctgcatttgggtgctttgccctttatgca

SEQ ID NO: 167087 - DNA, 412 bp, Homo sapiens
tcaaataatcatgttttgtttcttttgaggatgttgatcaagtcatcaccagccttttatcttgaacaatgtgttttaaatcatctgcaaatttttccattggtttcacaattgttcattgtcagtttcaggtttaattgcatctattgcttttaatacaagcaaaggaaaagtactattttcctggtatacaatccctttaggttaactttaaaataactcaatacattgtgattggaacccactagacagttaggatctgttctctttactcatgcatggttaaacttttctgttaataaacatgtctttcccatgctctaaacataaaagtgttatatgtgtataatcttatgctcatttaggcttgcattgtttgataaaaactgggtgaaaagcaaaataccctaga

SEQ ID NO: 167088 - DNA, 342 bp, Homo sapiens
gtgaacaaggcccttgaatgggcttcattcaggagggtgaacaggaccaacaccagcacagggccgggtggcgtccagccaagcccacctgtccctttggcagcacccctctcttcttcccccgcaccttgctccaccccccacccccagcagcctctcagctcctgcaggatctgtgtcctgtgccagaggacaccaccgacctcgggacccccgctcagtgccctgaggaccaccagagagctaacgggcagcatctccaggaggcgtctgggaagtgggggagggggccaaagcccaaggtccccagtattctggccaccctgtccccaggtccagcct

SEQ ID NO: 167089 - DNA, 553 bp, Homo sapiens
caccagtctgtgtcttcatgcagcagtggcttttgagatctcggttgtcttttcagaacattgggacggcctcaacaacttgcatgacgctgggcaagtgaatttctctctctgggcctcagtgtccccatctaggcaatcaccagccgttaggccctatggatggaaggttcctgcctgcagtggcattttaggatccactatcatctgctttatcttcctagtggcaagggactggaccagatgcttttggaaagcgcaccaagcttaaaggtggctctctctgcaggtgcccctcctcccttcacgccagaggctcacccccaccccgcccgggctccctgttagagccaggcctggctcttcagccttgcagctcaggaaaccagagcgcagcgctatagccgcgactgcggcggcggcggcggcgcagggggcgggggaggagagaagcgcccacttcgtcccgctgcctccgcagcagccctggccctagccccggcgcatcagagcggtccttgggaatctttgggcttgttgctccggcggccgc

SEQ ID NO: 167090 - DNA, 536 bp, Homo sapiens
aaacaaaaatgtaaatttgccaggatcagccctgccctaagggcagaagtggcttccctgcttgcttacttcactgggttcctatttaccctctatgtagcacttatccctttctgtcttgtcaaaaagctagttgtttttaagatttttttttctcctcccagtatttttagttgttttcagtgggaagtttggtccaaataacctaggccgccattactggaaactgaaagtcattaaatccttcctaattaggaagcagaacttttgccagatgcatttgcaggtgtttttgtaaggctgtgttcctaaccagaagatttgattcctctatcacagaaagcagtataggaaacaaatccatctctttggccttactcatttattcaatagtattatttgagtgcttcctgtgtgccaggcactggggtaaaggttacaacagtgagccagtagaatccctgcccttcactcctttgttaagaaaaagcagagtaaatcatctgagctaccagtttcaagattagataagccct

SEQ ID NO: 167091 - DNA, 325 bp, Homo sapiens
agacacaagcttgttccaaaagaacagaggagctggcccaggaagcaagaagccggaatccttgtccttgtcctttgaacatgtagcaaatgtgtttcttctaggcttcagattccttaaatttaaaacatggggctggaacaagaggatgactgaggtttcctccagctctaaatttctctacaagctaagggaatgagaggaggaaaaggtgaagaattacagccccttggccatgcccctaatgtctgggagggctcacaggtgcaggtctataccaggaagatcatgagctcttggagtcatttctctgtatttctgtttg

SEQ ID NO: 167092 - DNA, 177 bp, Homo sapiens
ctctgaggcacagactagttccttatagagaggaggcatttacaaggcacttggtagggaaggcgtcctgaaatcggggctgtacacccaggatgtgagtcgtctcccacccacgtgggcctgtctgtgtctgtgcgttgctggttttcattttaatggttctaatttgagaatgcg

SEQ ID NO: 167093 - DNA, 495 bp, Homo sapiens
cgcccggccgtctcaatgcgatcacaggagggacacggagatcgaggagggccacagccggaccaggccaggcgtgctgcggcaggaggaaggctccggaggtggggtgggaaggggaggccgagagacgggtgtcgccgcgcccccgctgccgccagagaggagcctacggctggcagcctggcctgggcagcagggtcctcggcgctcggctgggaaatcgcacgtctctccgcggtgacctgtgcacagcccctgggcctccgcctccgtgctggcagcctccgcctcagcgcacaaagccccgtcaccccgactctcggggcgccgccgccgccaaatcctcagcccctccctcattggccgcggcgtctgccgggaagtgcagtcccgggtttggggcgatggagcccaggaggaagcggcgagtcagcgcggcggaaagggcggaggggacggagggggcggaggggacgaaccacgaacgcccgcggc

SEQ ID NO: 167094 - DNA, 320 bp, Homo sapiens
tctgagctactcgggagcctgaggcagaagaattgctttaacctgggggatggaggttgcagttagccaagatcatactctgcactccagcctgggtaacacagagtgagactctgtctcaaaaacaaaaacagaaaaagacattttttttaaatacactcttttttgaaactcttaccataaagcacaaaccacaatcactttcctaatttcctttaccacagccagaaatgaaatgtgtaaagagtaggtgggaacaaaagggaagtaagtacaaaaaatcaaaatagcattaaaaatgatcaaatatccacaatgca

SEQ ID NO: 167095 - DNA, 403 bp, Homo sapiens
caaatattgatgcatgtttgtttcatgacaaccctgtgaagtaggtagtgttaccccgttttatagatgaggaaacaggcgtagagggataaagggacttgcccaaggtctgtctctaccttacacgcacatgaacgctcactcatgcggcaggcgctagtttccctctgatgtgagtcaggccttgagctggttggggtctgggtcccactttggttgtgttttgctgtgggcaccaaggaagcttctagcagcctcatctccctggtatgacctagctccagggactggatttccccaaatgctcctgcccagcctggagcctcctttccagctgggggagggctgaacgacccctcactcttggaggctgccggagcccctcctgcctgcatgcggccgc

SEQ ID NO: 167096 - DNA, 187 bp, Homo sapiens
caccaaccttcatcagcattagtattgacgggacactctatggagtcaagcagccaaatcacctttccctcccctctcctcacagatgctctccagggctacacttggactccacaaaacaccaaagagctggaagcacagaagcagcttcataagcaacaaggcaggttgaaaagaccgagaccca

SEQ ID NO: 167097 - DNA, 258 bp, Homo sapiens
  misc_feature (7)..(7): n is a, c, g, or t
  misc_feature (15)..(15): n is a, c, g, or t
ctctagnggatcccngatgttatcgcccaacactctgagaatgcagaccaggcacgtcattttaggctagactagacaaatcattctaaactgctgtcctcagacagttatatcttaagtctaaacaagacttctttggtcattcttcccagttaaaatattggtttcaactattttagatttaaggtatggttccaatcatgtttaaagtttaacatgtgcaaaggtgtcttttattgtgttggggataagaaagtt

SEQ ID NO: 167098 - DNA, 192 bp, Homo sapiens
tgctgggattataggcacgagccaccatgccggccctatgttttcttttaactgccttcaaactgtttctacttgaataatgccccgttgtttcatatatccaaagtcaaactcttcatatggtttctgacagagttccctttcttaactagtattatttctagtacagtaatcaatattcttctattcctg

SEQ ID NO: 167099 - DNA, 194 bp, Homo sapiens
attgtcactgtttaaccattaatattcttttctctaatgaatgcctttaaaaaatttccagttcagaatttacctctttttaatgaaatattttgtatggacttaccaaatacgtatatagtttgtaaaaagccgatggtagaaaagatttctaagttaggtgaccatatgctttatcatccaaatgaggccac

SEQ ID NO: 167100 - DNA, 421 bp, Homo sapiens
cctgcctcagcctcccgagtagctgggattacaggtgcacaccatcatacaccgctaatttttaatttttttagtagagatggggtttcaccatgttggccaggctggtttcaaattcctgacctctagtaatccacctgccttagcctcccaaactgctgggattacagtgagccactgcacccggcccatcaaaatatttaagagtaatcaaatacactttcttctctcatgaaccttaaaatatggcaggggaagatagacattaagtgatgaagcaaagatactgagactctctggggcgagaggatcacacgttgagaactgctgaattgggataatgaagggaaggaagcatacaatcccaaatcaccattaaaccaaaagttgtttacaggattcaaaatggacataatagaaa

SEQ ID NO: 167101 - DNA, 218 bp, Homo sapiens
acgaaaaggactgctatgaacatttgcgtataagtttttgtttgaacacctgtatttaattcttttgggtaactacccaggagcccgccaaactattttttcacagcagctgaaccattttatattcccaccagcaatgggttccagtttcttcacatccttgctaaacgcttattttccattaaatatatatatcatatatatatcatatatatgat

SEQ ID NO: 167102 - DNA, 292 bp, Homo sapiens
gagggtgggaagtaatgcttttaattttaaaaaaatttattgagtaataatttatgtatcatgaaatttgtctaatttaagtgaataattcaattattttttgtacatttacccatttgtgcaatcatgaaaacaatccagttttagaacagtttcatcgccctagtaagattccccatgcccatttatagtcaattcctattttcgctctagccccaggcaaccactgatctactttctctctctatgtattcatctattctggacaattaatataaatggaatcatacag

SEQ ID NO: 167103 - DNA, 260 bp, Homo sapiens
tcacctgccagcaaccctttcttttctctttactcacaaattcgctctagggaccagaggatgctgtattcttttcttagtaaaatagatgaaatctgaaatgtagcctaacccagacacagaaaaaccacatataaaattcgaatgttcttagacatactatacagtgagccgtgctgaaaataatagcctttctgtgtaatttatcctgtttttctcctcccttatttggtacctcagcttctcattcctcctaatct

SEQ ID NO: 167104 - DNA, 169 bp, Homo sapiens
gaaaaatcgagactcagtgagatttagtgacttgtccaaggccttgcagttaatcagtgaaggagctggaatgcagctgtagtctgaacccaaagcccatgctgtgtgtgctgtgatggtgtggggccccttgctttggtgtaatcatagacataactgaaccggaaaa

SEQ ID NO: 167105 - DNA, 282 bp, Homo sapiens
tagcactgtgtgcagtttttttctatataatcacagtagtgtattggtaaaggggttgggggagcatggtttgtaacactgccaatttccatagtgtaaatattcctatcatggctgatttcacactaaccatagcttacagtgtttgtagttattaaacaattggctctttcaagctggtaggaactagctccagcttgttgcactgctgcaacaattactcaataaatacaagtcattaaatagaatcactgggcaagaaatagggatggtatggtaagg

SEQ ID NO: 167106 - DNA, 547 bp, Homo sapiens
ccactgctagtcctttctctcccatttattaaaatggtataaaaccagctattcttaatgagatgggtatatacataggtatataatttctaaatatcagattctttgcattttgttttttccctacaatagactcccaactatcccttggattagttttctgaacaacttatataactttatacatctttgtactatactttgtcctcttcaagtatatttcttgagctaattataatgtttagttatttaatatcgagtaattccctttagagaagagtttaccttatacaaagcatgttcaaactctatcaccatttcctagtgccatttctttcattcaaactacatttttttttccttcattacatttaatgtagaattttaaagcaaggcttctgaacctgagattcatagagtccatggaatggatcctctagtccttgggcctcctgaaatacatgcagaattttgtatgtatgtatgaatacgcaaagatggtaccatagtattaagatgtccatggctttcatgagattttttaatc

SEQ ID NO: 167107 - DNA, 414 bp, Homo sapiens
tgttgcccaggctggtctcaaactcctgggctcaagtaatcctcccacagcgctgggattacaggtatgagccactgcaccagccccaacagcagattttaagatgcattacaaatttaaatatgttaaaatgtggaaaataaatggcttgaaatcaatgaagtatcatagacaaataaatcaccagaagagatgagaaagcctaggaaacaaatattaattaaaatgtcaaacaacagcaaaatatttggcatatgataaaaatatcaaaccaatgacaaaagggtacattattcaatatatggcacagacagaaacgattatgtaagaaaaaagttaaattgttctctacaccttactcttctaaattacaaagccaaatggggaaaaaaagaactaaaaagaaaataaatg

SEQ ID NO: 167108 - DNA, 477 bp, Homo sapiens
agctggtggccggggtgctggggcagtggccgtagttgcagcagaacacacggatttcatagttgaagcacatcttgaacttccccacctgctcacggttcctgcagaccaggccaaagtccaggctgcattccacgacctggcccaactcccgcagggggacaccaggctgggcctgggcacggcactcgaggcccaggggctgctcacagacggcccctccggccgcacggatgttggagtaggtgtcaaagtccccgccagagggccccggcatggggtagctgtagtccagccactctgaccaggcacactggggctcacagcccatggtcaccaccgtggttattggggccgatgtggggctgctgggcagcagggtcgaggtgcgggtcttgctgggtgtggccgtggccgtggtcctggaggtggccctggtgtggcccggggtggtcgtccctggagaagggggtgact

SEQ ID NO: 167109 - DNA, 110 bp, Homo sapiens
gcgaaccagggaacagttcctcccatgactatttatgtatcctgtagaacatgagctccgtgaaagcagcaagaatgggcttgcttttctcacctatgctgcttacgaca

SEQ ID NO: 167110 - DNA, 326 bp, Homo sapiens
tgatgacttacatagatcgtaagataccttctacccccgcagaacattaagtagacttctcgcagttgaatctgatcccagtatatcattatgatatccacaacttttgataagacttgggggaaggaacagtattgattgagaagagataaatcagctcaacttttttttttttttttttttttctccctgagacagagtctcactctgtttcccaggctggaatgcagtggcccgatctcggctcactacaacctccacctcctgggttcatgcaatcctcctgcctcagcctcccaagtagctgggactacaggcatctgcca

SEQ ID NO: 167111 - DNA, 343 bp, Homo sapiens
ggaaacagcattggaatttgggatggtaccttcttggtgattgctatttctttaattcttcttaatcgctaaatccttgtttggttcagtttctgggatttatgttttacattcatatatttaataaatgtttctgaatgtattatcatagattcttgaagggtattttttaacttcaaaatatttccaatttcatggattcaatttttctccataaggtttcttagagaattggggtaacattttttcacccaacatcacttattcaccaacactaacattcagagtattttggggatcaaaatactgttaagaaaacaattttaaatttcgcacatgttta

SEQ ID NO: 167112 - DNA, 302 bp, Homo sapiens
ttgggatacagcctttctctactaaattatataactttttgaaattaataattgttagaatttcaggaaatgttagattgtttgaagcaatgcttttctcaccttttgtacctgtggataaaggtgagaagatggactcccagtgtcttcgctagtggagatagttttgcttctggcttttgcaaaagtaatgctaactacagtaatcttcgtatgcttttagtcatatctgctcacaataatcatagatgatattaaagacataattccatatcagatttgtgtaattgtttaattttgtt

SEQ ID NO: 167113 - DNA, 537 bp, Homo sapiens
gcacaagttccacagatcattccaacccagctagaacctcactcagcctggcttcctaagacaaatgcctttaactcttaaggccacctgtagaatcttccaagcaaacatttggaatgcactgttgggctgaagctcttctaccttagaggaatttccaagcttgttagtgtgtaatgtttttattatgtgctttagtatctgaagtgggaaggcttcttaccttccctagactctctgaagagtcctggacattcaaggcctgaccttcaggggaggttcctaccctagactctcccgtcggcatttaaatgcatcttctttaacttcctttatcctatattttcttctgttttcacactggttaaaatcttgcagaatgctcttaaaaaggcccgcttaaaaatgcatccatctatctgtctttccaatagagaaatacatgcacatttagatcttattatcctggctaggtagacagtgttccatagttggatatacttaactatttctattgttgatctttgcagtaaatgg

SEQ ID NO: 167114 - DNA, 298 bp, Homo sapiens
tctaccccaacattcacatcctgctgctcagcctgactaattcctattggtccttcagagttcaacttaaacgctttttcctctaggaagcaccccctggctgcccagaccaggtcagccctctggctctctatcccgagcatgcccgtggctctatcagggaacagagattacatctgtcttgttcaccattgtctcttcagtgtctagcatggcacagggccataatacccgacaaatatctgctgaataaatgaagtcatggctggaactgtcaccatggggtcagctatagaca

SEQ ID NO: 167115 - DNA, 213 bp, Homo sapiens
gaaaagacaccaaacactacatacaggaagaggctgcagcattaaaaaacaaaacaaaacaaaacaaaaaaccccctcagtttattcagttgctatcaatgataatcctaaagaacatcacttacaatatctgaataccaatttgtagtgatgacctcaaaaggtaggtagcaagagtgtctgctaatatgtattctctagaaaactcaactt

SEQ ID NO: 167116 - DNA, 421 bp, Homo sapiens
gaccagaacagtgccaccaaaaggcaggggcactgccctgtggctcttgttcccagcaagtacaacctctattaaaataattctcaccctgagaggaagcttattccaaatgaaagttataaatggcatcccttattcattgagttaggatctttgtattcagcattcttatcaccagaatcatcatttattgaactttaattgtgcaacataacctaatgggtgagatactccaagtatggacaattggaagtgagacacagcaggaatactggaaggcctcaggtgttcaggtccacatggtactctatacaaaggtagacatgtgtgcctaggttctgcgggtattttatcatgtctcttccttccagcatctggccatttcatccctggctgcttttggagggagtcgaatcctgac

SEQ ID NO: 167117 - DNA, 277 bp, Homo sapiens
agaaaccccagggtcagacgctgcagggttggtggctatcttcagggggattcagataagtttcacccaaagggaacccagacctgctgaaggctgaggtctccgaggccccgtatacagtcagtgctcagcatacatccagcctctctttcccaccagtgtgttccttaaggaatgtccaaaaatcacattcaattcagtcacaccacctcccttctcatataccttctatggttcctcctccaagagaacaaagttcaaatgtacccgcctaaca

SEQ ID NO: 167118 - DNA, 297 bp, Homo sapiens
taagtgagaccttgtctcaaagaaaacaaaaacaaaaacaagaaaaactaggagtgagctactttacccaaaagaacgcttcagaggtttgaaactcagaaggcaccaccaaagttgtgaaaggagcagggctgaacacagaactggtttaaagcatgtaaacagagaattgtttgttttaggttccctctgccatattatatgcaaccagagccatcacttctcagctgtgtgcaaacatgaagaagcttcctaacacctctaaccatcagtttcctcatttgtaatgatattacg

SEQ ID NO: 167119 - DNA, 378 bp, Homo sapiens
aaattctcctcacattatcccaattcaagtggccccttgttgcctgcttggacgctgactgatgcaaacatttactgtgtgtgcccagatgggcaaaatatggatcttgccctggagaagctctcagaagggagacagatccatgagcagtttctgcctcctgcagcaggtgacaggagcccatgtgctgtggcaacactgacccaggagggtcagaaaggcttcctgaggagatgcccagagcctggaagctggacagtcagagttagtcaagtgacaggctgaagtgggaataccctttcatcccagccaaaaccagaggtgtgatgccgggtgggatgtgccgggacctgccagctgtttgaggtacctagaggg

SEQ ID NO: 167120 - DNA, 483 bp, Homo sapiens
gcggggatggcaggtgtatctgggacacaagggtgaggagccaacacttggtcttggactcagccttgcacacagacgtggtctgcattgcctttttctaccaactgatctcacaccttttgtgtgtgtgttttccagccttgcttcctgactagcatttgctgccagaagggaaaattttccagacacctccaatggatttttgcctcctacttcattgacccatacaggtcacaaccaccccttaaaccagtcacttgcaagagggctgggattatcaggatagaccaggatttaaacaaaaaccagaaatagtgtggttttattgaggcatggatttagaacaaaattgaggttccctcatcaaggaagaagggaagaattttttctaggtaggcaactgactgcttagatataaaacgaactggcatttttttgcagttcttcataagtatattaatacgactgcttggattacaagga

SEQ ID NO: 167121 - DNA, 574 bp, Homo sapiens
tcttcactccacactgagaacaaaaatcagggtttgttcttcctctaggcctgccttcctaatcctaatcccaatcccaatgggctaccattcagctctcaggacatttaaactagcaacattttgtgactaaacactgctgaaatttacggcacaggtaagagtctaaggtaaactgtatttaatacttcttaaatagcttctgaagccatgctctcaaaaataatttcaaagaaagcaaatatctgagttctaagaagttcaacttcttctcaggttctgggaagttggaataaggcttggcagtggcttggtgctatttatgaatgtgctagttggaccatgccaatctcacctacgtaatgggctgggagacttaaattatggcttgactactacaactgtaagttattgtgctgaaaagttatcctcaggccccaaaaatgaaccgattatcattatccattctgtttcttctattcacactgcatttacattcactatttaaaagttttatttttcttatatcaggcctagaagcaacttccacatcagacgcactgtttacaaaaaa

SEQ ID NO: 167122 - DNA, 373 bp, Homo sapiens
atgtaggtacaggtgtagatgcaggtgtgggtgtggatgtaggtacaggtgtagatgcagatgtgggtgtgggagtagggtcaggtgtagatgcatgtgtgagtgtgggagtaggcacaggtgcaggtgcaggtgtgggtgtgggagtaggcacaggtgtgagtgtgggagtaggcacaggtgtacatgcaggtatgggtgtaggtacaggtgcagatgcaggtgtgggggtaggtataggtgtagatgcaggtatgggtgtaggtgtaggcaccagtgtagatggaggtgtgggtatgggtgtaggcacaggtgtagatgcaggtgcgggggcaggtctatccggccgcgaatttagtagtagtagtcgacc

SEQ ID NO: 167123 - DNA, 450 bp, Homo sapiens
ttcatctccttttgtgtagtaaaaaccactaatgaatcagcacctatttaattgctggacatgaactgattgaaatagaaacaaggaggcatatttgtttagggctctaatatttttataaactttttagttaaaatatttcttttattggcttaggttgagtgaatttgaaataggaatatcctacactttgtgtagtttttatatccagatgcaactagctaaagtaagtggttcttttaatctactcatagaggaactaatatggaaaagagcaagagactttgcaggatttgaggggaaataattaactaatagcaattctgtcttggttattgatgttttctcttaaatatttttgcatttagtgatgtggtccaaattcctctctgtcttttatggaagaacagattgggagttagtttgtaagttaaagttctgttgaaggga

SEQ ID NO: 167124 - DNA, 231 bp, Homo sapiens
ccacacccggcctgcttttgctctttctttgaaatatactcaaaatgcttatattggtttctaactatagatcatgaactcctgaagcaaagtaaccactttgttcttcattatttctttcactcttctactctgcgcggtgccagatattggatatgtaggtgcctaacctttgcttttctgatttcttacattttatttcataaaaatcagcctaaccacgttgtagag

SEQ ID NO: 167125 - DNA, 280 bp, Homo sapiens
aaggcttacagggcctctgggagaagagagtcatcattgtggtgcttgctggcatgctcgagggttcagtgggctccaaggataatgatgataaaagcaggtttgtttcaggatgcaaataattacagttgagtagttcactgaatgagtaggattatcgaattaggctagagactgcctttggaggtgaggagaggaaggaaacgaaggctaacaaaacagtaaacagccagtaatcattcctgcctgattttgcaaatatgctaagggactacaaaaa

SEQ ID NO: 167126 - DNA, 475 bp, Homo sapiens
aaggaaggaaaaagaaaagaagaaacaagtgaagtcaactttacatacgtagtaaaattagtcttgcctgagaatcatcagtctttcagttaggaagagaacagcagcagaaggggcacacagttattcccagacagaagatacccaattaaaaaaaatcaaaggaaagattatcctcatttgatgattaacacaccagcaatctgtaataacatcaaatacatgtagatagtcattcgttgaagtcagcaacagcaggttcgtcagtccaaaacataaatcatgttgcttggagcaaaggctttcaaaaagtatgctccctgttcatggaatttattactaattccatccatggtacatgtttggaaattcagaaaactgtgttttaagatatacattgtatttgttaaacgcacatgtgtttctctctctgtgagcgtgtatgtgtgtggagagagagagaacactaccaata

SEQ ID NO: 167127 - DNA, 320 bp, Homo sapiens
cctggaggctgaggtggaaggatcatttgagcctgggaggtcaaggctgcagtgaaccaagctcacatcgctacactccagcctgggccatagagtgagaccctgtctcaaaaataaaaagaaaaaaaaggttttcttttttaaatcttaagtgactttttgttaagaaagatgatgagttaaaagtgtgttattagttcattcttactctcagaggaggatatataaatagctgttcttgttctttcctccattcttttcaagagaatgttctatttctgtagtacatggtgacagaattacaacaggtaaacatgcca

SEQ ID NO: 167128 - DNA, 319 bp, Homo sapiens
agcaagggagagacagtgcaggtaatggaatgtcaggctgtgggaccagagtctgcaatgccaacccaccaaggttatgataggaaaataacaccttctgtgtgtttaaggaaagtaactcttttttttgagacagagtctagctttgttgccaggctggagtgcagtgacatgatctcagctcactgcaacctccgcctcccgggttaaagcgattctcctgcctcagcctcccgagtagctgggaattacaggcacacgccaccatacctgactaatttttgtatttttagtagagatggggtttccccatgttggc

SEQ ID NO: 167129 - DNA, 135 bp, Homo sapiens
agtgaaatgcttcccgcctcacccatgctatttatctttgctcatgtggaggaattagtgggactttgggctaatcaccttgcctttcaaggcctcagtttccccatctgtatgattaggtggttaggcccgaag

SEQ ID NO: 167130 - DNA, 415 bp, Homo sapiens
ctatggaattatagccttttttttgttttttaaatcaaagatttaaatttttctcaaatgcatctttatgattgaagtctgcttatcattaacatttgatatcagaagcactaattctttgttgtagccttgtttcatcaaaagctgatcaactatgtctgtatgagtctgtcagagagctgaaaaagtaatcaaaggtcaagatggaagctgcagctacatacaggatccctgtgccagatcatgagagctgagagttacgacacagatagttctgggtgaaaagcttactagtaatagagtataatatgttttaatttaaaaacaatttactatatttaattcaaactaaaatcataaaatcattagaataaactatagggataaattttaatgaccttggcaacaaaagaaa

SEQ ID NO: 167131 - DNA, 1168 bp, Homo sapiens
atttgtgtttcgtatattactgaattgttgaatttgtgaaagagtcaattttaaatcacagtcatttagtagtagaatatattgttaccatttttaaagctcttgacaaaatttctcattttcttgactatttaatatatttagggctggcactcacaggtctagctactgggatgtgggaaacacgagtaatgagcaaggcaggttcctgctctcatggagcttacaatcaataggttaccgagcatattcgtctgctacaagtttgattataggacactttgtgttgagtagtcttgttctatttgagtacttgtttgagcttactcctgtttattttttaattgtattgctataactgttgactatttttttcgtgcacagttcgaaaatagtggtaaccatttgtttgtacacattgtgccattgaaaactacgtttttacagacacttatgtaatatatacatgctttggtaaatgaatggatgaatggctctgtcatttgacatgtcttttaaagtctaataatcatgtataaaaaagataacggttcgctgcatctgttacctttaggagtatgtacaagtggaacattatgttttcagtagtgacctgttttgactgttacattcttgacccttattaaatagtgtcttgaaagaaattaaggtaatagagaataacatagtttctatgagtagttctctctacagtgaaaagtggttcctttttgatttggggaaatatatatatgtatagacttttaggtgtattagtaaattaaagtattttgtgcataagatggaaatttgaggttactagaccagtaattctcaagaactaattgcatagttgatttaaatgttttaaaaattaagtggggaccgggcacggtggctcatgcccgtaatcccagcactttgggaggccgaggcaggtggattacctgaggtcaggggttcgagaccagcctggccaacatggtgaaaccccatatctactaaaaatctaaaaattagctgggcgtggtagcaggcatctgtaatcccagctagttggaagactgaggcaggagaatcgcttgaacctgggaggcgcggaggttgcagtgaaccaaaatcgtgccactgcacttcagcctgggcaacaagagcgaaactccatctc

SEQ ID NO: 167132 - DNA, 766 bp, Homo sapiens
agatccccaggaagagcagagaaaagaaagaatgaagaaaagtgattttaaaaaaagatcttactgtgaagaacaaatgaatggatgaatggctctgtcatttgacatgtcttttaaagtctaataatcatgtataaaaaagataacggttcgctgcatctgttacctttaggagtatgtacaagtggaacattatgttttcagtagtgacctgttttgactgttacattcttgacccttattaaatagtgtcttgaaagaaattaaggtaatagagaataacatagtttctatgagtagttctctctacagtgaaaagtggttcctttttgatttggggaaatatatatatgtatagacttttaggtgtattagtaaattaaagtattttgtgcataagatggaaatttgaggttactagaccagtaattctcaagaactaattgcatagttgatttaaatgttttaaaaattaagtggggaccgggcacggtggctcatgcccgtaatcccagcactttgggaggccgaggcaggtggattacctgaggtcaggggttcgagaccagcctggccaacatggtgaaaccccatatctactaaaaatctaaaaattagctgggcgtggtagcaggcatctgtaatcccagctagttggaagactgaggcaggagaatcgcttgaacctgggaggcgcggaggttgcagtgaaccaaaatcgtgccactgcacttcagcctgggcaacaagagcgaaactccatctc

SEQ ID NO: 167133 - DNA, 384 bp, Homo sapiens
ggagctccccaggtagcattttatgaactgaataggaagagggaagggcttctctcccagcacatgccacagttaccagattaagccggttgccttggtaaccttctctctgggcaggatttgggaattgttggttaggaagggcgaattggggagtgtgaagggtgtagggggttgaaaataaaacagactgagagacttctggaagctagaagcttgggacacaggaccccagtactcccccaaatgctcaaggatgtcaggcagagactaagttcaacattttgaatcagtgaggagagccagcatcagtatttctgagaagcttccctgtgattccagtgtgtagtcagggtgaaaaccactgccactccaggaggacca

SEQ ID NO: 167134 - DNA, 242 bp, Homo sapiens
gttacttcagttttttacaattgtgaaaaacattgctatatacatttgtgtgcaggctcttacgtgaatataagtcttcaattcagttggattgaggagtgagactggtgggttgtatttttaaagtatgtttacttttgtaacaaacggccaaactgtcttccaaagtggctgtactcctgcattcccactgcagtgaatgagaattcctagtgctttgcatctcaccaacatttgcattt

SEQ ID NO: 167135 - DNA, 477 bp, Homo sapiens
ctgtgactggctttttttgtttatcatgttttgcctattctggatatttcatataaacagaatcatatgatatgtggtctcctgtgactggctttttttgtttatcatgttttgcctattctggatatttcatataaacagaatcatatgatatgtggtctcctgtgactggctttttttgtttatcatgttttgcctattctggatatttcatataaacagaatcatatgatatgtggtctcctgtgactggctttttttgtttatcatgttttgcctattctggatatttcatataaacagaatcatatgatatgtggtctcctgtgactggctttttttgtttatcatgttttgcctattctggatatttcatataaacagaatcatatgatatgtggtctcctgtgactggctttttttgtttatcatgttttgcctattctggatatttcatataaacagaatcatatgata

SEQ ID NO: 167136 - DNA, 414 bp, Homo sapiens
aggtcagatgtaagttaaaatgcaaatattcccttggaagggtaacattttgctgttaccattcacctaaagaactgaaaggaggctcagttaacagagaaagagaagccgtaagggtagcaaaggtgtagcttcccaggaagatgggagctgatcaaaatctaactttgctttccttgtgctgtatctgggccaggcccagagaacggtcaccctgagtgactctctgtgaacagggcatttggtttctgcaggcttgccgtccccatgtgcctctaacatcctcatgcttaatagcgtccttgaagtgtgctgttcttcttacataagtgtgcttcctttggctaatcagacagaagttgttaagcatctctggagagtatgagaaaagctattacaatatcaaaaaaaaaa

SEQ ID NO: 167137 - DNA, 512 bp, Homo sapiens
tgataaatggtgactattagcctaaggaagagacacaatgagtccacaaaggagatgcctgtgaaacaggtcaaacaaactccgatttctataatcccttggaaacagaaggaagcactagaaaacttagcatcttttcttttcaacagcttatctataatattccttttctcactgccactatttataaccttcaagtctcattgcctcaatattcctaaattactctttttagatattattttaaatatgagtaaattcattaaataaacactgtaatattttatctagctcattatttccttacaaattttagtgaaacacttttaaaaaaagatcttccctctggtacaagttggtgtttgaaaaaaaagaaaaatgaaaatgaaaagatcttccgaagggtgaaaggcttttctttagggtcaccttatatgtaggtattctctctcttttcctctcattctctaacaccctccctctcctgcatagatgtttcaggtaccgtgctc

SEQ ID NO: 167138 - DNA, 421 bp, Homo sapiens
agggtgggaggaagtgaatgaagttccaaagccaggaagctaggcacaaccctgtgagtagtaccaatacctaaggatggtttctcagggacactcagaaaaaagagcccagtctcctgagagcaagcatgcagccctatccccacattttcccctgaacatggtcctgtccaccaaatcaggcctgaggatcctgaaacacctccaggccctgggccctcacccactagacagcccaggaaccaggagcctaggcctgaataatgggaagctctggtactgggctttatattcctgcattttcaacaggaacaagactatgatgtgtggggtttcacaccctttctccctcccttttcctctcagagccacctttgtctttgccaatttgtccctggggtttggtgacacagaggcagtg

SEQ ID NO: 167139 - DNA, 508 bp, Homo sapiens
tgatctccaaaatcattgcagcaattacaaagaaaattttcaaagaaccatgatggcaaaagctaagaaaatggctaaataaacatggttagctttatgaaaatgatattaaaaactatggtaacaataataaaggatcccatgttcctttattatattattgcgctaagtcgaaaaatggaaaattttaagaaaatactcaaaagctgttgcccacttttctgtatttttctttgttttgatttctctgtattaaagctggtttcactggtatagtgggaggaacactttttaaatgaaagattcctaatgatgaagcccctgaagcaccagaaggcaccttgatcttttattgaggagtgctgcttacctatagcagaggaacactttgatactgattccgtgtttacggtattaagggttgatttcaggcgttcttttaaactttaatgaaaaagtggagtctcctaactatgatgacaatcaaataaaatacataaagtaactt

SEQ ID NO: 167140 - DNA, 366 bp, Homo sapiens
taggcacatgccaccacgcccagcttacttttgtatttttagtagagacagggtttcaccatattggtgaggctgttctcgaactcttgacctcaggtgatccacctgccttggcctcccaaagtgttgggattacaggtgtgacccaccgcgcccaaccttttctttagcttttattgtaagaatacagtatacatataacacacaaaatatgttaattgacatatgacctgtaaggcttccagtcaacagcaggctactaagttttgggaagtcaaaaattatacatgggttttcttttttctctttttttttttctttttttttcctgagacagagtcctgctctgtcgcccaggatagggac

SEQ ID NO: 167141 - DNA, 327 bp, Homo sapiens
aggtgcaggcctgtgggtgggcgaggccggatcctgcctgtgcaggggggcaggtggccggtggaggggagccaggggttgtgcaggctgcctggatgagtcggcagctaggactatgtccttgatgggcccccaagcaccctgagcctcataggtcggctgggtagaggggacgcaggccagtgctcacagctgcactatcagagcatgtttctgggtggcccagggtctggcaggctcttggcacccagtgcccctcagctgtgggagccatcttcactgtcccagaccccagctccacccagggagggggcagcagggcggccg

SEQ ID NO: 167142 - DNA, 231 bp, Homo sapiens
cgttggggaaggaaatcgctaagaagtgtgaaaccacaggagacattgcccagtacctcggctggtgatatcagccccacaaagcccttagtgatctgaaagtttcctctcccagtgcagaaatcattccagatttctctatagaggccaggtatttgccctaaagagattcaatcaattcatgagaatcaaggagtagatctaaattaaatttgatctttcttaagtctg

SEQ ID NO: 167143 - DNA, 342 bp, Homo sapiens
aactagtcttatttggttcactaaaaccatgtaatgtggttctccttccccattcgttggttaacagtaaacaccccccaccccccgacacactgtgcaaaagtttccatctcccaaatgtatgaggcatttgatatttgatgtcataaacgggtttttcttaactcctatgaatattcttagctccttctcgtcaggaatcgcttgcagctcttagatgatgtgaatcacctccaaagcatttgttttccaacattcaaatgcattttttgaaaacgaacatcagctgttaaccagagctttcccaggtgcagcagaaaccctcttccacaaggctttacc

SEQ ID NO: 167144 - DNA, 335 bp, Homo sapiens
tttaattctcagaacatccttaggaggaagatgacttttccatcttacagattaagtaacaggggcttagaaggtgatggttgtacaactgataaatagcagaggtaaaatttgaaccaggctctgtccaattacaaagctcaagttcttttaccatattatgctacttctctaaaaaagtgatgatgagctgagtgcagtggctcatgcctgtaattccaacccttgaggaggccaggtgggtggatcacttgaggccaggagttcaaggttacagtgagctatgattgagtcattgcaatccagcctgggtaacaaagtgagactctgcttgt

SEQ ID NO: 167145 - DNA, 473 bp, Homo sapiens
taggattttatagatttaaaaaattatgttaactaagaaaatatagatggaagaaatgagtatctgttgagtgttgtattctgggctagacatcctaatatgttctatgcatatatcatctcataaagccatcacaacatctgtgttcctataacctactgtttattaaataaacaactatggattagagctgattaattgcctcatgatcccatagttaacaaagtagctggcctacagtttgaccatcagcctgcctgccttccaaatcctgtctcttgctcctcagcatagattgacagatatctgtgcagcccttggatcaaggtataggtctgaatcagattagtcagattgattaatttgattaatgtctaaattaatgagagtttaaataccttgaactctcatttaagtttatcattagaatgtggttagtccaagagtttgtcctaataaatttgacaatttca

SEQ ID NO: 167146 - DNA, 465 bp, Homo sapiens
aaaagcatatgaaaggagatgtgagtcactgggctgaaggaatacatgccgctttgatttagcagtcactaagtcatgtcctgctacaagcaggactcccatgacaccccaggccaccaccacctgagtctcatctttgaatgacttctacatgctatgaagagcagctgcagattcagatgtgcagatgatactgtatcatgtctctcaacctgatttctaactttgagttctcgtgccactggacgggtggaaaacttaatttgttattcttgagctatccctcctcggagttatatgaggtttcaggtgtccctagacattaacagatataggttgcccttgagacatcatcctcccatctttatggccactcaggccctgcttgggaagtaggaatcttttacctatggtcacctatggtcctatctgccttgatgtgctagcactaggtgactacctgtc

SEQ ID NO: 167147 - DNA, 503 bp, Homo sapiens
aggtggttgacctgcccaggctatacagctagaagtgccgttagaacttggtacaggtggaactgattctgatacttgtctcaaactgttaccagtggagggtgttcaggttcttggtgtcttgaacaaataattggacaaaacggcacaaacaaagcaagggaataatgaagtaacaaaagcagagatttattgaaaacgaaagtacatttcacagggtgggagcaggctgagcatgggggctcacgagcgctgttatagaattttctgggggttaaataccctctagaggtttccattggttagttggtgtatgccttatgtaaatgaataggttaaaagttacaaaggcattgtatgccctatgtaaataaagaggatatttcggcggggagttgtggcttacacctgtaatcccagcactttgggaggccaaggcgggcggatcacctgaggtcaggaattcgagaccagcctggtcagcatggtgaaaccccatctct

SEQ ID NO: 167148 - DNA, 120 bp, Homo sapiens
gccgggaatttaaatttggtttcagtctgggttgactgggggattatgctgaaggggtacatctcccttgcctctttctgatccatgaagttctcccccagagttggggcaggagggagg

SEQ ID NO: 167149 - DNA, 296 bp, Homo sapiens
tcgttccctgcccttaacgagttttccacgtagttatgaaaagataactaacatcataaagaagtacttgacaaggtcgtagcactcaggatggtcattttagaccaattcccgtaaaggggagaaatgagagaaaaggctgaagaaattagctggcagccacactgagaggcccttggatgcccatctaggaaagagggacttgactcagctgctggagcacgatgcttgaacaggagattgagagggctggaattcagccctaggaggactgatctggcatccgagtataaagt

SEQ ID NO: 167150 - DNA, 435 bp, Homo sapiens
agaacattaactgattgtctacttctaactactagcagagctgggcccagcccatactcctttcactgcactgtgatgtatataataaactatatacttgtcataccatatcttagagcatactttttgtttttttgagacagagtttcgttcttgttgcccaggctggagtgcaatggcgcgatcttggctcaccgcaacctccgcctcccgggttcaagcgattctcccacctcagcctcccaagtagctgggattacaggaatgtgccaccacgcccgggtaattttatatttttagtagagatggggtttctccatgttggtcaggctggtcttgaactcccgacctcaggtgatctgcccgcctcagcctcgcaaagtgctgagattacagacatgagccactgcacttggcctagcatatattttttaa

SEQ ID NO: 167151 - DNA, 377 bp, Homo sapiens
ctacataatccactgatacacacacactaagaaatcaaacatttccaattccataaacataatacatctgaagcaaagataatgccaccaggtattttttactttataagttggtccccagaaaaggataattataaaagacaccaggaagcctcttttcaaccttgttaaataaacgacttgcaaatattaaccacaaaactgtgggtgaagccactctgtcctgtcatgattactcgctcataaaggcccaaaatgcgtcttgaagggagtttttgcaatacaaatcctaatcttaattatataaactctattcttaactatcttaaaatacattacaaaagaccattctcaactttctgaaaactttaatatct

SEQ ID NO: 167152 - DNA, 481 bp, Homo sapiens
ctgctgagtagagcctttattccttcatcatcatgcaaagtctttctagtagctgctgcccactcttcctggaatgagcaaaaatgttttgctatgtgaggagtgctgagtgaattgattctatcacttgtatacttcctggaagttgatgtgttttttaaaaaaacaaaaaggacaaagatggaaccagcatgagctttgtaacaggaccagtttgctgagaatacattatattaaaggtagaataatgggaagacatgattttgattcaacagacataataaataacgtactgaagtgaaagaagaccataaatcctctccaacaatttttttttagtttttaatttttgtggctacacagtagatacacacacacacacacacacacacacacacacgaggtgtatatatgtatggggtacatgaaatgttatgatacaggcatgcaattcataataattatatcatggagaacagca

SEQ ID NO: 167153 - DNA, 2341 bp, Homo sapiens
  misc_feature (935)..(935): n is a, c, g, or t
  misc_feature (1419)..(1419): n is a, c, g, or t
cttttctctcgttaatctgttttttgtcatgggggtattggccatggaccttggaatgggtgaggaaaaggtactacacctctttgccctacaaaagcaggctggcaagtaggatggcccagcacctattgcatgccaagtgtcttcactcaggcagttccatccgtgtctaaacaacctcgcacttttcacttccccactttggggatgaggaagctgagactcaaaggggcagattattcgtcttagatcactcagctggcaaatggaagaaatagtgtttgaaaccacaatctgttgcagcctcccagatgggtacctgcccaccagaaggtcttatgcctagtgttccattattggaatgctaagcaggtgggagttatttatatcctgcggctcaaggtcatcaccaaggcctgatttttcacacacgtctgcaattcaaattgtaacctctgggccgggcacagtgactcctgcctgtaatcccagcactttagaaggctgaggcaggtggatcatttgaggtcaggagtttgagaccagcctggtcaacatggtgaaaccctgtccctactaaaaatacagaaattagctgggcatggcagcctgtaatcccagctacttgggaggctgaggtgggagaatcacttgagcctggcaggcggaggttgcagtgagctgagaccacgccactgccctcctgtgtgggcatcagagtgagaccctgcctaaaaaaaaaaaaaaaagtaacctcttaagctctctccttagcttctgggaaaaatgagtaggggaactcattcacactagaattctaatataggttaataatatcctctttcccagggggctccaagatgtggacccaagtctcacctttctctatctccctcacagccagtcatgaccatgcgatggcctcggaccgtagnaagtagtttaactgaactgtttctcttgggaatttcccctaaagctgaggcatttccttctaagtctcactggaaagttcccaagagcccacgaggtcaaggctacagtgagtgatatttgcaccacagtgctccagcttgggtgacagaacaagactctgtctcaataaatagattaataaataaataaataaataaagtactgaaatctgtattggcaggtgcatcaagacgtagaaactctccttgctcattttggttctgtgaacttccaagtacctttgagaacccccaaggaatccaactcgatttctttcctttcaacttaacccattttctaaataccgtgcatctcagctctgtgctaaggtgcttggattgtgctgaagaagtcataatctccatccttaaatggttgtacaaactaaggaaataaaagcctctcagtggatggtatttagagatgaaagaattatatacaggnaggaaaaatgtagagtgaggcttcccaactgggcaagggaccctcacaggctgttacttgggtcccccagtgtcctctcaagttttgcctaggattggggtccccaggtgtgctgttgggggcccaggccccacaagggtagctctctgaagaggtccatttgtccctactgactctgagggcacagctgttgagatctgggtccctgggatgagcatctggggagctgcctctaggctagccttctcttggtgtactccctcagcattcctggagcctggttgggggctggccctagggagcccgcccctgcctgtgcagagttgctcctggcccaggggagagtgaatgcattgtgctcaggcctcagtaagaggcagccttggcaaccagaatcctgagggagggtgtgcctggcaggtcccctatggactcaaccagccactgtcctcatcaccaagcattagtttggacactagctgcaccctgctaccaacaagagatcaaagaatcatgtctgggacatagagtccagagacctgggctctagtcctggccctgtcactaattctcggggcaaacttggtcatatttgttacctcatatgtgccagacactgtgcaagatacttcacatacttaaggccaggcacggtagctcacgcctgtaaccccaggactttgggaggccgaagcaagtggatcacctgaggtcaggagttcaagatcagcctgaccaacatggtgaaaccccgtctctattaagaatgcaaaaattggctgggcctggtggcacgtgcctgtggacccagctactcgggaggctgaggcgggagaattgcttgaactcaggaggtggaggttgcagtgagctgagattgcaccgctgcactccagcctggatgacagagggagaacatctc

SEQ ID NO: 167154 - DNA, 133 bp, Homo sapiens
tcaaaatacataatcaaaattgggaagagtagaaaacttcaggaaacgtatttatttgttccagagatttctgaaaataaatgactcaaataattgtcaaaaatcataagcaaactgaatagaatactgggag

SEQ ID NO: 167155 - DNA, 100 bp, Homo sapiens
ggcaccagaaccctgaacccctaaccccaaggctcagtcccttacaaggaaccccaaacccttccttcttatttaggccatcactcctcaaaccctgaga

SEQ ID NO: 167156 - DNA, 497 bp, Homo sapiens
tagcttaacttttaggtagtgatttcattttccttattttcagggtcttggggaggcccctgtaagttgcttccatgtctcagcgatacattcaaagatatgttgagattgatatgaacagacaggcagatagcctggccatcttactaacattagggcccaagatcatgcactctgtctaggctgtctaactgctctaattgtcacaaaaatctatttcagtataagattgtaaaaattggtatcgtgccggggtcagtaattacatggtctttccccaacacagcaaaaggatgtgtatattgacaaggaaattacaggattggacataaacaattcactacacgaggggctttggcagaattgagagcatcactttgaaaaagagataccttgggaacaaaaatgtaacccatgaagaagacacctctggccatctctgagaatcataagcataattcatgatatctaataattacaacattaagtctatattt

SEQ ID NO: 167157 - DNA, 688 bp, Homo sapiens
gggacagtcaataataataatgatgataataagtcataacatgttagcaatagtgaatggtatagaacgaacaagagtaggttaagggggtctgggcgtagtggctcacgcctgtaatccgagcgctttgggaggcagaggcgggcggatcacctgaggtcaggagttcgagaccagcctggccaacatggtgaaaccccatctctactaaaagtacaaaaattagccaggcatggtggcacacacctgtaattctagctactcgggaggctgagacagaagaatcacttgaacccgggaggtgttgcagtgagctgcgattgcaccactgcactccagcctgggcgacaagaacaaaactcttgtctcaaaaaaagaaaagtacataatacctactttagagattgtcatggaaatataaagtatgtggtccttactaatgctagataatgctttgtttactttgatttgcatcttaccctcttccgtgagtattgatactgtcttaaacatagtagggtttgattagatatttgctggttgccccttcacttgaagggatacatacaaatgttggtttgtattggataatgaatatgatgttttaacgagtaatatgtgagtttgttactttttgaagggcttaacaacattaacctagttaaagaagtagaacattaagtctgga

SEQ ID NO: 167158 - DNA, 360 bp, Homo sapiens
caggttagggcttcaacatggaactttggggtaacactattcagtgtgaatgaaatctttggcctctcaaatacagatttgtgattcaaagacttcagatttatgaaattatcagcaagattattcaggaattgttcgtgtgcagcctttctgctttttagcacaatgagatttctaatatgtaattgaaggcctcacaactaaaatatatttgttttctaccatgaatctctgtatttttccaaatatggcatttccagagttttcttcataacaaaatgaccttttcctctattcttaactaaatgatgttacagttaaggatcataaagttccgttgaagccgttttaatgaaatac

SEQ ID NO: 167159 - DNA, 112 bp, Homo sapiens
cagggaaagggatggaactaagatttgacctctgttctaacttcagagccaaaatctaaatcacaacgttatactatcttgaaaactagcctagcttattagtgtgctgggc

SEQ ID NO: 167160 - DNA, 527 bp, Homo sapiens
aatctagacataaactgaagagtagttactttgagagcagaagattggggtcgtggagagtggggaggtcagtgagtatggaaggagactttgcttttactgtacgaccctctgtaatgtttaaaattttcaaactttatatcttgatcatgtttacaatcgctacatttttaatttaaaaagattgtttctatcagtgaatcttgccaagaaaaagaggtggcgatagagaaaaagagcaacaaatcaaaagagattatgattatattgcaataaagctgttttttaaaaagaggatatggattttagaacattaggaaacattgtcctaagccatagaaaccactgtttaaaacctgggtacgactacatggcattaatgagtctagtgctgctcagaagagagaaatgctagaggaccagatatttgtattattttaagaaatgacttctattatttagaaaatttattattttaaatttatacttatttaagtattaaatatttaggtatatctgaatttaaa

SEQ ID NO: 167161 - DNA, 421 bp, Homo sapiens
cagttgagggaccataaacagcagagtagagaaaggtctcaattgttattataaccaatagccccaagctatccaaactttggggtcaatatctcctttaatattcaaataatataacctattccttcaccttacataaccttggaaagcacagacctgcactagcatttcaaaggcgtccttgagcaccactgccctatcttagcagcatagctcagagctgctggttacttcctgctccaggctgttgtgctaatgatcactttgttaaaaaaacagcttcattgaggctgggcatggtggctacacctgtaatcccagcactttgggaggctgaggtgggaggatcacttgcgcccaggagtttgagaccaggctgggcaacataatgataccttgtctctatttttaaaaattaaaa

SEQ ID NO: 167162 - DNA, 735 bp, Homo sapiens
gcgtaaatacccagtagtcggattgctgggtcaaatggtagttctacttttagttctttaaggaagctccatactgttttctgtagtggttatactagtttacactcccaccagcagttaaaaatgttcccttttcaccacacccacaccaacatcaattattttttggtttttaaattatggccattcttggaatgcaggaaatgttaataataagaaacctgaacagtgtatctatggggatccaaacagtgctaattgcccacaggtgaactaagcatatgcttagggtgtttgcaaaaatagagtaccgtatgtttttaaaataatttaaattattaatttttaaaggcataagagtggccattgtgaggaaatttagaaatctgtcaagcttccttacatgtttttttctcttataggttagtattgtttttattttgaattacatagtggggatgtatagggagggggaagtctatgattttcagtcctttaaaggttttagaccttaatctgaaaaattcattgttcaagccaggagtaagtgagtcatatgtataacagacttttttctagtattccccagggcctcagaatttcagtctttactggtcagatattccctctccttttgcttgtagcctctggtcaatttgaaaggttacccaccataattgggttgtttctgggctctcccaagttaaaatcttacatctatctgcaacaagtggc

SEQ ID NO: 167163 - DNA, 210 bp, Homo sapiens
agaagattagtgcaggtaaagttgagtgattcctggtaagctgtgtgagttaaggcaaaatggattgagatggtggtaggggtgggatgccagattcagaggaaccccagatgcaggcaggaggtcaatttgtattcatacacagacttggagatcttggccctttaccatcaggaaggaacttagaaatgttgtggctcgtgcccctta

SEQ ID NO: 167164 - DNA, 435 bp, Homo sapiens
attgttcaatgtcctcttcttcatatcaaataacccttttttacccctttactgacatgtataggctaatatggccaactcatacttttcttaaaagcattctttttcactacaagtttcagaaaaaaaaatcaaagtctttctaagccttaccgagtttctgcatctataaaataggggttcataataagaacaagtatttggccagcttatgcacattttagcccaccgttcttttcagtagggagcactgcaaaaccaaccaagtgaatcatgccaagctttattcagtttcctcacctgtaaaatggagcactaaatatctggctagttctgcctacagggttgctgtaaggaggcaatagatgtggaagtgctttgtaaactgtgtaggaattcacatattaaaggaatcatctttaggattacttgttc

SEQ ID NO: 167165 - DNA, 354 bp, Homo sapiens
catttaaagcacttcatatataataccttatttggcttcatatctactgtgagcaagcaaaacaaaaaagttattctcattttacagacaaggaaaataaagctcaaaagccaagtgacaaccaggaaaagtaacccacaatgagacatattaaactaaaattattggaatgtatagaaaaaatctgggtgtccaggaaaaatgaccaggtcactccccaagggaaagaaatgagaccagcatgagactttatgtaggatgacaatggagtaacagactttagataattaaattaaaaaatatgaaccaaggatttcttatttagctgacatgaccttcaggtataaacagcac

SEQ ID NO: 167166 - DNA, 266 bp, Homo sapiens
ggagatgctgagtgccagagggtactgtaaggagagcttgtgcagctgatggatcatgcatgatgcctgtgaacaattgtcctactagacctcacagtagttagggatgtctgcagtcatctcacagtagagcagtagctcagctttggagttttgtttcttgaatgtcttcttttttaaccgtacacgtgcttgagctcactctgataagcccattacatttgaatctcagagagcaaaggcagcatctccatacttgttgctga

SEQ ID NO: 167167 - DNA, 262 bp, Homo sapiens
ctctcatctgtaagcccagcactttgggactcattcttgcaaacatggctcccctcatttctacaacatcacgcagacccagtgatcaaatctcttttcctgtgtacatgtctgagataatgggaaagtccagaatatagcacacatatgctatgaagagctttcctcccagatggtatcaaaataagtgaagtttattatctagcacctcttatccaacaaagcagattacaactatgattacagaaatgacatctacaaa

SEQ ID NO: 167168 - DNA, 327 bp, Homo sapiens
agcgggggggaaatcataaattgatttagcaggattcttgctaaaattggtcctacaggtcttgaataagcttatttcttatttcttataagactgtagggtatactcttttcagtcttattactaattctttatcagtaatatgtattcatctttactgtcttgtgtctttttgctgattcttctggtcttaaggcactctccttaataagttttgaaatctgtccagaactcactgcagccaaatttcctggatttgtttactgtacctgtgattcagctggagatataattcccaaattcatatttttagcatgctggtggtca

SEQ ID NO: 167169 - DNA, 179 bp, Homo sapiens
cttagtgaatgagtctgggtcatggctggaccggagaaatcccagggtgagccagcccaaacacaccatccatggaataaaaaaaggaactgctactccaatggtcagccctgtgagaaacgcatccttccatccagctaaaatctgcctgtgtccatcttgtctgctcaacaccagtc

SEQ ID NO: 167170 - DNA, 142 bp, Homo sapiens
ttatcaatggactttagttcttttgtgtaaattttagtgtcagttggccccattccccagtgggataacaataataagtatcatcaattttattattacttcttgttatgctagcattccaagtctaaccttcaattcctta

SEQ ID NO: 167171 - DNA, 228 bp, Homo sapiens
tgctcaatgccgcttgctaaactgagctgaagacatgcctcccgattccaaggagtgcacagacaatgtgggaaacaagtccagaaataactggaacatgagacatgatggcaggtccacaaatgaagcctgaagagtgtcacaggaacgctaagcagaggcagacggattcctcctgggggagaccagggggggcttcactggggaagtggagtttcatctggggat

SEQ ID NO: 167172 - DNA, 255 bp, Homo sapiens
agttacagtctacatggagtatttcatgaaactgaatgaaattttgataatttggtagcttgactggtgctataattctactatttaaaatgatccatttcttatggaagaatgcatgttattgggtgaatattactgcattttcctctttgcttgatatgttttaagacctctcaattttctcattgtgtcaatgtgtgttgtgtgggttgtgtctctgtgtctccttgtgaagtagctgaactctttagggtt

SEQ ID NO: 167173 - DNA, 326 bp, Homo sapiens
attcaatacccaaaccacatagctgccaacttccacttcttcacttttgttctatattttgatttgggaagacacaaagctaagagaacatgatgtatcccagggagtggggagagtatagcatcagttacaaaatagggatagccaaaagtctgattttaagccagttattaatctaccttacctcattttattaaattattctgtagatccaggacccaagagatgagaagagtcaatcaagctattcatgataggatgctaaaaagaaaaaggcacagagcaaaatgaatgatcacatcagggcggctcagaacaaaaggcga

SEQ ID NO: 167174 - DNA, 284 bp, Homo sapiens
gcctccctgtaaactctctgcttctgctcttgctcattccccagtctgttcatttgcactgagtgattttatttttctctcttccgagtagcggagtgacctttttaaagtgcacagccttatttggaaggctgtggtgggaggatcgctggagcccaggagttgaggctgcagtgaactatgatcatgccatggcactccagcctgggcaacacagtgagaccccatctgtaaaaaaatatataaaatgtgcatcttatcctagcacccctagtaatgcttca

SEQ ID NO: 167175 - DNA, 264 bp, Homo sapiens
caagcaattcccctgcctcagcctccagagtagctgggattacaggcgcatgccaccacgcctgcctaacttttctgtatttttagtagagatggggtttcaccatgttggccagactgggctcgaactcctgacctcaggcaatccgcccattttggcctcccaaagtgctaggattacaagtgtgaggcaccacgcccagccacagaacacttttaaaccactgaactgataaaggggctataaaactcttctatttcattc

SEQ ID NO: 167176 - DNA, 322 bp, Homo sapiens
gcttactgcaacctttaactcctaggcttgagcaatcctctcaccacagacttttgagttgctaggaatacaggtatatgccaccacacctggctaattttctttttattttttattttgaagtggtggggtttcagtatgttacccaggctggtcttgaaatcctggcctcaagcaatcttcctgcttcagcctccaaaagtgctgggattccaggtgtgaaccaccgcaccctgccataagttctgaccagtgatatttaggtggaagtaccatgtattacttgtaggaagtatcttccttctcctgactgcaaggatgg

SEQ ID NO: 167177 - DNA, 247 bp, Homo sapiens
ccacagacttataattacagcacgtttgtacaacctgaaacttgggttcattcccatcctgccattagctatgaattatcctgcagacacatttattctttcaaccactgtcctgttccagagggtccactccctaccaggcccacaccaaggcaacaatctccaaaaagcagcgagtgacagaaacgagcctgtggatcatgagggccaaggtacgctgaaaaatgaaatcgacaagacagcatcc

SEQ ID NO: 167178 - DNA, 599 bp, Homo sapiens
tgttaaaagcatgggtctgaatcccagctctgtcacttattgtgaccctaggacatatttcctattgcccagtgtttcctccaccataaaatggagattataatcctcatctggttgggtttagctggggattcacacaaaactgctagtgctgttggctcagcactgcaaagcacctgcagctccccggtggacgtcaagggatctgaaagtgcagagggttccttagccctttgtgagaggaactaggaaaggaatccactgttcacctaggaacatttgttaaccctttatttcccactgtgggccaagggctaagtgtgcagatggacgattctcctcctgggggcatttgtgacgtttctccagtctccaatatctgccactctccctcttgatacttgcaaagatcattactgcttcctgacagctgcggctacccccactgctactggccactgataccggagatagaaattatttaggcagatattcagggcaaaagagtcctcggcggaatttcccttctaacaaaaaagcagccccagaaatcatttcttttctaacaaagagcagcctgaaaaatccagctgcaaaca

SEQ ID NO: 167179 - DNA, 566 bp, Homo sapiens
aattaagtaggagactttcaggtgggtcttatgtggcctgaaaagctttccttccagatggttctgggtggtacctatgactcaacaaatcacaaacccaagttgttaggataaactcctggttaatgtatagaggcacaatcttaagtagtaagctgtttcctcaataaacccatgtgctttaaaatgttttaactagggaaaactttttaacttattaaaattgcttagaggaaaatcattctagagcataattttcataatttaacactacaatatgtaatataaaacagtgtaactactcgttcactctacgactcctgaaacatacagtctttagttcaaacagactgaaccaagcctcagacacaagattaagaagaaaactcaggccgggcacggtggctcatgcctgtaatcccagcaccttgaaaggctgaggcaggtggatcacctgacatcaggagttcgagaccagcctcagcaatatggcgaaacccatctctattaaaaattccaaaaactggccaggcatggggcgtggtggctcacacctgtaatcccag

SEQ ID NO: 167180 - DNA, 144 bp, Homo sapiens
ctgttttgagatatgttaaagatgaaggattttggtgtcaaatatctttaggtccaaatcttggtccaaccatgttctagcagtgtatccttgggccagtaactacactgagcctgtttttttgttttttggtttttggctata

SEQ ID NO: 167181 - DNA, 554 bp, Homo sapiens
ccagtatcttattattttattaagtgtatgtagaaataatgatatttaatttttgcatgccaaattattttcatttacttttacattccctttaccccaacatttaaatacaatgaaattgtagtaatttatgtacaactaaatacacaacatgtaatatctaagcaaaacttacaacaacataggattgaaatagacaagttgtgaaccattttgttagaagtatttggtgtgccacatttactgtagtatgtgtccatagattgttgcatttgtaatacctgttctaaatatgggaaacttggttgtaatttatgctaagtatgtgagaagctataaaattgccatgtgtaggttactatgggcatatattattaatggaaactaactaaaatttgctgctgaaagtcactgaaataaagtttagtaaaactttgtaaatcttgctttgaaatattttaaaaatgtatacaactttaagctctaaactactcttagaactgtagaccaaggtaggcaaattagggcctgcctggtgcactaccagttttgtt

SEQ ID NO: 167182 - DNA, 251 bp, Homo sapiens
tagaggtttgacctaaggccagcccatcttgcaaatccctgccactaatctgagggtcagtgaacaagggaaggatttggatgtctccatgcaacccacccccacagctggatacagtaactccatcccaagtcctactggtgagtttcatccccttaactgaaggaaacacacacacagtttggactcactcacaggtgtgatggagtctatcatggagagtgatgaaatgagatgtggctcggaaatca

SEQ ID NO: 167183 - DNA, 630 bp, Homo sapiens
acagctagtaagtgacggaggctagtttacaactgaggactgatcactgaaatcaggttaaacataaaagtaaattatatgttaacttccatattgtgtagcagttatccacctaaggttcagcagtcctgggttctaacactgaatggcatggggtagtggttagctcacctacagtggccaacatgttctagaagccatctctgcgactgtgtagatgacttgtgctctccatgctaagatttttgctggagttttaaattttcctccaaaagctgattgtcttcatgataatgagcaccagcgatccctttcctaagtctaaataatgcatcacatgttgactaaagtggagattcaacttcatggttggttgtttttacatagggttggttgtttctacatgtgttacagtgactcctaacattttctgaggtggaaagggcctaagcaatcacaaattcctttcctatattaaagctagagaatctgtgacagaataagacacggagtggggtagttttgtagttgacagcagaagctagggtttctgactgccaggtcagctttttttcccaccatatcaaacagctctctatgacaaaaaataatgcaagtcttgcagaataa

SEQ ID NO: 167184 - DNA, 520 bp, Homo sapiens
ttcctctcctcaccatttactgcctggtatccactccattccttcttcatgccaggcattcagacttttgtcctcactgtgtcccctagacacgtacactgctgtttttcacttccttctggtctttactcaagagctacctcagtgacgccctccctgccattctgaaattctcacacataccttgacatttcttatctcccctcccctactttttcttcttagtgtttataaagaacatacttacttcactgatagatctgtttcatagcttgtcctcgctgctagggctttaagtcccataaaggtatacatttatgtctgttcattactatatccttagtgcctcaaacagtatgcttagttggagctcagtaagaacttgaagactcaggctgcctccccaaaactggtcagcaggtggcaccacaggatcatacaaagtagctgtggattacttactgatggcctccaagaagtgcccatgcccaggttgatgagatacccacccctgatttta

SEQ ID NO: 167185 - DNA, 225 bp, Homo sapiens
gcaggaaatagcataatcctgtttaggttttaggaggctcactgtggctgctaagtggacagtatactgtaggggaaggtgggagcagagacatcggaggctcctgcagtaaccacgcggagtgttgatggccgcttggatgtgcacatagcgggagtagtggcagaaggagtttggccgaaggaattggtaaatgatggttctgtacagaagacagaggaacac

SEQ ID NO: 167186 - DNA, 493 bp, Homo sapiens
tacggaacacagatctgactgtgttttgtgatattagtattattagaagtagcatgcattaaacaataatgataaccattcgtgggtggatgttctctggctacctgaccctctaagatgctgcatgttcagagcattaagggacatcttgctgcatgacagatttcctgccatcaccaacccctatccaaacctgctcttaagtagaagcgtcaagtacagatctggttcttctgttgccggtgatcagatgtcctgcagagctgggccgagggcgccccctgccgccagtcagcagtccagctctgggcagcctgtgcggctgagggcagcagtggctcaagctccctggtaggtactcagagaaatgagacgagggcgcaggaaaatcagcccaagaagtgaacccggaacctggtcctgcgtctccctcaggggggcatgtgcgctgtacacaaacattgttcatcttttcctatcaggagctggaagg

SEQ ID NO: 167187 - DNA, 194 bp, Homo sapiens
ggtcacagtgaggcaaaaactctgagttatttgtagagtaccttaagatttaacttttcaaaaaccatatttaagcttagctttagaagtattcttcccagcatcccttcaccaagctatttcaattttttaaagtgaggagtagggagggctttttaaagtattattcctttatattcagtttctcttatccc

SEQ ID NO: 167188 - DNA, 423 bp, Homo sapiens
tctcaaacacttctggtcccaagagatttggataagggctattcaacctgtattaggtcctactcagttgtccccaaatgtggcccagatggctacatcaaaatcacctaaggaatgtattaaaaacatgtatattcccatgacctggctcagacattttaatttactagggtttagccaaagaatctgctaaatcaaattaaccatgtaccccaggtaactactgctgtttaacattccttcttacctcttattcctgagaagatttgagtcagcccaggcctaggcctgatatggtatcagaaaaaaaactgccctgagtgggtggagtggttcacatctgtaatctcagcactttgggaggccaaggcaggcaaatcacttgaggtcaggagtttgagaccagcctggctaacatggtga

SEQ ID NO: 167189 - DNA, 158 bp, Homo sapiens
gcagctatctccaacgggcatctgagaagatggagatggatgtagctaaaataaatgtgtgtgctggatcgaagtctagctaccaccataccttctaggctctcatccctgtcagtgacctgctgtgtgaatttcagaaatcaaatcttttatgctgt

SEQ ID NO: 167190 - DNA, 532 bp, Homo sapiens
ctggaccaaattgaagactagctaaaacaaaaggcaaaagcagctttccataagacatacccaccagtgtcccatgtcagtttactattgccatggcaacagcaggaaattactgcctttttccatgaggaggctctgacaactgggaagttaccacccttttcctagaaacctcagaataatctgccccttaatttgcatataattaaaagtgagtataaatatgcccagagtaacagcactgcctctgagctgctactctgggcagactgcctatggggtatacctgctccacaaggagcagtgcctctgctgctgtacattgctgtttcagcaaaagttgctgtataacatcacccactcacccttgaattctttcctgagcaaagccaagaacattccccggctaagccctgcatcaatatctgcagatccaaggcttcatggtgaggtgtacatgagctggatttttttttatcaggtgtttggtccaccttttccacttgataacaatccctgtggatgggactgg

SEQ ID NO: 167191 - DNA, 506 bp, Homo sapiens
gcctgcttcctcagcccccagccctcactccgctacagagtgcggtgcccatctgaccctgtgtggcatgcagtgtcctcctctgagctgtgggtatatgtgactaaaacactgctgtcaatctcatccatccacgccaggtgtcgtgttcagccatctcctacactttagggcagggacccctccttcaccaatggggtgaaaaggaagtgaccataacaactgcttaatgacaaaaggattaacccaccaagaagacatctacttcaacatcctcctcttagcaactgttaaaactaggcagaggccgggcacagtggctcatgcctgtaatcccagaactctgggaggcaaagacaaaggatagcttgaggccaggagttcgagcctgggcaatatagcaaggcctcatctctccaaaaaattttaaatttagccaggtgtgccggcacacacctatagtaccagctactcaggaggttaagccaggggaagtacttgaccct

SEQ ID NO: 167192 - DNA, 493 bp, Homo sapiens
tggtgacatcattttattataacacaaaaaggacctgatgctttgaaattactgaggtatttagagttcacatttgtttagatatgagcattcttttacgagtgtagagttgacaaggcattcaggacaaagaaaaatgagaaatgatatgacatcatttcaagtgcggaagataagtccagagaaactctacagattgattgattgattgagggctctttgaatgtgacgtcttctcaaaccatctgagactgagtagaaaacaaatattaataacatttgcagatgatacgtgagggtgagtgttacaaacaccagtcatgactaaggcaaaattaatacctttttaaggcccacagggaattgaaaaatgtggaagacctaacaaatgaggtccaacttggaaagtatgagctgacatatcaggagaagaatattctgaagcagagaccaacagaaggaagctaaagttaaagatggaaaaggattttgc

SEQ ID NO: 167193 - DNA, 994 bp, Homo sapiens
ctagtttagtaatttttatgatttagttacatatctgtacatgcataacttttttagttattaatctagtgttacatttctttatgatttagtcatatcttttttggtataagtttatttggtattaggtataactctttgctgtcctagtagttgctttgggatttatagtgtatgaatttacctcatcacaatccaccttcaagtaatattatatcatatcatagacggtataagaaattacaaccatattttcatttcttttctatcagccagatcccagcctagatctgtgggattatggctgtcgttaagtttaaaacatatttagccaatttttttctcaagttttttattctgcctctcctcctacctctttggggacttatatattacctgctggaagtttgctcatagttcactagtgtctcaaatttgtgactcttttatttcatgatggcgaattaatctatgctcatatctactcagtgcagctttcatctccagcattgtaacttgtatctctacaagtgcaatttgatttttaaaagtatcttctactgctttacttatcttcttgaattttatggtagaatagagttgagttacttataaagagcttgatccttttcatttttctttttatggtatgagctaactccccatacctgaggcaaggcctttctgagtattcattctcctgtgaagtctcagttttcccaggcaaatctataaaaatagatgctcttcttggcgctgtgtgaacaccagttgtgatttcctataattttataggccaccccccacccccacctggtttgttcttaggtagttttctagctcacatgcaatttccaaaattttgctaaatattgacagggggtttcttgccattgattctgtatctctctctcctcctcagtgtttgttctgtaatatctgtctgctttggttttaccagactctaagcttcatcaatgtaaccaagagagtc

SEQ ID NO: 167194 - DNA, 198 bp, Homo sapiens
gcactgctccgtggcactctccccgtgtcccccgcttcccctactgcatcctctctggtaatcacgttccttctcatgtgtgaatcagtgaccatcagagccggccttcactctttactattttggattcaaatctcatgtccagctgccatcctgtcacctttccttgaatatgccacaaactggactcacccaacg

SEQ ID NO: 167195 - DNA, 405 bp, Homo sapiens
caaaaaaaggccaatgtgactggtagaaagagccaggtcacagagccctgcaatcccatcaagggtgttatgttgagtatactggggatgcggggggactaaaagcacagccctgacatgatctgctttataaacagtaaggctaattaggaagctactgagatagcccaggaagagaaaatggtggcttgaggttagaatgcctacacctggactgggccgaagaaagtttttataaacatccttagaaaaacctttgactccatttacaacagcaaccaaatgtatacaaatttaagaaacaggccattcatggctaggtgcagtgactcacacctgtaatcccagcactttgggaggccgaggcaggtagatcacctgaagtcaagagttcaagaccagcct

SEQ ID NO: 167196 - DNA, 488 bp, Homo sapiens
tgattattttgatcaagtttttactttacttttaagcaaagactgaaagtatctccttatgataaatttcccaaagtgttattactttacacatatctatttcttgatacataaattattttccaaaaatactgttatcagttcacttgcctgtgagcaattcgtgtagtcacatgcccatttccctgtgtttccctggccacagtcaagccagtgtgaataaatgatcactgccacagccacagagcttgcactctcctcctcaaaattctgctccattgcccttttgaaaaatggaaatataagtgatatagttttaggtagggatacgtggtaaatttattattttcagcattgttaaaattattttctacattgttgagctgttctagaggaacctattattgttttggactagagattttttttttcgcttcagatttattaagttatgattaacaaataaaattgaatatatttaaaaaaaa

SEQ ID NO: 167197 - DNA, 309 bp, Homo sapiens
agaggtctgcgaaccttctctgtaagtattttactgtcactgctcaactctgccacagtagcacaacagcagccatagacaatatggaaacaaatgaacatggctgttctccaacaaaaccttacttactgggacactgaaatttgaattttatatcatttttatgcaccaaagaaaagttttctagccaggtgcggtggctcacaactataatcccagcaccttgggagactgaggctggagaattgctttagcgtaggagttcaagaccagcctgagcaatatagcaaaaccccatctctacaaaaa

SEQ ID NO: 167198 - DNA, 389 bp, Homo sapiens
tccagcctgggcaacacagcgagaccctatgtcttaaagaaagggcagaagtggggacccctctcccacccccttcccctgctccaagccaaagcgtttgaagcaagaggttgcctcctgtgagtttcccccagtccctggaggcctgggctttgggaggtgtgtccaggcagaggacagaggtcttgtgcaaagggccgcttttcccttcgcccaccctgcgcccgcccagccccttatccgatgggaaagccttactgactcttttcctcgcagaagcgcccagatgctgtttatgcaacctctccagaatctcagtgtactgtactttttaaaaagtgatttgattcaaagcactcattctttaattaaacttcatttagctgcca

SEQ ID NO: 167199 - DNA, 341 bp, Homo sapiens
cttgaactttaccactagtatttatggaaaagtcacaattccaatgggtttctaccatatttcatcaaatttaggatgccactgattgaaagaggcattacgattcaagagatgttaaaatggggtgggtatggtggctcatgcctataatcccagcaccttgggaggccaaggagagtggatcgcttgagctcacgctttttagaccagtctaggcaatgtggagaaatcccgtctacaaaaaatacaaaaattagctgaatgcagtggcgcacagctgtagtctcagctactcaggaggctgatatgggaggatcactttagcccaggaggtcgaggct

SEQ ID NO: 167200 - DNA, 231 bp, Homo sapiens
aacactatgattcctgcttgtgcaagcaatgtttgtggcccatacaagggggacccggctgagttcttcatggttggcttgtggttgacatttttttttctctaaattttctctggacataatgctgctgatggaatttataaagagatagagcattctcattccactggattaggccaaaaagtaattgagctactgaagctatttagaagaagagcctctgattgcatt

SEQ ID NO: 167201 - DNA, 393 bp, Homo sapiens
cttcctgtaagatctgaataaagctccaatgagccataaccaatctcttctgaagcattccacccattgataagagctgcctcaattgaatatttccattgcagcagcaatagggcagacagttgcagaaaatcctcaaaagaactaccatagacacaaagttaactggcagtaaaaatcgctctgtgacaccaccaccctatgttcagaaagataggcaaagctctcctctttgtctagaccttcctttaattagggtcccgggggccaggaaaattctctgaagtaagtctgtgcactgctccggcttttgaagagtaatggctttggtgggaagaaacatttgtaaaaattcagatctaatctaggaacccaaaccaatctaattagagt

SEQ ID NO: 167202 - DNA, 445 bp, Homo sapiens
gatggacatttgggttggttccacgtctttgctattgtgaatagtgctgcaataaacatacgtgtgcatgtgtctttatagcagcatgatttataatcctttgggtatatacccagtaatgggattgctgggtcaaatggtatttctagttctagatccttgaggagtcgccacactgtcttccacaatagttgagctagtttacagtcccaccaacagccactgtatatatctttctaaaactcaattctgatgattttgctcccctgattaaaagccctcttggactatctatccaaattccagcctagctttttgaccttatttcttgccaatccctataaatgcacaatttattctagctatactgaatttctcaatgtaatcataatttactgggacatctattatcctttgccgccttctttgtacacagaagcactat

SEQ ID NO: 167203 - DNA, 556 bp, Homo sapiens
atcgtagccatcatgaaatcttagcataatgcgttgtgctaagatgtgtttgtggtgatgctggtgtaaacaaacctactgtggtaccagttgcataaaagtctaggatatatgagtgtgtgtgatacacagtatttgataatgatcatagattgatgctgttttatgtgtttactatacttttaatcattcttttaaagtgttctcattctactaatgaaaaaaagttaactgtataatagcctcaggcggattctgcaggaggtcttccagaagaaggggttgttatcataggagaagacagctccatgcctgttagggcccctgaaaaccttccagtgggacaaggtgtggaggtagaagactgatattgatgatcctgaccctgtgtagacctaggacaatgagtgtgtttatgtcataatttttaacaaaaaagtttaaaaagtaaagtaaaataaaaatagaaaaaagcttaaagaaaaaggatataaaaatatttttgcacatctgtaaaatgtgtttgtgttttaagctatgttattacaaaagagtc

SEQ ID NO: 167204 - DNA, 528 bp, Homo sapiens
cttgccctgctggaaagtcaacaggagaaaccccttcatctctgaaccccaaactgaaaacaaaccatcagctagcaaaatctaaaccataactgggcctagaaacccagactgctaaagctgaacgtgccctaatagaacactgaatctacccttctcactttgcaggtaggaaatgaggattccaagagaggatctcagacccgcgaccaacacgagtttctagatgttctttgcaatgcgtcacacctctcccacgcctgtatatttgctaacatttccagaccagcacaaaactaggaagagagaaacattctctctccaaagagaaggaacctttccctcgggacacttggggtttcctcctaaggcaggagactggaagcccacaggacaggggcccctctggcctctcccgtgcctcgtcccttcacccacgcacggccccagagcttctctcaagcactcctgaaaccccgccccagcggcccccaggactgggccttctgcttgtctgctacaaggccc

SEQ ID NO: 167205 - DNA, 462 bp, Homo sapiens
ctacaaaaatattaataggctgtaaaagtaaaaatgatgtcagtattatggtttcaaatgttgaggcaaccagagaagaaaataggatagtatactgacaatttgaaaatatgaatataacataatattaaaaagtagaaaaattagccgggcttggtggcaggcacctatagtcccagctactcgggaggctgaggcaggaaaacggcatgaacccaggaggaggggcttgcagtgagcagagacggtgccattgcactccaacctaggcaacagagcgagactccgtctcaaaaaaaaaaaaaaaaaaaaaatagaaaaattttaatgtgccatttgagatccctgcattatagccccaatatcttcccatccttaactgttataaaaactctttaaaccatgctgctctattattactccaaatttcctttcttgccactgaatcttggctcattatgt

SEQ ID NO: 167206 - DNA, 386 bp, Homo sapiens
acctacagccaaatcaacccatctccccaaacacacacagcatatatttacttattcacaaaaatgaattaaagagaaagcaggtacagactcattaatctgattgtgtggttcctctgaaaattctgtgagccactgtaatatcctgttaaaatattctcttctgcatcattaaatcactcaatatttattgaggggttgcctgtggttatcagggggagctggtctggtcatgtacacctgtagtcccagcaacttgggaggctaaggcgggaggattgcctgagctcaggagttcaaggctgcagtgagccttgaaccttcaatgattgcaccattgcatttcacccctgggtggcagagtgaagactccatcttaaaaacaa

SEQ ID NO: 167207 - DNA, 560 bp, Homo sapiens
cagatggggcccaccgtgtctcctcttccagcctggtcctctccctccctggccatctcagtggataccccgcattggagagccaggagaagagctaagagcagctttgcccctcatctggtttcctccgagtctgcttgacaatctctttcaaatcaactttactaaggaagaagttacgtaccgcaaaatgccctcatttgaattgtgtaaagaatgagatttgacaggcttggtgctgtggctcatgcctgtaatcccagcactttgggaggccgaggctggcggatcacaaagtcaagagatcgagactatcctggctaacagtgctctgtgagcttccttgaccatggttcctcccgctcaccatcactcaatctctctcctcttcagtgaagcatccagaaagagttactgttccaggtctacactccccttcccattcactctgcttcggataaattctgatttggacaattacataaatgcccacctgggtccagcctcatcttatttctcctcctccctcatcaaggagcagccaggactctgaagtcctc

SEQ ID NO: 167208 - DNA, 285 bp, Homo sapiens
cgtgcgtgcgtgtgtgcaggagatgaggaatggtggacatggagagttttaataggcagaatggttgttgtctatttccatactttaatcatgcctgtgccagatgtacgtgaagccttttctcattatgtgatgatacctctggttgacaaaataatattgattcattcctttttcatgttatccttcaagttacagtcccatccctttctctccaacagcatcagactttatcgggagagtggacaaatatggcttcctttcctacctttctctctccaattt

SEQ ID NO: 167209 - DNA, 411 bp, Homo sapiens
gaatgaccgctgggcgcgccgccgcggacctggagccagggctctgcgcagggtttaagcctcagggtcccgcgcgcgaatcagggcccgtctcccctcctttattccctcctcgggcgggtagaaggggcgaaggcgggcagtgcacgcaaggctctgggcagcaagtgacgcagccggccgcgctcagcctcctctgccccgaacttggtccgcatggctccggccgggccgcccgggcagcccacgggggtgcagccccgacgctccactcggcggggccgacggccaatcttcccagcacgtcgccgagggagcgctcctgaccccgggaacgtccaggacgcaggcgagggtcctgcgcgcccccagccgcagtcccgggagcctgcccagctggcggcggccgcg

SEQ ID NO: 167210 - DNA, 524 bp, Homo sapiens
caggggttttgttgtttaagagatgtagtgacgcctcccttcagacattgttgggagatggagtaaactgagggctagaaggcagagagtaagtgccccataagcagagcagttatacctccctctctgaagatatgtgtctgcatggcatgtgtatggtggtcacttccacagttggttatgaaattggagctagtgtctcatgatgacacagcaaccttctcagagtaggaaggatagatttatatgtacgttatcctaagtgatggtgaccattattaaaaccagtagggacttctagcttgacttcagcctatagtttcaagcttctctcccactaaatgctttagcagccctgttacaagtagaagagctcctttactttactttcatcttctgttttcccagtctccccagcacagaaagtactgatgagtagtaaaatgaccaaaagctcccttgtcaaaggaaaaaaggtgcatttatcattgataacataccaggctcttacccaagctcagatg

SEQ ID NO: 167211 - DNA, 233 bp, Homo sapiens
tagctgaccttcctcccagcacagctccaatgcaggcatgtgcatccaccacccttccacgcacacttactgagcacctgccagtgctgagcagggtttagagactgcagactctgcagtgattgagatggacagcgtccttagattctggttgggtagacaggtgataaaccagtgaacagatgtgaacattagacctatgatgaataaaatcaggctagtgtggtggggtg

SEQ ID NO: 167212 - DNA, 242 bp, Homo sapiens
cacaacacatgtcatcctgcgttatgaccacctgctctgctctaaatccctggaggacagagtagactccttccttgctgaatccccaggccctgggcactcagaaggcactcatcaacatttgttgaatgaatatatgattgttcccagagcaccttgcagcaaccatcatactcctgccctgtgattagtcctgtccaggtattttttttttttattttttcagacagggtctcactctc

SEQ ID NO: 167213 - DNA, 430 bp, Homo sapiens
tcagccctggtcaaggtggcaaagggtctgtttttctccccccattagacaggggtcttgtcttgctaccctaatggtaaaggggtgactgggaagggttggtaagaacatggtagggatggagactccagccccacttctctgggcttatgctgacagagacctgcttttatttttatcccttgagttttttaaaaaaatccagtaactttattcataactttttcaaaaacttttcataaaacatttttttactttttttccacaacttttgccgcaacttttccacagcattttttatcccataactttttcatcccacaactttttttaatacctgtaacttttttgtttgtgttcttttaataaacacacttgcatagttacattacaattttgtaaaaataaaaaccgattatctcatgccaag

SEQ ID NO: 167214 - DNA, 828 bp, Homo sapiens
ctcagccccatcatgtgagctcaaagtgcttcacctcactgtgcctcagtttccatgtctgtaaaacagggtagaagtagaacttatctcagaagagttataagaattaaactagagaagaagtgagcattgtttatatgtgcttgttgctatggatccaaaactgccagtaataacaataataataataataataatagcttatgctttcgttgagcccttgctttgcacctggccagtgacaggcacattatcagtaacacaaatgcaagtatctcatctaacccttgcatcaacgctcagagatgggttttatcaacatccccattttacagatgaggaaaactgaggcagagcagttgcacaacgtcgcagctgttcctggatgcttcaccgcagagctcattgccagtaaaccactcatcattcagcctttgctgatctgtgcctaatggcttataccaatactttctccggagaattccttagctagcaaaagctatttcacccagggagttatgctctcacatgctgaactggccaatgactaagcgatatgaagcgagaggagtcacacaaaagtccagtcctcctgcttcaaggcagaatacactccagagacccacgtgagatcaaggctagcctcagcctgagagcccattcttgcttggctctgtcccctcccccatcatcctccttccctcactttccttctcctgagaacccccaccttgaataaaccgcacctacccaaatctcattcttgggcttccaaggaacccaagaatcagctttgctgacttgggcgatcctctacatcgtgcctgg

SEQ ID NO: 167215 - DNA, 765 bp, Homo sapiens
agtcgggtggggatgcggcacctgcattttcacaccctcctggtgtgtccccacttggagtgattgcgtatggaaagaagcaccctctcatcaatcccttggaaaaggtaacttctgactaattcactgagtcctggctcatcagctgaaagaactcactgatggggcaggtggaatgtcatgtttccatggggcatttcaggggtggggtgcgtcatcgcttccctgtgtggatctgagaaggagagggggcaggccaggtgcagagactggaaacccaggcttggactagaagagtgttccaagagtaagcagggagcagtgatcagtagccgaggtaaggaaggaccagcggaggcactggaagccctgatcagcaaagacaaggtcttgctgcccaaagctgagggcagaggtcactagcctgcccacagctgcattccacactcccaacggtgactgacttcttaactgaaaggactaaatgcaggagcgtgagccatacccacctgaggcagagaacacgaaaaattgagacaaaaagatttcaggataacacagtgttaatcagaaccctttaatcccctcaatctctcaatctgttgctgaagattttaacctactgcagggttcagctcctgtgatgtgcgtgctagtgttactttgtgtttcctaaggaaacaggacattcacaaataccttgcagcttcttttctctcaaatcccactgcatcactcagagagctatttactggaaaacaaaac

SEQ ID NO: 167216 - DNA, 513 bp, Homo sapiens
  misc_feature (5)..(5): n is a, c, g, or t
cagcncgactctttaggatcccccacgcagcttggactagaagagtgttccaagagtaagcagggagcagtgatcagtagccgaggtaaggaaggaccagcggaggcactggaagccctgatcagcaaagacaaggtcttgctgcccaaagctgagggcagaggtcactagcctgcccacagctgcattccacactcccaacggtgactgacttcttaactgaaaggactaaatgcaggagcgtgagccatacccacctgaggcagagaacacgaaaaattgagacaaaaagatttcaggataacacagtgttaatcagaaccctttaatcccctcaatctctcaatctgttgctgaagattttaacctactgcagggttcagctcctgtgatgtgcgtgctagtgttactttgtgtttcctaaggaaacaggacattcacaaataccttgcagcttcttttctctcaaatcccactgcatcactcagagagctatttactggaaaacaaaac

SEQ ID NO: 167217 - DNA, 370 bp, Homo sapiens
ctgaggtgatctagaggatcctaattctgcaccacagcaattctgcacccgatagctgcgcctctgggaaaattactcccctacctttctttgcctcagtttcctcttctgtgaaacgggaaatgtataacttacttcaaaagtctgttatgagaattaaatgagttagtacatgtaaatctcttagaatagtgctcaacatatagtaattgctcagttgttaccatgcattatattaaagctctaagaattgcctgggtatagtggctcacacctttaatcccaccactttgggaggctgaagcaggagaccatcctggctaacatgatgaaacctgtctctactaaaaatacataaaaattagcctgg

SEQ ID NO: 167218 - DNA, 414 bp, Homo sapiens
ctgggagggcttagaatcagttcactctggatatattccatattttttctgagtgggtttttcttacctttggtgggatgagagatgaattacatttttcccccgtcctttattatttgaaaagaggatgtatctgaagcccaagttttttgtttgtttttctttgtttttgagacagagtctcactctgtcacccaggctagagtgtggtggtgtaatcatagctcactggtgcctcgacctcccaggcccaaacctgggaggatcatacctcagcaacccccaagtggctgggactacaggagcacaccaccaagcctggttaatgtttttaatttctatttttggtaaagacagggtctccctgtgttgcccaggctggtttctaaatcctggcctcaagcaatcctcctg

SEQ ID NO: 167219 - DNA, 464 bp, Homo sapiens
cactctcagcccaatactggtgtgttttaattagccaagcaaggcttagctaagtgggcatttaaaggttccttctaaagagccatttctttacaaaaagttgaaaatcttatgctatattggccaaaaggtcataattcatggaatgtctttgctcatgaaactaaatagatggttagagatgttgctgtttgagacctggtggcatacatgggtgaacaattgcaatgtaaactcttgacttgcatgctttttctttacctcaacccattcattacatgtaggctcaatcatttcactatttaggttactggttcagaagaagccaggaaaaacaataacactatagtaataagaatgttgttacctgagtgtgtattgcttactttcttgcagatactgctgaatggcgatcaatacgtagctttatatttttaaaaataaaaataacttagtggcttaaa

SEQ ID NO: 167220 - DNA, 517 bp, Homo sapiens
gggtcatcaccaaggtctgatttttcaaattcaaaaaattacaatttcaggcataaatgggttaaccattaaacattctttaattctccaaggttcaactctgtaaactctgtacccattctgataatgacaattcatggacatctcttgactgtaaactacttcaggaaagtgatttttgatctgtacactcatatcacagtacctaacagtgcttcctaaaatgcaagaacacaaagcaggaataaatgaataaatactaaagtcaccttcttttctttctttttttttgatggagtttcccactgttgcctgggctaaagtgaaatggcgtgatctcgactcactgcaacgtccgcctccccagatcgaaacgattctcctgcctcaggctcctgagtagctgggattacaggcacacaccaccacgcccagctaatttttgtatttttagtagaggcggggtttcaccatgcttggctaggctggtctcaacctcctgacctcatgatccgtc

SEQ ID NO: 167221 - DNA, 496 bp, Homo sapiens
tcggtaccggccccctgtggaattgattatgctacgtatttgcagaactctggcctggcagcacctggtccgtgtgccagaaatgctcttcaccctcttctctgcccctcaaattcccatgccacacagtggaatcagagaaagtgttctagagaggtgacatttgagttggagtcagttaatcctctggattcatgaaacaactttcacattcactacagcatgatattgctgaggagatgccggtgtttatttgaatagctggtcaccagactgagaacactttcagggcagggatcatgaactatttatcactgtatcctagcaactgacacaaggtctggcccagagcaagtactcacctagatgatcatggggatggatggatggatggatggatggatggatggatggatgcattcatgcatggatgagaggatggatggataagggcgggagggagagagaataaaagaaaggaaggaaaaactgtaca

SEQ ID NO: 167222 - DNA, 514 bp, Homo sapiens
agtcaaggattatgtcactatgtgttttagggcactgtgaagaagcataaaatttctaagttatattatatgcatatcagattctagatatgcaaggcctgagaagactgagagggagatttatggtgtgtgactcagagcatgcagaggaaagatggatgagacactcatgtgcaaacagctccctcaagtacaatgttacagagggagatcagccacctggctctattgtttcttctcatctccttgcttcatcttcaccttcttgcccctaaagcatagccttcacaaaagccttcaactcagcaaggtgcatttatcttacagggtttagtgaagggtaactttgtggaagcatataaaaaactattatataactcttaaaacctgcatttatttacgtatgtctttcagttttccctgttctagcttagatttataccttcacacttttaaaagaaaatagtaacatataaaatctatgtatgatgaactttactagcagatttacttg

SEQ ID NO: 167223 - DNA, 427 bp, Homo sapiens
tttgccattgcttccagtccaacgtccttcctttaatttttcttccagaacattccatcccctccagcctcttcctccattaaactgagaattgaatgactgaatgttcgtgaatttttagattcaccggtgctttcttccaatccctccaaacctctcatttttataaagaaacaaggaaaacatgaagcaccttacatcacaataccagtatcaacaacatatctttatcagctctcattccatattttaactaccttctaaatacagacccaaaccaaaaaattaatactttaagaaaggaaggatcagtgttctcttttcatttatcagtaagattagcagactgcaattagaatttctctcttcccccacggtctttcctccagtaaagacaaaatgctttcctcattcccatgattcaaca

SEQ ID NO: 167224 - DNA, 810 bp, Homo sapiens
gcaggaagcccagggaggatgcccgcacggcagcccagaggagagacaacagtgccgagtgtaggcagtagtaggggaggcaggaagaaacggtgagaggcagtttgtgggcagcactggctggatttactgaagaactgatgtgtaaggcaagagaggactcatgcagcatttttgttgatgtctcttatagcctaagcctggggatgaacagcgctatcatctaatgaaatggagaagacagaagagccaagaagcaggcaggatgagactcaagactgcagattttgacaggttgagtttaagatgccagtgagcaccatcacaggactcttgagcggagagctggataaaccagtctagaatttaggggtgaggccaggattggagccaatagcattgggtggtatttaaagccttgggactgaataagaatgcaggagagaaaaggcccaaggattaaccccagaggcacttcaacatctccggtgggaaggtaaagagcttggactgaatcctgaagtgtagttctccaagtgtagttttccaagatattgtagccaacataatttgggtggtaatgtcagttttattagtcatgtgtttacttttacaggcaaaagggattaaggaaaagaatagtgaagtatgtggacagtacgaacaactgccagacgattctgcagagaggtgagcactgatggtgcagaagagagaggacaacgctgccagagcaaagcccttaggcaggagagaaggaaggagtccagcgcctacactgaggggcttgctgtggaagcagggacagtc

SEQ ID NO: 167225 - DNA, 339 bp, Homo sapiens
ccccactcccaggagagttggctacgcaaatttttagtaaagaggaatatcggaagggaaggaagttttgttttgatttcccagctttgggagaaaagaaaagaagggattgcttatgaactgcaagccccctgatgaaacagcaaactaccaggccggtgctggtccaagatctaatggcaggatgtttgcagtcctgatgttaccaagctttgtctccccaagctgggaaatcaaaacaaaacttcctccaccttccagccacctgtcctgtttattcatttcttccctgtcttttctccttttcttttccatttatccaggcattcgttccttcta

SEQ ID NO: 167226 - DNA, 1491 bp, Homo sapiens
  misc_feature (1203)..(1203): n is a, c, g, or t
  misc_feature (1352)..(1352): n is a, c, g, or t
caagatagaagcgttcagactacaactcccagcagccacgaggagccctagggcttgatgggaacgggaaaccttctaacctttcacgtcccggctccgcgggttccgtgggtcgcccgcgaaatctgatccgggatgcggcggcccaatcggaaggtggaccgaaatcccgcgacagcaagaggcccgtagcgacccgcggtgctaaggaacacagtgctttcaaaagaattggcgtccgctgttcgcctctcctcccgggagtcttctgcctactcccagaagaggagggaagcacaggtgggtttctttagctctgcgtcggatccctgagaacttcgaagccatcctggctgaggctaatctccgctgtgcttcctctgcagtatgaagactttggagactcaaccgttagctccggactgctgtccttcagaccaggacccagctccagcccatccttctccccacgcttccccgatgaataaaaatgcggactctgaactgatgccaccgcctcccgaaaggggggatccgccccggttgtccccagatcctgtggctggctcagctgtgtcccaggagctacgggagggggacccagtttctctctccactcccctggaaacagagtttggttcccctagtgagttgagtcctcgaatcgaggagcaagaactttctgaaaatacaagccttcctgcagaagaagcaaacgggagcctttctgaagaagaagcgaacgggccagagttggggtctggaaaagccatggaagatacctctggggaacccgctgcagaggacgagggagacaccgcttggaactacagcttctcccagctgcctcgatttctcagtggttcctggtcagagttcagcacccaacctgagaacttcttgaaaggctgtaagtgggctcctgacggttcctgcatcttgaccaatagtgctgataacatcttgcgaatttataacctgcccccagagctgtaccatgagggggagcaggtggaatatgcagaaatggtccctgtccttcgaatggtggaaggtgataccatctatgattactgctggtattctctgatgtcctcagcccagccagacacctcctacgtggccagcagcagccgggagaacccgattcatatctgggacgcattcactggagagctccgggcttcctttcgcgcctacaancacctggatgagctgacggcagcccattcgctctgcttctccccggatggtcccagctcttctgtggcttcaaccggactgtgcgtgtttttccacgggccggctggccgagatgcgaagtccgaggcacatttggaaaaaagcagggncagagcggttcttcctggtagcttagccagccaactctttgctgggtctaggcgccctgggtgtgtgccggatatggcctcgtgtgggggccacggtcccccctgttccccgggccgttagaccggtgctgtgccgcgt

SEQ ID NO: 167227 - DNA, 291 bp, Homo sapiens
gctcctgaacagctgtcgacgggagagaggggaccccaaggagtgggagcaggagccaggcagacctcagagccccaggctcctcccgcacatggtgcagtggctggatggcccgggctgggtcctacagcggctgctcagtcaggtgggggggtccctatcccagcagggtcccctctcagggcagtaggggtgttgtcagccatgactcagacttccctgaggcccctcacctggactcaaaaagaggctgcttgatctgcatgaagccacgcgggtgtgcagggcagg

SEQ ID NO: 167228 - DNA, 455 bp, Homo sapiens
cctcctgggttcaagccattctcctgcctcagcctcctgagtagctgggtctgcaggcacacaccaccacacctggctaatttttgtatttttgtggagatggggtttcacagtattggtcaggctggtctcgaacccctgacctcaggtgatcctgagcctcccaaagtgctgggattacaggcgtgagtcactgctcccagcctgtgtgcaggttttattgtgaacatatgctaattctgtagggtatatggctgaacagtggggttgctagatcagtcatttggtaaatataattatgtctttgtaaaaaactgcaaaactttcccagaatggctttataattttgcatttacaccagcagtgtatgagaatttcagttgttcccattcttgtcagcactttgtagtgttgatgccttttattttagacagcctaacaggtaaataatggtt

SEQ ID NO: 167229 - DNA, 180 bp, Homo sapiens
tgtgaaaatggcagcaagactgatcaatgagatcaatgtggagaatgttgtagtcatcgagatgagagacgattgtggtctgaatcagaaaatggccattgagatggagaagatggatggattcaagagatatgtaaaagctggaatcagcaagacttccttgattgaatatggagcatg

SEQ ID NO: 167230 - DNA, 211 bp, Homo sapiens
ccctgagagaatgccaacggctctgcgtaggtcactcgcctttgaggctgggctagcagctcagaaaaggggccaaagggcaggaatagcaggaataaagccgtggttccatgctggctccagggacggggcttgaggctggctcattccagagagctccttcttttcctacagaggccacaagttcccagctcagcacaatagcctttgt

SEQ ID NO: 167231 - DNA, 604 bp, Homo sapiens
  misc_feature (8)..(8): n is a, c, g, or t
  misc_feature (10)..(10): n is a, c, g, or t
  misc_feature (13)..(14): n is a, c, g, or t
  misc_feature (19)..(21): n is a, c, g, or t
  misc_feature (23)..(23): n is a, c, g, or t
  misc_feature (27)..(27): n is a, c, g, or t
  misc_feature (37)..(38): n is a, c, g, or t
  misc_feature (63)..(63): n is a, c, g, or t
  misc_feature (68)..(68): n is a, c, g, or t
agacgcananggnngttcnnntntggnacgagagccnnaaccaaagcttacagcaaagaggcnctggncctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaaggtcgacaaggatgaagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctccccccccagccacagccacatggaggatgagatcttcaaccagtccagcagcacgcccacctcaaccacctccagctctcccatcccgcccagcccagccaactgtaccacgggatccttagatgacctcagcaca

SEQ ID NO: 167232 - DNA, 519 bp, Homo sapiens
gtgctctgcagcccctgagcctggccctgggctcgccagcgaagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctccccccccagccacagccacatggaggatgagatcttcaaccagtccagcagcacgcccacctcaaccacctccagctctcccatcccgcccagcccagccaactgtaccacggaaaactctgaagatgataagaagaggggacgttccacagacagtgaagtcagccagtctccagcaaaaacggctccaagcctgtccacagcaaccagcaccctcagtccccagctgtgccgcc

SEQ ID NO: 167233 - DNA, 588 bp, Homo sapiens
  misc_feature (8)..(8): n is a, c, g, or t
  misc_feature (10)..(10): n is a, c, g, or t
  misc_feature (13)..(14): n is a, c, g, or t
  misc_feature (19)..(21): n is a, c, g, or t
  misc_feature (23)..(23): n is a, c, g, or t
  misc_feature (27)..(27): n is a, c, g, or t
  misc_feature (37)..(38): n is a, c, g, or t
  misc_feature (63)..(63): n is a, c, g, or t
  misc_feature (68)..(68): n is a, c, g, or t
agacgcananggnngttcnnntntggnacgagagccnnaaccaaagcttacagcaaagaggcnctggncctggcccagaaggtagatcctgcccagaaggagaaggaagaggttggccagtggctcacgaataccatcgacacgctcaacatgcaggtggaccagtttgagagtgaagtggagtcactgtcagtgcagacacgcaagaagaaggtcgacaaggatgaagcaggaccggattgagggcttgaagcggcacatcgagaagcaccgctaccacgtgcgcatgctagagaccatcctgcgcatgctggacaatgactccatcctcgttgacgccatccgcaagatcaaggacgacgttgagtactatgttgactcatcccaggaccccgacttcgaggagaacgagtttctctacgatgacctggacctcgaggacattccacaggcgctggtcgccacctccccccccagccacagccacatggaggatgagatcttcaaccagtccagcaccctgcctcagcccaggcctcaccccaccaccagcccaaccgcatcacccgttcggggatccgtgtagag

SEQ ID NO: 167234 - DNA, 689 bp, Homo sapiens
taatcccagctactcagaaggctgagacacgagaatcgcttgaacctgggaggtggaggttgcagtgagctgagattgtgccactgcactccagcccgggtgacagagtgagatcctgcctcagaaaaccaaaaccaaacacaacaacaacaaaaaatgacatattcattgtgaacttttaaaattcatactcattaatcgtcattaaatttccttaaaccatttttcaataaactgtactagagttcgctagtaatcaatgtcaagcttactgggtagttgtttccagaacccgccctttttaccaaatgaaaaaaattaagacttttgcctttctcaccattttctgataacgtattctgcataatttctcatagatgacctacagtgactctgacgctaaatctgcaagttcttttaacaccacggaaataatgtctaaatgctcaagacaaaatcacttatggtggtaggttttccctcattatttccttccaccttagtcatcaattccttcttattcagacctgttcttgcattttcagctttaaaattattcttcctgatggaaaagaaagggaaagcaaaataataattgagaagatccattttctttctgtcgtctatgaatcctataccatctaccccaaacactggctctacctctccttattctttatacaactttt

SEQ ID NO: 167235 - DNA, 558 bp, Homo sapiens
ctatggtatatatgcaccacattttctttatccagtctaccactgatgggcatttaggttgattccatgcctttgctattgtgaatagtcctgcaatgaacatatgtatgcatgggcctttatggcagaacagtttatatttctttgggcatacacccagtaatgggattgcttggttgaatggtagttctgtttttagctctttgaggaattgccacactgcttcccacaatgcctgagctaacttacactcccaccagcagtgtgtaagtgttcccttttctccacaacttcgcctgcatctgttcccctcaaatttaaacatttaccccaaaggatattagggatgtacaaaatcactgaaagaataatgactaaacatttctgaaaggaatttagaatcacttatattttcagtatttttggctgatccctagaacaccttagaatattagcacttacttgtcatctgcaaggactccctcatgatgtttatctaaaggtctagcatactgcagctgtgagttacgttttacaaaaccgttgaaaggccatcat

SEQ ID NO: 167236 - DNA, 438 bp, Homo sapiens
tactattgtagatgctgagggcacagcagcaaataaagccaagtcccagactgtgtaggacacttacattctcacacccagctcgcagcaaattataaactctaaggagataaataattgggggaaatcttgaaacttgactacaggcttaactgggtaagactgccagaaaacaggaacagttttctgtgtatttagtgccattcataacatgacagcatccacagtgactaagcaaacagcccagaggagcaagggtgtgagttaggagttgagtaagaatcagcgacaataaaaatgaacacctgacatatttttcccattctagggtcctctgtctataaatatgtttgaaactaggttattatcctctctcacccatgcttatctcccaaattcttcttaatcatttctcgggtcctgatgatatattgatag

SEQ ID NO: 167237 - DNA, 441 bp, Homo sapiens
cccagggcaaaggaaaggctattcacaaattttttaaaagtggaagacagccataaaatatgccaggataatccccaagaccggctactctcaactttctctacctccaatcttggagcccacccaagggcaagagtggcctggagactcgctataaaatgtatgtgaccaccacaatggaattgctttgccagacatttttactaatgaatctcatagcacggagacagatcccatataaggagttaagcaggttcattctcctccacgctgccccttcacctaccagataagcaaggcaagtgcccccagttccatggaaggagagcagaccacaaaaaggttagaaggctcaagtcctctttccaggtagctgggaggatgtaattggtgaggcaggagattagaaatatcggcagcctctaagtaagactttaattt

SEQ ID NO: 167238 - DNA, 201 bp, Homo sapiens
tttctttttcttctcagttgactgaattatttccctagtctgtcttcttgccactcttgatgctcatatgagaggacctaaggtaattcctgacaacctgggactccttaggaaaaacagaaggtgccatagactccattttaggagaaacgtctgttttccttatggaacttcaagaagtgtaagcagacaggtccctct

SEQ ID NO: 167239 - DNA, 270 bp, Homo sapiens
tgtgaacggggagatgctggaagatggctcagcagacaggccagcccagctccagtgtccaaaaagcggtttctccaataaggaggcctgggaagggaagcacaatcttccccaaaggagaaccaagggctgaggttctgcccctccaggaagtaaggtgctctcggggcctccttggacttgtctgggggctgcagtggagtcagctggacacctgctccacccctgccacctccgcccccaccctctgcagcatctggcatctccatg

SEQ ID NO: 167240 - DNA, 395 bp, Homo sapiens
tccccccgttatgtccgggtgtcttatgtattccagtgtgtatattcaattattctgaacttgagagtaaaaagtgggtcactacaaacttgatgaagatttggtctgcaacattatttgaaataggaataaggccacacacggtggcttacgcctgtaatctcagcacttgctgggattaaaggcgtgggccaccacacctgacctctttctttttttgaagcaaggtctctgtcacccaagctggagtgcagtggcatgatcataactcactgtttcaattggcaataatcagtaataattgtgcctcggataaaccttactggctatgatactgccactgcccaaagctgattataggtcactgtagcctcgacctcctgggctcaagtaat

SEQ ID NO: 167241 - DNA, 933 bp, Homo sapiens
tagggggaggaggaaagacatcttcacaaatccatgtccttatgcagattagctcctttcactgtgcctttaaatcccccagattgtcttgttatgccattctgtttcaagatggttctttcaatccatacatccatttttcattgattcagatgtacagtgctcttaattagcatagacttcccgtggattcagaaagtggttcataatggccttcccaaaaggaaaatttaagtctaatgtaaggaataagaacaacccaaaggaaaagtcacccactgagtactgccagcattagcagtgacaaggacagatctcactcagcctatctgtcctctggggagctccaagaacatacgaactgctgtcattattctactaccttaaatcataatcattctgctgagtgggaacagttccagtctgtgggacaggtaaaaaataaatgggagacatgaagacactatcacgcttcactcacaaattcatgtaaattatgtttagttcagtcttctaaaatatgcaggcatgtcatttagaacagtactcagttgccaagaattattttcaatggaccaatttcaatggaattcctgaaatttttgcttgcatcagtgatagactagacgtggatgacttaacctcttgcaataaatagctagaaaacctgacagtatatataaaagaactacgtgcaggcaccggacaacgggcagttcagaacttggctgttcagctaatttgcataaagatatggatttgtttgtttctccctgcaagaaaagaaacaaacaaggcaagctatacaatcaccccaactttctgcctggaggtgttaataatttccaggtcaccaagtacagggaaggggaactcaaattaaacatagtagccctacagattaaatactgcagacagtaaagaacagagttc

SEQ ID NO: 167242 - DNA, 177 bp, Homo sapiens
caaacccacacactcctcaccacatgtggcggtttcggaagctccttcctggggctccaactacagactacctcttctgacagtctcacccccgctgtcccagctcgaaccttcaccctctttgggcagtctgcatctgggggccccctcacacccaagtgctactgtgtttacact

SEQ ID NO: 167243 - DNA, 491 bp, Homo sapiens
ctacaattaaagaattttgagattgcaattacagataacaactactgtaacctatataatatccttttcctcttatttactaacagaacactgattttacttgaggaagctgagcattcagctaaaaattaaaaatctgcccatcttttctgcagtgggggtggccttgtgacacaattgtagccattgaaatgtaaggagaggtccctggcagtgatgttgaaatgtaagcagtcaagcgggttgtccaggtacagtggctcatgcctgtaatcccaacactttgggaggcagaggcaggggaatagcttcagcttgggagttcaaaaccagcctgggcaatgtagcaagactctgtctttatggaaaaaaaattgtccagcgtggtggtgcgtcagtgtagtcctagctacagccacttggcaggcagaagtgggaaggtctcttgagcccggaaaggtcaagctgcagtgagccatgatacatttaaa

SEQ ID NO: 167244 - DNA, 545 bp, Homo sapiens
aattgggatatcatcttcaggtaatccaaatattgacagtgaagaaaagagcccaaacataatgagaaagtaacacacagcagagtatttcaactttaggatataacaacttaaaagatgttactcacaaatatataatctttatcaactggccaaaatatagccttgaattatccaacaagtctcctatttcttgttataaaatatactggcaaaaaccaacaaacccacactgctacaatgaaacccatcctcacattccatggcttcagggcaattccataaacacaggatcataaaaagacagcctgcaaacttaggtagcccgcactccattttaaggatcggaaattaaatgacatgtgatcatccagctacagcaacctgaggatctttttaaaaagctagcaggaactggcaatcttatgttagaaatccaccaacaaaacagtatacaaaattcatacaatacagatgatgaagaaatttgagtccaacgtgaaaatgttatagcttgtatgctttaggatacaagttgtattcag

SEQ ID NO: 167245 - DNA, 291 bp, Homo sapiens
gacgcttgtcagaactttcatgtttatgggctttcatttctttgttagaacactaacctagaaaactcgggtaagactaagtgaacgtcatctctggtcagacctcagtccatgtggctcttgtgaaagagttttggcctagagctaattaatattgttggatcgtggatccttttgagaatttttttttttaaagagatggggtctgcctatgttgcccagattggtcttgaactcttggtcccaagctatcctctccttggcctctcaaagttctaggattacaggtgt

SEQ ID NO: 167246 - DNA, 473 bp, Homo sapiens
aatttaaagattcttggtaaatttaccaaattgagcaaccatgacaataattactttaataactaaaaattggaaatagcctaaatgtttcaaatggacacatcaactgatgaatgcatagagagaaatgtgttatattcacaccatggcaagctgcttaggaataaaagaatgaactgttaaatacgacatggaggaacttcaggacacgctagtgaaaaacctgcacaaaaacaatttatgtgattccactgatatgagctgtccagaagtagtaaatctgtagacagaagtagattagtggttgcctggggctggttggtggcaatgaaaatcaacacaggtcaagagagagactgaaatcatgaaaatattctaaaactgatttattgtcaaggctgcagtgagttgtgattgggccattgcactccagcctggggcaacccaaagtgagaccctgtccccccaaaaaa

SEQ ID NO: 167247 - DNA, 248 bp, Homo sapiens
agccaaaccataatctacacaatagttattattatctccatcttacagaggaagcaatggaaagtcagagaagtgaagtacgtggcccatgtcacccagctaataagaggcagaacccagagtcacaccaggtctggccgactgcagctgcagtccctcatctcttcatgactgtgccttgtaacaggggatgagttgaaaacctggaacacagcagaagggcaatttgttgggcaagctgtatggtg

SEQ ID NO: 167248 - DNA, 304 bp, Homo sapiens
cagcaacagaggacagaggaaatgtttgtgtgttccaagaaacggggagcagacatccctgtccctccaagaagaatggatggcgggcctttctagctccagacagccctcatgcccccagtcatcccaaggagcttgctctacttttccgatggtacggagtacatatgagactaaatgagattcgacaagttggatggttctgcaagagatgatgggaaaattggccagggatgcaagaggcctgagctctcatcccacatccgctactatctccattgcaaccacacaagtcaaaagaatg

SEQ ID NO: 167249 - DNA, 519 bp, Homo sapiens
cagcgccttttgtatattcatgatctgtttctgggcaaagttttgagaggaatgattgaatataggttcttgtagattatacctttatacaaaagaaaagtgatagattcttagtaaaccaaaatatagttgtccctcagtattgggaactaatgaggaattggtagcagctgcgtgaccttactaaaaataaaaatcagatccgctgctgtaaactcttcactgatttcccactgcacttagaatacattcctaactctttatcatggtcatatcagtgctgtgctacagccaggtcataccagcttttgacggccaattgttaaattttcaggaattctgtgaaccagttgttaagcacagccattgttacaaattaaatgataaaaacttacagttaaataactcatgttaaaaacaaaagtaataagtactcaaaattcatcactttctggttatgttaccactttttactgttgtctgtgctcttgaactatttacattgttttatctgtatga

SEQ ID NO: 167250 - DNA, 450 bp, Homo sapiens
tggcattcacagaatgatggaatcaaagtaactcaaattctgttccttaacttctctaatcactaatattattgttattttgaatctactgtctagatgcaggggtatgtggcaccatggggttgggcacgtgaagtcagcttgaatgattttcaaactgtcaggaacttattcaaaacaaatgtgtgtggctgagttcgtgtgtattggggcgtgactgtataactgggagtttgaattaacttctaagtagaatgcaagctataaaggataagtaataaaaaagtgctaatttgaagcttacatgcatattattaaaactcagtagtaacaaagcaatggtttagaacttagacccacaaaagcttttatttgggaaggagtgctttatcactgacattgtttggaattgccggcacatggtgataataaaaagcagactgacttcta

SEQ ID NO: 167251 - DNA, 137 bp, Homo sapiens
tccatctattaaagaaaaaaaaaaccatcgtttacttttaggagtaggcattacatttacgtgcttaaaataccaaaggtacccaagtgtagatatgaaagactttcccacccccaagtgagtgcccagccccttaa

SEQ ID NO: 167252 - DNA, 239 bp, Homo sapiens
ggaaagtggcagctgcacagtagcaggggctgcctgagcaggaaagcaggtaaaggaccaggggagaaacacctggggatgatgagaaaatcattttatgatacataagtgtgccagaaccaataaaatcggccctagtcacatttaagttactacgagtctgcttgaatataaacacagattttagcatagagttggaaggaatttttactttctagttaagagcatcctgctccagc

SEQ ID NO: 167253 - DNA, 122 bp, Homo sapiens
aggtgttcaagatggaaacacccattgtcaaggttaacaacagcagtagtaataacagctcccctccccaagcacgcacaggccgaagggtgaacaggcacggtgccaggtgttttggacaa

SEQ ID NO: 167254 - DNA, 477 bp, Homo sapiens
gcagagcagacccccagcttggaaaaggagcatgtgttcttcccaagtctgggtgtgctagaactggcctagagattctggaacagctgttctggccacctccccagctgcctttctctttgtcccagaatttcccccatcttaacttctttctttcatctcccattcttgactccagcactgtaagcaggaatctggccttttatctcattcttggatcttgataggctggaatgatggtaaaaagccaatgcgggccaggcgaggtggctcacgcctgtaatcgcagcacttagggaggctgaggtgggtggatcacgaggtcaagagatcgaggccaacatggtgaaaccctgtctctactaaaaatacaaaaattagctaggcgtggtggcacgcacctgtagtcccagctactcaggaggctgaggcaggagaatcactccagcttggtgacagagcaagactctgtctgaa

SEQ ID NO: 167255 - DNA, 215 bp, Homo sapiens
cacctaatggtcctccaattatggaggcggtagttggccagagtttccagctgctgagctctgatattcatcactatgtttgtaccctggccatgctctctgagggctgttcacagacaatgactgagcacagcaggagttctaaggtacacttgttcctgagactcatggacccctctcattgaatgactgtgacttgaggactcccaaatggc

SEQ ID NO: 167256 - DNA, 1011 bp, Homo sapiens
  misc_feature (2)..(3): n is a, c, g, or t
gnnggcatactatacagtaacagccaactttttgttcattctaactcttaccacaccgagctttccttggtgtcagccacaggggtcactaagccatcagctgatcaagaaagtctcccgagtagctggactacaggtgcccgctctcaggcctctgagcccaagccaagccatcgcatcccctgtgacttgcacgtatatgcccagatggcctgaagtaactgaagaatcacaaaagaagtgaatatgccctgccccaccttaactgatgacattccaccataaaagaagtggacacgcatgaaatttggtgccgcgactcagatcgggggacctcccttaggagatcaatcccctgtcctcctgttctttgctccgtgagaaagatccacctatgacctcaggtcctcagaccggaccagcccaaggaacatctcaccaattttaaatcaggttcccacgccgaccctaatgccacttgaagcagccctgagaaacatcgcccattctctctctccatatcaccccccaaaaatttttgccaccccaacacttcaacactattttgttttatttttcttattaatataagaaggcaggaatgtcaggcctctgagcccaagccaagccatcgcatcccctgtgacttgcacgtatacgcccagatggcctgaagtaactgaagagtcacaaaagaagtgaatatgccctgcctcaccttagctgatgacattctaccacaaaagaagtgtaaatggccagtccttgccttaagtgatgacattaccttgtgaaagtcctttccctggctcatcctggctcaaaaagcacccccactgagcaccttgccacccccactcctgcccgccagagaacaaaccctctttgactgtaattttcctttaccttaccaaatcctataaaacggccccacccttatctcccttcgctgactctcttttcagactcagcccgcctgcacccaggtgattaaaagctttattgctcacg

SEQ ID NO: 167257 - DNA, 210 bp, Homo sapiens
cattcatctgtttgttcattcacctattcacccaccaatctatccacccattcacttacccaatccaaccattaatcccttccacctaccgactcatccatccactcatcccattcatctgtccactcatccatccatttactcagcaagcatgtcctgagccctgactagtatgagtaagtcactatccagctctcaaatttctcacag

SEQ ID NO: 167258 - DNA, 594 bp, Homo sapiens
tcccttttgatccttttaaggtcaatggggtctacagtgatgttccatctttgatttctgatattagtaaatcgtgtcctcctttttatctaaattagcctggcaagggactccaattttattgatttttttctgagaaacagcttttgtttttgttgattttctcccctcatgtcccattttaaatttcactgtgccctacttttactattatcttcggattactttggatttaatttgctcttctttttctagtttgctaaggtaaaagattaaatgattgatttaagatattcttcatttatctctaattctgctttcactgcatccataacatttgatgttataattttattttcacttatttcaaaatatttttaaatttctcatgaaatttcatcttgacccatatgtttcttagaagtgtattgcttaatcttcacagattttgagactttccaatgatctttctgttgttgacttctagtttaattcccttgtggtttaaggacagatattacatgattttcattctttcaaatttcttctattttatttttatttttatttatttatttatttatttatttattt

SEQ ID NO: 167259 - DNA, 261 bp, Homo sapiens
caaagtgctaggattacaagcataagtgactgcgcccagcctcaaatttaaactttttaactggcatggtatcacatgcatcttagttttgattccaattacagtagctgtgtaaatgagagattcaaatttggatgaacaggtcaggcacagtggcacacgcctgtaatctcagcactttgggggacctgaggcaggcagatcacttgaggccaggagttagagaccagcctggccaacatgacaaagtcctatctctac

SEQ ID NO: 167260 - DNA, 349 bp, Homo sapiens
tcttgtgtcccaggaatatcctttaaatcacgctgggaacacttatagtaaggcacatgtttactcagctgtctgttcccccttccagaatgagaggagcttcctgaggcagtgactgtgcctcatccaccttcgaataccagggctcagcaccaggtaggtgctcaatcccatgatgttgacaacttccaggttcccaatgcttacagaccatagcaagtcaagatgccagtaatgcttcaggtcagcaggacaggcagtgaagcgggctgtttttattgccagaaagtttaggggattcaggcaaggagacattctgggcaagaatgttgtgaccagggagctggag

SEQ ID NO: 167261 - DNA, 436 bp, Homo sapiens
ttgataactttaataaccctacatctattacagaaataaatttgtagataaaattcttctcataaagaaaattccaggccagatagtttcactggtaaattctaccaagcttttaagaaaaaaataactgtaattttacacaagctcttctaggaaataaaaattgggccaggtgcagtggctcacatctgtaatcccagcattttaggagggaggattgcttgaggccaggagtttgagaccagcctgagcaacatagtgagaccctccccccatcactacaaaaaattttaaaaattagctggatgtgcctctggtcccagctacttaggaggctgaggtgggaggatcacctgagcctgggaggttgaggctgcagcgagccgtgatcacaccactgcacttcagcctgggtgccagagtgagactctgtttc

SEQ ID NO: 167262 - DNA, 630 bp, Homo sapiens
tctgttttcatgctgctgataaagacatacctgagactgggcaatttacaaaggaaagaggtttaattggacttacagtttcatgtgggtgaggaagcctcacaatcatggtggaaggcaaggaggaccaagtcacatcttacatggatggcagcaggcaaaaaaagaggttgtgcagggagactcctgtttttaaaaccatcagatctcgtgacacttaaatcaccatcatgagaacagcacgggaaagacttgccttcatgattcaattacctcccacccactccctcccacaacatgtgggaagtcaagatgagatttgggtggggatacagccaaaccatatcagccatcttcctttggtgtcttcacgtgatgttccctttgtgcatgtgtcttgtaaatctcctcttatatagatactgttggattagagtctacctatatgacctcatttcaccttaattgtctacttaaaatgccctgtttctaaatacagtcacattctgaaggtagtgagcatcagaacgtcaacatttgaatttggggacacataagtcagcccatgataggtgacagtctgagaacccggcataatgatcttttccaaggctctatgcttctctggag

SEQ ID NO: 167263 - DNA, 263 bp, Homo sapiens
attttgccattcttgctaaacgtgttattacatgtaacacagcatctatcaaagaatggaagagtggaaattgctttctccactttattggtcctaatattcctcatttttgtgttgccttttgtaagccaccaaatcatagtattattactttgtttccctcttgaggagttaattcctgaattcttaggatctttggctgaaggagctcaaattgccttcacctttctttaaggtgctttcagagagtggggaaattgggg

SEQ ID NO: 167264 - DNA, 342 bp, Homo sapiens
tttattcttctggttgaagtgttctatccaagattattacatggctgtttcctctcttatcatcaagtctcaggttaccaccactctcccctcactccctgtcccagaggttgaccactctgaataaatccccagccaatctctaacacatcatcctgtttcattttcttcctattaatttttactacccgaaattgtcttctctagttctatagtcacccactaattctgtcttagctcccagaatgtaaagctcctgagcacgggaaattcttaagtcttgtccatcatttactccactttacatcaagcctagaaaagtgttcaggatgcagtaggtgc

SEQ ID NO: 167265 - DNA, 390 bp, Homo sapiens
aactgacaccaaaagcaagttgtctgaaaagatagaaaataaaattatacttgcaacactcttcccaatagtcaagatttggaagcaatctaagtgtccatcagcagatgaatagataaagaaaatatgttacatatgcacaatggagtactatttagccatacaaaaaaaaaatgagattctgtcatttgcaacaacatggatgaaactggaggtcatcattttaagtaaaataagctaggcacaaacaaacagttatttgtgggaactaaacatcaaaacaattgacttcatggagcttgagtacagaaggatggttaccaaagggtgctaagtgtagtgggagcagagggcatggggagaggtagggatggttaatggacaccaaag

SEQ ID NO: 167266 - DNA, 207 bp, Homo sapiens
agcagtgtgttatatcctgggtagggtaaaagataggcctagctggatgcagtggtgcatacctgtagtcccagcaactcagtaggttgagatgggaggatcgcttgaggccggcaattctgggctacagtacagtatgctgatcgagtgtccacactaagttcagcatcaatatggtgacccctcaggagcagggaaccaccaggt

SEQ ID NO: 167267 - DNA, 474 bp, Homo sapiens
acatattatgctcctatttacataacatatttgagggccagatgaatgagggttatctcaggatatctatcataaattactagaactttcttttcaaccttctccctaacatttcactattgttgtccccccaactcttctgttttttctacatctccttccaaatttgtcttctttcctgttaccttttctccctcttttcttttccttattcttttttctcttcccttctctcctttctttccatttaactcttttaattccttttctccatttctttgctttaactaaccacaatatagaactgatgtgtatattaattgttcattaaagtgactgggtaaattccttgtgcttaaatttaaaaagcaattttaaaagagtatatttattgttttaaaaaactcctaacataagttaatcaaaattcacagaaaaatgattaaaaataaatatactagattacaatagtta

SEQ ID NO: 167268 - DNA, 415 bp, Homo sapiens
cagttccatctagtgtaaggacagggcactcctcttcctgacttcaacccttaggtgggggatgttcccagtgagtatttgtcacagtcctggccccaggctatttcagggctgcctggccacttacctgccccttctttgacacattgtttgtgaacaggtggaggaacaaggtgggtacaatcccccttcttaactcttaacaatgcaagctctgattttcctatgtcaaatcctgtcttcgtaggtcgttatgatgcttgtttgtcaggacctgagtcctctcttttgggagagtaggaaagagaagcttgagtacctacccaaagtcactgggtaagccttgcttccataggtgggtgaggaggactacagtgggcagatggtagtaaggaaaatgaaaggaaagggaatt

SEQ ID NO: 167269 - DNA, 257 bp, Homo sapiens
atgccaaccatgcccatcactctgcccagtgccttccctggacatctattagcccaaagccaccaggacctcagctgagccggagtggttttcccacaccgaaggccagggttggggctcgccaaggcgactccaggagctccacgtcttcagaaactccagattcacaaggactcactgaagacctgccatgtgcccggcactgggtccctaggagcacccaccaccccccatagcccaccccaaaactcacacca

SEQ ID NO: 167270 - DNA, 387 bp, Homo sapiens
ggcaggcgctgggatgggggcttatggggtggcatcgtctctgggccctcctttccccctttgcctgttttcggatctgtggttcctttgaaagccagaacaatggatcggcttccttacccagcacccctccggtaggtgggtggccacgtggatgcctcgctggggcggtcttggaggcctggtctctgcctcgacgggagatccccgatcactggcattcaccccctgcaaaaatcggggcgacaatagctcactgcctacttgctgcagggagatgaaaggctttgcagaaagctttgagctctgtgggggaacacactagagaaccaaaaatgtgattatatggtgatataaaaatccctttcctctgtgtttaccaccacc

SEQ ID NO: 167271 - DNA, 238 bp, Homo sapiens
gcaggaaataggtatcagcagagaagtaaggtgtcatgggcccaggcatcctttccggaagggtcgactcaactggatgagcatggatgtccactgctggggagagcaaagagcttgatattttaatgctttggtttctctcagaagaatgaggcaggaagacttaaccgggctttgtaaattagttaacatactatttttttttctccagttttatactcttctctgctggatactt

SEQ ID NO: 167272 - DNA, 352 bp, Homo sapiens
tcaggatttctatttcttcctggttaaatcttgggagattttatgctttcaggaatttatccattccttcaaagttttctaggttgtgtctataaatatgctcatagtagtctctgataatcttttgtttttccatggtatctgttgtaatgtcactttattatttctgattgtgcttatttgaatcttctctctttattgatctctctttattgattactctagatagtggtttatcattttgtttatcttttcagaaattcaacttctcattccattgattcttcttctcattattttttttttagttgcaacctcatttagttttgctctggatctttgttatttcttc

SEQ ID NO: 167273 - DNA, 128 bp, Homo sapiens
agagggcgctgagggcttggcagctgtgcaagcccggctatgtgttcagggaaactttagttcagggagggcacttgggcaaagcaggggagggaggcagtggctggagcacaagaggctgaaagtgg

SEQ ID NO: 167274 - DNA, 621 bp, Homo sapiens
aaaaatcggaaaggtgatgtcaatctccagtgttttgttttaaagcataaatatacattcagtcactcatcttgtgaaattttcaaattgtcatctttgaatatgagttcacccactgctgttcagtatgactacatccacgatttgtccattatgacttctggttcggtttcttccgagtgagatgcttgggaaacagtctacacctcaactatttagattgctgtgattttccccaccagtctttttcagttggtttggcacaccttattaaggagcaccgtttttagtagatcaactcacagtattcaacttctagttttcagacaaacaaaactctgtctacacatacttcaaaagtttgcaacataaattatgactatgatgaatttaactggcataagtgggtttgggaacaaatggggctgttttaaataatgccttttttttctagtagctcgtagtttaatcagcattctcaaatttgagacatgagggagtatgagaagagtggtgttttgttttttagaaatctgtatgctgaatacacaaatatttatgaatatccaagaaatacgtcagtaaaactttccgaatcaaccagtttgattcagaaaatca

SEQ ID NO: 167275 - DNA, 380 bp, Homo sapiens
tgcctcattaagagctttgaaaaggcaaggaattttaagaaaaataaaaccgctaaatacagcaaatagtatgagagctgctatatacaaaatgacaaaattaacaaagttacatacccagcatctgtatagcaatttacagttgccaaaacattttcacatatatattcatgtatacatacatgtatgtgtatattcatgtatatgtgtatatatataattttatgtggtattcctagaacttctctacctaaagaggagcacacttcttccctcctggtgcaggaacactgagttatacgttcaagacctgagtcacattacaatttgttctgaattttaaaaatcaaaaagccaaacaaacactgacgagactaggt

SEQ ID NO: 167276 - DNA, 445 bp, Homo sapiens
tgctggagaagaaaaggaatgcttgcagtccctccagcaccctctgttggcaaagcctggcatcaagcgtcacccaggatttcagagcagggcagggcgaggtctgcatctgagaagcagcaccttcacacctcctccacgctgctcccagagccatctttccaaaatgtgaaattcattctggcatccccctaccagaggatcttcatggctgtcaaacagaaagtgtttcaactttttattttgcagtagttttagagtttcgcagcaaagttgtaaaaatgatacagcattctcaaataccactcctccaacttcctgagtgttaacatcttctgtaacattgtagcacagttaccaaaaccgggaaagtctttgggaggagctatgcaggctgtattcacactgcacgttttcccatgaatgcctttcttctgttccagga

SEQ ID NO: 167277 - DNA, 540 bp, Homo sapiens
cttctctgcaaatggaagaataggtatggctttctaaatactgttctatggcccgagggaacatgtaagtggggcaaaggaagaaaaatcttggttagggctgtaactgcctctgctaaggactctggccccctctaccagccagacatgtagaccactccagagggttctggctcatcactttacagaatggcacatcccaactgtcctttctgcagctgttgagaaaccaggatggcataatgggaattctcaagcaaaccattcaccaccaccaattgaaattttctccaatcaaagaatattcatgagaaatcctaggatttcactaacttactttcttcgatactgcttttttttaattttctttttaaaaaactcatgttccgccaggcacagtggctcacgcctgtaatcccagcattttgggaggctgaggcgggcggatcacctgaggtcaggagttcgagactagcctggccaacatggcaagaccctgtatgtaccaaaaaacatttttatttacctggacatggcacg

SEQ ID NO: 167278 - DNA, 299 bp, Homo sapiens
gaggtgatctagccgatcctttaggtggttgtgggtagatgaccagatgcctaaagaatggatgttgcatgggtgtgctgatggatgaatggatggtaggtgggtgggtgattgggtgggtggatggattgatgaatgaaaaagcagccacttattctcagaaaatatgcattctgaaacagtttagtgacatctgaggtcaatatttaggaaaggaattaaagtgttcttgaatattttaacttttaaaaattaaacacttcaaccgggcacggtggctcacgcctataatcccaaaa

SEQ ID NO: 167279 - DNA, 342 bp, Homo sapiens
tgactgggatgtggggagtgagtgaagaaaggcaacaaagctgattcttgggtttcaggcatgagcagctgtgtagatgactgtgtctacagaatctacctttcaaaaggttccggtattcctagaccatctcacaggagatgcccactttctcctctcagcacagccaccctgcctccaagtcattataacttcctctctagatcacttctttctccttagtttccctactacttgtctatgctgacttcaaatcaccccaggctgtattatctttttaaatacagctccagccatattattccccactcaaaaatctccaatgttccctatcacctacgt

SEQ ID NO: 167280 - DNA, 581 bp, Homo sapiens
gtgaaaaagaggaaagctcacgggactgggaggaggcagcatgcctgagctgcagatctatttttactcagcagtcaagccatgttagtgcctttttggatctcatctataaaaggtggcagctgatcaagggaccactaaggttctttccgcacctaaattctaaggctctattatcctcttccaaaaggaagcaaatgagcttggtagcacatgcaacacagaaaactggagaagcagtctttggggaaattcagggacttccctgtgattcgcctcggaaggagattcaatatgaaaaagacacaagggacaccaattcaagtttgtaccaagatcaggcccagggacttgctgtgcagacaggttatgttcactggggtgagtgctacagaaaagggaaattcatccacttgtttttctctttggtgagggaacgcatgattcagaacagcctaagctatcacatgcatatggttgtggtgctctcctcagggtaactaacaggcacgaagaaatttagatgtaagtggccttagtcaatcagaagggatgagctttcattttgaacgataactagg

SEQ ID NO: 167281 - DNA, 775 bp, Homo sapiens
gtaatcccagctgctcaggaagccgaggaaggagaattgcttgaacccaggaggcagaggttgtggtgagccaagatcgcgccactgtatgtactccagcctgggcgacagagcgagactccgtctcaaaaacaaaaacagcagcacgcttattttatcaaatgcaatattacaaggaatcttaatgtatttaaaaatgcaagtgtgctggcagaaaggggactgatgattctgtgactctgcagttgcagaagctccgtgtaggagattatttggacatagcgattaaccctcttaatcaggtgccacctccttcagggcacatgagatcatattaaattctttttgagatagggtctcactatgttgcccaggctggtctttaactcctgggctcaagcaatcttcccacttcagccccactttgggaggccgaggccggtggatcatgaggtcaggagtttgagaccagcctggccaatatggtgaaacccggtctctactaaaaatacaaaattagctgggcatggtggcacgcacctgtaatcccacctacttgggaggctgaggcagaagaatcccttgaacccaggaggcggaagttgcagtgagccaagatggcaccactgcaccccagcctgggcgccagagcaagactgtcttaaaaaaagaaaagagaaagaaaatctgtatgtttctagcccttctgtaaaatatgaagaaaagtgctcttagcactctgtgtaaaactgtactgttaaatatatgtaattta

SEQ ID NO: 167282 - DNA, 482 bp, Homo sapiens
gtaatcccagctgctcaggaagccgaggaaggagaattgcttgaacccaggaggcagaggttgtggtgagccaagatcgcgccactgtatgtactccagcctgggcgacagagcgagactccgtctcaaaaacaaaaacagcagcacgcttattttatcaaatgcaatattacaaggaatcttaatgtatttaaaaatgcaagtgtgctggcagaaaggggactgatgattctgtgactctgcagttgcagaagctccgtgtaggagattatttggacatagcgattaaccctcttaatcaggtgccacctccttcagggcacatgagatcatattaaattctttttgagatagggtctcactatgttgcccaggctggtctttaactcctgggctcaagcaatcttcccacttcagcccgccaaagtgctgggattacaggcatgagccaccacacccaacaagatggtattaaatctctt

SEQ ID NO: 167283 - DNA, 533 bp, Homo sapiens
tcttcaatatcatctagtaactcttaatatttaggaaactacaacccagagaggggaagtaacccagcaagttagggtcacagctggagttagagcctggtgtttggccttcaattgtgtcctattaaggatttgtgtctctggagcctgtgttactcatcttttgttatcacctatctctaccaaagatatttaaaggttcccgtgagaaggaaagatttcaagaggaaagaacgtagctcttttatttggaagcacttgttccagagtggccttcaggagacatcttcaccttctctaatgtgtttcccgcagagccctccatgaatctagtgattttttttccagattatagaaaactttaggaaatatagagaaaagtagaaaaaagaaaatgaatatcacttatcatccttccatctaatggaggatgggaatttttggtgggaggcgtgggaattttgcagagacctgcataacacacacttttttccctcaaattgttaatcatactgcatatacaggtttgtgtc

SEQ ID NO: 167284 - DNA, 470 bp, Homo sapiens
ctctctcaaactgcgtgttttaatgaaaactcatttaaaagcattgattgcatctgaccatctcatagtcttggtcaggtattttttgaagaattacacattgcttggcatttgaccaatgctaagtgggcctactgacatcaccagcaatctagaaattagaattatttgattccatagttatgtttgtaactaagagattgttattcttttatttcaaagctaccctaatgtcctgcatgtctccagtttatctgatggagctgaactaatctgagtatattatgaacacaagcaagtaagttattttaaaaaatgaacctacttgtactaaaaatttacaggtagaagggttgtctactaaccatattacctagaacagtgtggatctttagaaagttaaattaaatgatggtaaaaaatcacctcttaccaggtgcagcaaacacaaaatacagtaaacaaacaaa

SEQ ID NO: 167285 - DNA, 237 bp, Homo sapiens
gtatgttgaaatggcatgaggaaaagatactatcagaaatcaagctagtaaaaatgaggacactgaaagcagcaaagcacaaaagcatagtgcaaggtactttgaggtcctctctggcaggatgccctcttgttctgctaagaattgaatacttaaataatcattagttctttaaacccatttatatgtcagcatacatggtggatgcgttttcacatgtgactcattcccagggat

SEQ ID NO: 167286 - DNA, 393 bp, Homo sapiens
gaactaaaggaaaccaggagaattatgtctcaacaaatacagaatatcagtaacaagacagaaagtataaaaaggaaccaaagagaaattctagaattgataaatacaataactgaaatgaaaattgcactagggaggtttaagagcagatctgagtaggcagaagaaagaaacagtgaaactgaaaataggccaattgaaattatcaaactagaggagcagaaagaatgaagaaaaatgaatggaggccaaaagacctgtgaggtaacatcaagcactctcaacacataatgagagttccagaaggaaagaatagacagaaaaggaaagaattatttgaagaaataatggccaaaaacttcccaaatttgataagccaatttctcagcagaa

SEQ ID NO: 167287 - DNA, 323 bp, Homo sapiens
ctaaaccctcaggcagccactcatctgctatatgttactgtggattgtctgttctaaaatttcgtattagcaggctctcacagtatgtactcttttgtacagggcttcttccacttagcatgtttttgagattcatcgaagttatatgtatcaatagttttattcctgagttgtactccattgtttgaatacactaaaatgtacccactcatctgataataatatttttgttgcttctaattttgggcaattataaataaagctgctatgaatatttgtgtaacaagtccttgcatgagcaaatgttttcatttatcttaggt

SEQ ID NO: 167288 - DNA, 519 bp, Homo sapiens
taccatagctaaaatcaagacacggcttagatacaaccttacagctgctgccggcaagtggctgctgtgatgcggtgctcactgcacactcatgcttcacactggccacaccgctcagactatggtcatgccagctaagtaacgtgcactgttgctaagactatgttgagtttaaattactaattaaagtattcaaaaagattacactgtagttgcataatacaacaaaaagtaacgttctgcatagaaagatactgaaatagcgcagcacggtggagaggaaaagctaggatgagaaaaaggggatgctagggaataatataggaatagggaagagtagagaagaaaaaaagaagagtggaagaaaattttccagaggttatacctccaagtcttctgtgtgttaaaaacatataaacctcagaaatgtttgttttttcttactgatagcaaacctaaaaataattttttttcattacttctgtatggttcacttcagaatttctgtgcccatttcaa

SEQ ID NO: 167289 - DNA, 327 bp, Homo sapiens
gctacggcatcactaggcaacaggaattttcagctccactaatcttatgggaacaccatcttatacactgtccatggagtgaaacacaggtacgtggctgtaattggagtccctgaagggcaggggagggacaaaaacatggccaaaatgttccaaacttcatgaaaaccataaacccacagatgccaggagcccagtgaacttcaaaaaacatgatgaattgttgcttgtttttaagcaatcttatttaaaatgttgcccactgtcttctggcttgaattgcttctaaagaaatgtttctcattctgctatacattatacttttaa

SEQ ID NO: 167290 - DNA, 344 bp, Homo sapiens
actggtaagaaagtgactaataaggaaagaaggtagacgagtaaggaaggaaggtagactagagaggaaggaaagtagaccagtgaggaaggaaagtagactagtgaggaaggaaaactaacaaggagataatctccagaatgggaggagagtcaacatgaaagtatgaagaaggatccatggaagcagaagccctcagctctccctagagctgtcagggaggctcccagaggacacggcttttgcatgcaactagaagaattaactaggcatctaccaatgggcaaaggaggaaaggagactccaggaagaaaggcagtgatttgtatgatccattgcaatgg

SEQ ID NO: 167291 - DNA, 447 bp, Homo sapiens
gagcccaaacaaaatgcagactgtgctctttggcttgcacagtatttttctttaatttgggattcgttagcaacatttttaaatcaggagattttatataaaagtcagaacttctaacttgtctctaaagagggcaagttctggtgacactgggcacacatcctcacctgccaccatcagctgaggcacttagagtgccagcctcaaatgggctgtgtatcctgcagttaacaccatcagcatctctatgtacagtctcacagccaacctctttccttcatctggcttcctgcccagcccctgggtgcacctgagcatgtggtctgtgcagagtggacagtgggctctgatcttgaatctcacatcccctcttgttagaaccaaaggagatctactctttttgctgtttgagacagggtccgagatacagccgcgagaagtaccgac

SEQ ID NO: 167292 - DNA, 251 bp, Homo sapiens
agtagctgggactacaggcgcgtgccaccacgcccggctaattttttgtatttttagtagagacagggtttcaccgtgttaggcaggatggtcttgatctcctgacctcatgatccacctgcctcggcctcccaaagtgctgggattacaggtgtgagccaccatgcccggccacctttttgtttttaagcccttctgccagcctcagaaatagcatcccatttgcactggcatgtacaaagcattagagt

SEQ ID NO: 167293 - DNA, 542 bp, Homo sapiens
atgactgtgtcatttgttgcaaagctgcacgtcacgtgcttttcctgaagtctctactttgaatgacatttgctcattcattcagtcaaccaacacctatttattgggcctctccttagggccagaagccaggaagagagttagggacctgctgcagagcggttgagtctcatgcagctctcccagcatcccttcggagttagtttaattatccctgtcttacaggtgaagaaactgagatcatagacttgctcgaggattcagaatcaaagttcaaatccaaatgtgcctgcttcgcgtctccaaatctggtttctccatttcatcgcctgtcccttccggggttggggtctagtgactgtgtagccatttgtcatgggttttggccccaaattatcctcaggcgacgacccctggggtctgggttgagctggcataattgggagctctgtggttacacaaacctggtttcaccagggtcatggggcaggtgcagggggtctcacctcaatgggggagccatgcaggggctcctctctcct

SEQ ID NO: 167294 - DNA, 508 bp, Homo sapiens
agaccgtaccctaatacagggaatcccacgggatatctgagggatgtgtacttttggaggaggttgacggtttctaaggatgattctttctgagtgaaatattgtcagtgtcattgaccttttcattatttcaactattattattccaggttatcaatactctggctgaccatcatcatcgtgggactgactttggtggaagtccttggttacatgtcattattgcgtttccgacaagttataaagttgtcattaccctctggatagtttacctttgggtgtctctcctgaagactatctgctggtctcgaactcccaacctcaggtgatccacccgcctcggcctcccaaagtgctaggattataggcgtgagccactgcgcctggccagtagtttcttacagttatcattatgaactcataaattttcatatacttgtgtttaaatcactttttgtttattattttaatgctcaaattgtcctatcgttggccattaggaatgttt

SEQ ID NO: 167295 - DNA, 378 bp, Homo sapiens
ctggcatcacttcccaaataaactacttgaagtcagagcttcagaatctgcttctgggggacccaaacttaaataaagggcagatacggggttttggtaagtcataccatgcagaccttgtccagtgtctgcccatgggtgaaaattcagagcagcactgaaaaggtcattgcatgaagaaaatacccagacttaactgggaaaggagaggaatatagaaaagaaagttttactccctgctgcattatttaatcttttcttgtacctcatttactcttcactgaacaattttgcaagataaatctgtcaatttcctttcctgcaggtaaagaaactgaggccagaaagattaagtaacttgcccaagttcacagactt

SEQ ID NO: 167296 - DNA, 318 bp, Homo sapiens
attaacagttggctatgactatctagagtaagcactgcatttatttttccaagatgttgtcatgtgacataacttatggccagtaggatgtaagtgaatatttttggcagttctggaaacctctcttaaaacacagctggctgaatatattaatatttgagaaatctgggtgagggatatccagaaattctttacgattttccccagttctgtgtaagtctgagagctcataccattctgatgccagcagtggaagaattcatgattggtttggagcaaggccacaatatcaggcttacatccatattatatgacaga

SEQ ID NO: 167297 - DNA, 263 bp, Homo sapiens
tcctatcaatatatgggtttctagagtatatttcccatcagaaatattcaactagcttaaaataccagtacactgatgttgaacattttaagtattttatatttcccacagcaagggcttttaattatatggccaatcttactttgggatgaatttcatcctcaatttctgaacttcttggcatagcaaatgtgtgtgtattgtgtgtgtgtgtgtgtgtgtgtgtgtgtgtgtatacatatattcttttttcagtaacgtta

SEQ ID NO: 167298 - DNA, 437 bp, Homo sapiens
tctttccctaatgacttaggcatatactaaatgtgctatacatatactgaaatgccttcataattcaaaatatgcattatgaatctcaactattaaagtgtgtttaatgtacacataaattctcaaggactactgaaatatgtgaagttatttgatcctctaataagtatacgaaatctccatgttttgtagtgtatctgttttctgttttatcggtcaattcttaaccgtccattggtctgttttttataacctgcccttttttgaaaaagaaacaaaaaagccatgttggctcagtgaattctaattttatagattatattaagacagtagagactgagggagccttctttctttatagactaacgcaatgtaataaaagaatctggaagatcactaacttgctctgtgatccagacaaagttatttaatctaca

SEQ ID NO: 167299 - DNA, 289 bp, Homo sapiens
cagcatgctgtttccatgttttcaccattctttgataactggtcatacagatgggcatttcctgtcttcttttcttagcctctccaaatttagatcaggctcttggctttagcttaagacctgtctctcttagtttatggatgaggtagtgatgattctgtgtaaagccactaaaccagttctggcatgaagaaggctgcttgtgttcttcacaatagcgaaggcatggaatcaacctaggtgcccatcaacagcggattggataaagaaagtgtggtacatatacacc

SEQ ID NO: 167300 - DNA, 309 bp, Homo sapiens
gagagaaagcacacacagttcagggctaatgacagggcaccgcaggtaggaacatgactgagccctacagcttgcacatgtgtggttgggcaaaagacaattgcagatgttcctggaattcccaaaccggatacaaaatcgctagcaggatgcagagaaagaggaatgagccaagtgttttacataatgagaagcttgcctcccgcctggtctctctctctctctctctctctccctccctctctctccctctccctctccctctctctctctccctctctccctccctctcagtgccgtggcgggtcg

SEQ ID NO: 167301 - DNA, 382 bp, Homo sapiens
catgaccacactacccaatatctccaatttgaagaggcagagatgaaaaactttatagagcccagtatcaggaaaagtttctcttccctgaggaagtaattgctacagcttttttctaccttataaacaacaacacatcatgtgtaactcaagctgctcctattttattttccgttttaattgattcaggaaacttaggactctaatcatttgctccaacccaagagctcagcttctggtttatgtactgggactcaagtaagatttcattggaagaaaaggtcttattattaaaaggtttgtaaactactgttctattccctaatttttatagacttacattttcccattttgctgtttttattcctgtaaaccacttcaa

SEQ ID NO: 167302 - DNA, 123 bp, Homo sapiens
aatgacaatgacctttcataatacacacgtatgacagtttcagaagtataactgtgtatgagaaattatcttggattttttcaacattacagctaatcaaacacactgatattttatttgatt

SEQ ID NO: 167303 - DNA, 314 bp, Homo sapiens
gggcagaggactggagggaatgagacagcacacttccaatgactccacttgctgctagactcaagggctgaggtcaaggagactggggtaaggaagggagcagcgactaggtggagtttggatgattgcttgatttagttagtgccagggcgggatagctccaggctgacttggatcatcttccagcctgagaagcaggaagtgaaccccccaacccccacccctgccacaggaaggcagccagtacctgggacctgccaagttcacatggcagaagccacagcttcctttgggcccttcaccctggtcacagg

SEQ ID NO: 167304 - DNA, 245 bp, Homo sapiens
gtgccaccaacttcagatgcccattacaagtagtagattgccacctatacttctgaccaccaagctataaattgggactcccactgccccctccttgggttcaattaatttgcttgagtgggtcacagaactcagagaaatactacttacattttcccatttattataaaggatattacaaaataaacagccagaggaagagttgcatagggcaaggtacgtggaaaggggtatgaagttttcat

SEQ ID NO: 167305 - DNA, 202 bp, Homo sapiens
aagcaagcaacttcccccacggccttaagggcccaccggtcaacccggggtgagtggagacaatagggtttgtgtcgcaggggtcgttgacatcacgtaagaatgcgcaggggtgtccccatctagggtcctcatcccccaccagaaaggccctccgaggctacggtggttgggatggcgtacctgagcgagtgtcgcctgc

SEQ ID NO: 167306 - DNA, 344 bp, Homo sapiens
tctaggtgcacgagccgtgcggtttgttacatccgcaggctggctgccattgcgtagatttatcatgcctggaaaacggaccatttaaaacgttttcttacaccatcgaagcacatctgggctgattccagtttctggtgcttatgaataaaacagctgtgaacaactgagtggagtttattggaccatttttgacctctagtaatggtgggctcacatgtttgagttgagttgggtcaggtgctgagtgcctgctgctgcaggcaccaccttgtgctttcaggttaactctaaccacacatctcatgccttctctgtgcatgtatttgaagttactgaaaaag

SEQ ID NO: 167307 - DNA, 419 bp, Homo sapiens
aaaagcccaatataaagggctaaaaaagacaacttctggcacacaaaaacacacaaagtattactaccaaagtatagcttttctgatattacacaacaaagttaacaaaacaaaaatgaattaagatctcaaacggctgcgcgtgatgcttaagcctgtaatccctgcactttgggagatgaggccgggctagaccatgaggtccggagctcaagaacagcctggccaacatggtgaaaccaactctctgactaaaaatacaaataaggaattaacgggcgttttggtccgagctataatcccagctactcgggaggctgaggcaggagaatcacttgaacctgggaggcagaagttgcagtaagccgagatcacgccactgcactccagcctgggcgacagagcaagactccatctca

SEQ ID NO: 167308 - DNA, 502 bp, Homo sapiens
taaaggaagactacaaagacatcaagtaccaggtaggagtagagaagggagatacttctagcaggaagaacagcgtgggcacatttacacatcatcgtgtagtaatctttgcccattcctctctgagagaagtgcacttatagagtgaccaactgttctggtttgtccaggccatgggactttcaggaccaaaaccaggagagtcccaggcaaactgcaatgagctagtcacttcatcaagtatcactttcaaattttaagtctcccaggtacaagttatgttggcactgatactacatagtttaaaggatgagcttgggagagttgggtttgagtcctggttccagcactcaccaggttaaccttggacaagctgatcaaagcctccattctatcatctgtaaatggtagtaatatctgccccactggattctttgggagagtaagcgatgggaaaaaacactcaggacaatcctcattagtacagtgatgagtaaaaaaa

SEQ ID NO: 167309 - DNA, 521 bp, Homo sapiens
acctcccactgcacggctcctcaggcctcctgtgacctccccgagacatcaaggccggatgccatcttcccctacagttgagaacaacctgacaagtccctgaagcatctcagtaactgtgcgtgtttggggttgttctttttaagtgtagctactgctcagggaatgcttaggcacaaacctgaggggtcttgggctaagaaaatatgtttccccaaaaaaaccagcaaatggagaggagacaccaaaaccataaccaggagaccgattcggggctttaacgaggactcgctgaaaaagcgagggagcaaaacaaaacataacaacagagccgaggctgttaatacccttctctgatccccaggaaactaaacacgaggacttcagggagggttttttggtttggacttgtttttttcaccttcactcggtatcattttgagtttaggaaataccatttccccttttcgtgcaaaggcaaatgtcttaagtatcatctaatttagttctttccctagttt

SEQ ID NO: 167310 - DNA, 517 bp, Homo sapiens
ttatcacttccccaatcaatactcttataatttcctatgcctgtctttactttaatctcttaatcccatcatctttgtaagctgaggatgtatgtcgcctcaggaccctgtgatgattgcattaactgcacaaattgtttgtaaaacacatatgtttgaataatatgaaatctgggcatcctaaaaaagaacaggataacagtgattttcagggaacaagggagataaccataaggtctgactgcctgtgaggccaggcagaacagagtcatatttctcttcctgcagaaagccaataggagaaatatcactgaattcttttcccagcaaggaataaccctgggaaaggaatgcattcccagggggaggtctctaaaatagccgctctgggagtgtctgtcttatgcagttgaagataagggatgaaatacaccctggtctcctgcagtgccctcaggcttgctaggattaggaaattccagcctggtgaattctagtcagactggttgtctgctct

SEQ ID NO: 167311 - DNA, 569 bp, Homo sapiens
gaattcacaggtgaggatcaagcccatctgcccagaagagccccaaacatgaagatggcaagtgcatgtgtcagtgtcccaacacaaagccctgagaggttcctcaattcccctgctcacagtctagaaagtactaatgcagtgagtcagtgtcccaacacaaagccctgagaggttcctcgattcccctgctcacagtctagaaagtactaatgcagtgagtcagtgtcccaacacaaagccctgagaggttcctcgattcctctgctcacagtctagaaagtactaatgcagtgtgtcagcgtcccaacacaaagccctgagaggttcctcgattcccctgctcacagtctacaaagtactaatgcagtgtgtcagcgtcccaacacaaagccctgagaggttcctcgattcccctgctcacagtctagaaagtactaatgcagtgtgtcagcgtcccaacacaaagccctgagaggttcctcgattcccctgctcacagtctagaaagtactaatgcagtgagtcagtgtcccaacacaaagccctgagaggttcctcgattcccc

SEQ ID NO: 167312 - DNA, 192 bp, Homo sapiens
cacgcacctccgacggaacgacgcaaccatcctgcgaaacacaagaaccaaacctggatccgatagggcctcagggtccgctatctttttaaaatgctctttcacagaaagagccaaggacagaacaccttgtccttgtccacatcccagggacataaagacacgaggaaacaccaggagtgccatctccac

SEQ ID NO: 167313 - DNA, 846 bp, Homo sapiens
gactaacggtggacttctcagtgggaactttataagccagtaaaagattgggattctattttcaatgtgcttaaaggaaaaaaaaattgtcaaccacagattttgtattctgctaaaataagtttcataaataaaggagaaataaggtacttcccaaacactgatggaatttatcaccactagacgaaccctataaaaatattcaaaggagttctaaacatggaacaaaatggtcaatgtttgccatcataaaaaatacacaaaactataaaactcacaggtcttataaaaacagttagttacacaaaggaggaagagaaagaaatcaaattacaacaggacagaactccaccaaacaacaaagacaaacagaaagagggaaaaaaagatgcaaataatgtacaaagcaatttgataacaattaacattatgatagaaacaaacctcacatataactatgaacattgtacataagtagataaaatgcttaatttaaaaggtatagattggcagatgggttttttaaaatatgaaccatattttcataagaactataagaaactccccatattggtaaagattcttatagcctgaaggtaaaggactagaaacagatctcctgcacaaacagaaactaaaagtgagcaggagtatctacgcttatatcagataaaacagacttttaatcacaaaagtaaaaaaaagacaaagtcagtcattatataatgtaaagggatcaattctacaaaggacataaaaatcctgaatatatacacaccaaacactggagcagtcagagtcacaaaacaaatattactggacataaagagatagacagcaatataa

SEQ ID NO: 167314 - DNA, 272 bp, Homo sapiens
atggagagcatgaggcccaggaacagaatgcagaatacagtctatcctggattgccaagagtgttcctggtcatgcctcctctggtccgtttctgaaacctgcatgtggagcttgctggctgtgggagccaggtagactgtaaatcctgctcgcctgcccacggggctgtcaggaagctggccctccactgcctcctccagaaggccggcagctagcccttgcctctgcatgtttacctttcctgggaggcaaccgggccggacataggagg

SEQ ID NO: 167315 - DNA, 277 bp, Homo sapiens
catgcctctagtcccagctactcgggaggatgaggtaggagaatctaaagccaagaagttggaggctgcagtgtgccaggattatgctactgctctccatcctgggcaaaaaagcgagaccctgtctcacaaaaagaaaaacaaaatgcctttggcagcactgtggaggatagtatgaagaggacagagactggaagtaggaaaaataattgacaagctgtgcgttaaggcacaattgagaagctgtgtattaaggtgcaattaaggagaaaaattt

SEQ ID NO: 167316 - DNA, 180 bp, Homo sapiens
gctcccaggcactgccctctcggatttcttgccttgttatttaatcattaagatcgtgacctatgagcaggactgtttccagccagcacatacacatgtcctctcctggccagcatccatgctgattagacggtgcccctgccatactagctgcctaatatttcagataccccaccccgt

SEQ ID NO: 167317 - DNA, 226 bp, Homo sapiens
tggggatggtggcgcactccaggacagttatgacccaagagaagaagggattagtaaggaagttaaaaaggtacactgagataggttttaaaggatcttagacttacacaccataatagtatgaacattatcctgtagggtgtgaggagctaccaaagatttttatgcaaggaagcgaaacaataaagaaaaataattggcaatagtgcaggggctaaactggcag

SEQ ID NO: 167318 - DNA, 721 bp, Homo sapiens
ggcaaatggagtgttcaggttaagtgtgcctgcccttcttcccttctttctagaataactctgtttgggattgagatgcactaattatttggaaattagtttgctaatttcattggttatttcagtaagttgaggggagaattggaagtttagtttgtttgcttttcaatcccatctgctcgttgattactaatcattcctggacgtgcagtcacgtaatttattctgtctttgagtcttctccagagagattagtcatttgaagtggtttagaggatacctcatgtctgaattccacagggttagcagaatgtgtgagtgggttatttgttcttctctgggctgctcagtgttattttgggctagttgagaatgttgctttgtattacagaccccatcaggacaatgcaatttctgtttttatcaataaaacttctgaaaactcctcctaaaaagcattcacatatgagttattaaaaatgtttgaacattttgattctttaattcctctcaaaataagtatctcttaagatatatggggaagaaacctgccactgtgttaatcacatacttaattgtaccaaaaattaaagcaatgcagtaagttaaagtatatacacatggtagaatattatacccattaaaatgagcaggataaggaccataaagggtctcataattaaaaaattgacataaatgtttgtcgcataactttagataa

SEQ ID NO: 167319 - DNA, 614 bp, Homo sapiens
taataatcctcatagtaaaatgagtaaattcataaatcatataccagatggcccagggaagcagcccatgaatgtgttaggtggcacttataaaaaggctttttgggaaaggataatcttttatagttatgcaaggaaatgatgtgattcactagattatatgtgtttggggatgagaaagattagaaaattaaggcagttttttaaaaagttggcatgagatacagcaaaacaactggatggaaggcattaaaggcagagactggggggttttatttctattctggagaatgaaccagactccaggcctgtgtgcgcccccactgtaccccttgcttcctttccaaatagccaataaaaggctgcaatgaagtgtgtctgacaagcagtcccaatggcaaaagaatatcaagactgtttcaattatgtagaagaaatgtggaaaggctgcaaacagacactgacagtaaggtattaaggtgttataatagctttatgaaatattataggagaattcagagtttgataataggtatttgacagctttctacctcttagatagctttctgttctctgtagactcaagataacgttaataaataagtttaagactg

SEQ ID NO: 167320 - DNA, 292 bp, Homo sapiens
caacgcgagcagctcagacatccccacagaggctctgggagcttaaaaagcccacgtcaccctagaaaagaggctattaaggtgtggcgtgatttgcactttcaggcagaagctttttaagctgctgcagagcccaatcacagggagatgaagacttcagtttctcaagatatgcaactcttctgctgatgaaggagaatgttcccgggtgcaggtggagtgagaacgggttcctggcacacattcagcaacctggtgaggagagctcggaccatgtcgccgtcacctcttg

SEQ ID NO: 167321 - DNA, 121 bp, Homo sapiens
aaaaggaaagaaaaaagaaaaacagaaaaagaaaaaaaagtagtaaaataatagtattaaatgtttatttaactcttcttttgtgccaagcactgttctaagcactttacaaatgtaactc

SEQ ID NO: 167322 - DNA, 248 bp, Homo sapiens
atatgaagagtgcttatatttatcactgacattttgttgaacttgttcattcttattaatcactgctttaaagtaagcagctgagtactcttaggaagttgatattcccagctgacctatctgcaaaaatagtgaagcttgatactctcttgctgcagtctgtctctatagatgtatgtgttcgtgtggctatgtgtacatatgtgtgtatttttttttctgggattaaagaagcaaatacattttcg

SEQ ID NO: 167323 - DNA, 195 bp, Homo sapiens
accaagaaaagaagagagaagatcaaaataaacacaatcagaaatgaaaaaggagacattacaactgatcatggaaatataagatcatcagagactattattattaacaactatatgctcacaaactagaaaagctggaagaaatggataaactcctggggacacaacctcctgagattgaagaaatagaagccc

SEQ ID NO: 167324 - DNA, 587 bp, Homo sapiens
gtgatttataatcctcatttatttgatgagacagattgaattacagataggtaaataacttggctgcaattgaaaaaattggaggagctgggatcagtctcatatgcctctaactagaagttctggccatgatagctttattatatcacctccaaatgacctcctagtcactaagtcttcatcactatcagaacatgagataatattttgtattttcttttctaataactcactaccccatctttctcgttacagttcactttccccaaccctccaatgccagaatccatcctctctgtgtgaactggaacgaggtgcactcagtcacgtaggatggtgactaatcaactcattacactttagagtaaatgattttcaataaattgcctcatccaaacatttctatcttaaaccattcatctctgctgctcaaagtttaatctgtttctaaaggaacttagacatctgcaagtagttgaggaaaacatttctgaaaataagaataatgtgattcatccaacacattttattataaagtttactgtgacggaatgaaatttgcccccttgaaaattcatatgctgagg

SEQ ID NO: 167325 - DNA, 609 bp, Homo sapiens
tgaggtcaggagttcaagaccagcctggccaacaagtgaaacaccatctctactaaaaatacaaaaattagttgggtgtggtggcacacgcctgtagtcccagagtagctgggactacaggcgcacgccaccacgcccagctaaattttgtatttttagtagagatggggtttcaccatgttggccaggatgttctagatctcttgatcttgtgatccgcctgcctcagcctcccaaagtgctgggattacaggcatgagccaccgcgcctggccaatttttaaaatttaatcatgaggtaaggagctttcctttgtgatgatcctaatttgttacctttaacacttcaaatggtaaattgggatttaacaagtctttgcagttaatctagagatctgtggagtcagctcctccagaattaccctagctcattttttatgataacctaagctctccagcaccttcccaggaggttcttctgttctccagagagctccctccagtcaccaccactggactcatcagaaccataggaagactataacttaggtctaaacaagacagtcactaccaaccacagtcttacacaggattgtagtatagaatgtg

SEQ ID NO: 167326 - DNA, 559 bp, Homo sapiens
  misc_feature (418)..(418): n is a, c, g, or t
  misc_feature (461)..(461): n is a, c, g, or t
  misc_feature (519)..(519): n is a, c, g, or t
tgaagctcagtgcctgctcgcaatcctggctgtgcctacagtgttttactcaacaagttctggataatctctcctgagcttgtcaatgataccagaggtggaatggatggtggtacagagcaaggctatggaatctgaaggtggtggtcatcaccctcacttgttgtatggagtcttgctctgttgcccaggctggagcacaatctcagttcactgaaacctccgcctcctggattcaagcaattctcctgcctcagcctcctgagtagctgggattgcagctacaatgccaccaggtgatcggaatttttcagctccattaaaatcttatgagaccatcactgaatatgtggtccgtcattgaccaaaacatcatgatgcagctcatgactatagttctgtctcagaagatccaggnaatagtaggttcctccgaggccggtagcccattcagtatcttngccaatggatgtcttatagactaagattcagctctcttcagactaagatcacagcttnggtgtgatttgatcctgcttcaagctggcaaagctcagaa

SEQ ID NO: 167327 - DNA, 362 bp, Homo sapiens
tgcagcctcccacgtgattcagatggtcgctaaagtgggaagaccaggctcctgaaagagcggatggcatctgcgcagttgaagcatcgtttgtccattcactcattcagcaaatgtcactgagtctcttgaggtgccagcgctgtctctggtgctgaaccagggccccgcgctcacggcattcaccttccagtggaggagacagcttgtatctgagggagtcccccagcagtcagaagggacacgacgggttaactgaagagggcttaataaagggcaggggtcgggaccgaggctgtttatgccaagatggcaaaacccaagaggtctgtgggtggcgacgtctgagactctagcggccg

SEQ ID NO: 167328 - DNA, 122 bp, Homo sapiens
gggaagcccttgcccagcctatcagcaataaaatcaagccattcggttacctcctaaagtgagaaagttgttatttctcccagttaactagttttatatcctagttgttagcaagaatcgtg

SEQ ID NO: 167329 - DNA, 538 bp, Homo sapiens
tctgcttctaatgggaaagggcaccactctcctcagccacattattggggccccacagcaagactgcttgggtctcaaggaaatcgagcttaatgaatgagagcaaaccctcttcatttggccatgtcagcttgtcaggaagggtccatcaatcagccaccatgtcttacctgcctttaggtcctattgctgagtttgacttctaaggatacatttggtaaattcctttttttcttgatgaattacctcttattggtccctaattccttctttaacttttttcttttccattttaaaagcaatataggttcataaaagtaaattcaaagcagtagagaaaaatgtaagataggaagtactagcctgggcaacgtggcgaaaccctgtctctacaaaaaatacaaaaattagccgggcgtggtcctagctactcgggagactgaagtggaaggcttgcttgagcccaggaggtcaaggctgcagtgagccgtgatggcgccactgcacttcagccttggagacaggggagaccctatgt

SEQ ID NO: 167330 - DNA, 574 bp, Homo sapiens
gggagaaaataaatatcgagtcttcactgttaagtatgatgttagctgtaggattttttccagtcataaataggtatcacattttgttaaaagctttttatacatcttttgagatgatcatatgggcgttcttttttagtctattgtatgatcaattacactgaagaatttatatagaattagtattatttcttccctaaatgtttagtagaatttatcagtgaagccatctgtacctgaaattttatttgtggaaagatttaactagaaatacaatttatttaatagatatagggctattccagttatctatttcttcttgagtgagtgttggtagtttggtagctggtgtctttcaaataatttctccaatttgtctaaattttcacacttactggcatgaagttgtttataatattctcttattatctttttgatgtgtgtgaaagctgtagtgatgttccatctttcatgtcttgtattggtgatcttgtcttttctcttgattagtctggcatttttttaattttattcatcttttttagaaaagagcttttggttttattggatttct

SEQ ID NO: 167331 - DNA, 266 bp, Homo sapiens
cactgcattccagtttgggcaacagagtgagagcctatctcaaaatcaaaaacaaaataaccagtctaaaatccttcagagacaattaacatgccagtcatacccaaaatgttagctgggggaaatcctactcataataaagttttgagaggtagtttggaaaactagtttagaaagaaatcacataaccactaatgtgtccaaaagatctgtcatttggaggagttacacagactacaaagaagggaacaggtgttacagtaggg

SEQ ID NO: 167332 - DNA, 332 bp, Homo sapiens
cttatctagtcttacctactactacctactacttactatactgcagaaacaacacttaacctctcaaagtcagtgtgctcactgctaaaacaaagatagtaacagccaccttgcagagctattataaagaaaatagaatgtaaaaaatcagctataagcctaaagaggtgtacctagtacaagatactgcttctctacttccaccataaaatctagcttataattaagggcctccaaaacaatgaagagaacaacctctatcagtgtaatacaccccagtgtctaataaacctatgagaaagatgtgtcttcatttaattcctttctagcac

SEQ ID NO: 167333 - DNA, 121 bp, Homo sapiens
gggagacagatacctctttcagcaagacacaggaaagtgaaaggatgtcttatctttgatgtaggcaaaatatccagttatgaaagtctgagcgccttattgcatctcttgaatacctgag

SEQ ID NO: 167334 - DNA, 491 bp, Homo sapiens
caattgtaggttgtatgtgattatagatatatgaacatatgatatactctgaaaataattttcatgtcattttccattggcactgataatttaaataaaaggtattcttgacaaagagtaaaatgcaaaaaaaaataaaagtataaatcaataaaacatgttagaattattttaccattgaaaaatccaaattaactttggatttgtaaaaacccttccattattttcccataacactaatttttataatgaataaaccccaatagaaatgtattttatggagagaaaagttgtaaatagatatcatatcatatgtaatagtttgatacttatattagactttctgttggatcattttgtgctgaaacttacaatatgccatttactactcacaactgtgctgtgtttattttctcttttccctgaagatggctaaattgtggttgatctgtgttgcactaaatctcttttaaataaatctcacatttgac

SEQ ID NO: 167335 - DNA, 450 bp, Homo sapiens
gttgtgtatctaatttcgtttgcaaaaattactagataggtatagaaaattacaccaaactaaattcagttatatagaaatacttcataatgcatacatattcatctcatgacaatgagccatgccaagccacatctggtgtaaacatatttagtagatttttatcttaagtaattgtccttctcccacttcacaataactagctgtactcttttcaacagccaccctgttgacctttagcctcctctcaggcttttttgcactttcccttttcttctttgatatttttcttcctttacctctcttttctcttactcttttcctctctctctttctctgtctctctctctcattttgtttggttttctctttcttttacctcaggagccaggtgggcagatcagaaggaataaaacactcacttttgcaagaaaacttcacctctttttt

SEQ ID NO: 167336 - DNA, 98 bp, Homo sapiens
ggacagtccaagaatttggagagcatgatactctgccacaggacactttaaaaatcttctgttaaaaaagtaaagttctgttgtgtttaaagtctgtt

SEQ ID NO: 167337 - DNA, 704 bp, Homo sapiens
catgctcttctagaactttctcatccctcagtcaagaggtggagcctatttacccttgaccttgaaattgatcaggactttgtcactgccttgctcttaacatcaccatgctggagaaatagcatggcaaggccagctggtgatagagaaagatgcctaaggagctccagctgctattttccctggatttttgagtcttcccagtccagccagacatatgactgggcaaaaccctcaggtaactacagccttatccactgtctgactatcacaaaatgagagaccttgggtgaggaccacctacctgagcccagtcatcctgcagagatgcgagaaaaataagaatgtcattattgttattttaaaatcactgagtttgggttaatttgtatgcagcaatagataactgggacacaaagatagactgtaaaaaaataaagagggaatggttaagctaaaaacattgtgatcaaatcaatgtttagtaagtaagcaagaaagatggctatccagggaagagagattgcacaacaaaatgaaaatgaaacaagcaaagaaacaaagcatggattataacttgtaagagagaaaaccatattaaggggagttatttgaatattttgtatgaaaatacagaaatcagatataagtgagctgacactgactttggaggcaggaggaaaactgatggggaattctgggaa

SEQ ID NO: 167338 - DNA, 379 bp, Homo sapiens
gtggggtgaggttctgaaatcaaagactgatgtaaaagtggcaaatggtcaaaatacagccccttaaattgtccatgcaataaattatgatgtccgcccagaattggaacagctcattattttacggctaagcaccagataaaatagtaggggacttgcaggctaggtcattcttgcattgctataaagaaatacctgagactgggtaatttatttaaaaaaaaaaaggtttaattggcttacgtttctgcaggctgcacaggtatgacaccaacatctactgagcttctgcgggaagcctcaggaagcttacaagcatggcagaagttgaaaggagaagccaggctggacacggtggctcatgcctgtaatcccagca

SEQ ID NO: 167339 - DNA, 555 bp, Homo sapiens
gtttgagatgagccaatcctgactccatggtgccaccagggatcacgaatttaataagatcttcgtggatgcttggaacccaactgatctctgttttctactttagggaaagagccacagcttaaatggggtggttttggtgtcacataagctatcaataatacccacgttttggtgtcacatacgcgattaataatacccaccgctgcagaggaatcaccgtggactactgctcgtttcatcccatgctcttgcgatggatccctctcacctgtttactgatttcattcaaattcttcagcgaccacaggaccccgacttgccttctctatcctggttcccatcacgctgctttacaggcctggcctgctcgcggctcctcacaccagcactgtgcgtctccctccacgcctctgccctgtttcctccatcagacaggactagcttcctcctagcacggttcggaattctggcttgcggacacacgtgacaaaaccagcgagtcacattattccagatccggcggcaggtgggcctagacgtatcggaaggcgc

SEQ ID NO: 167340 - DNA, 666 bp, Homo sapiens
cagccccaggacaccccctgattcttcactggcgttggttccctctgaagcccatagcagcttggctttggatttgttcttccaccccacctcctcaggataacacaagaaactaccgggaggtgttatcatgatcttgtcagtccagtagtctattttcagcagaaatgccaagatgatcattgctataaattatgtatttagggatgtgttccccaacatatgccaatttttcatcacggctcagtattatgctttcatccaaaattttcttgtgacctttacaaaggcttcctatctattcctattctggaccatcttaccactcacctgtcatgtgaacttcccaaatagccttctgatcagaaactaaattagctaaatactgctatgcaaatgaaacccaactggtaaaaggtatctacatagtttaacatttttaagagttaaaaaatgtcttacaaagaggacatgtcagtatgaatagaattgcccactttctgaacaaagtgaggaaggagtacaatggtaagttgtttgggggggaaattgagatttttaggtctgagcaggtatgccatcggaaacggaaccagagtcactgtgatccaatgacctaaatggacatataactgcctagagtaaaatcatctaaatgtctaacag

SEQ ID NO: 167341 - DNA, 831 bp, Homo sapiens
caagtaatttatatttctatctgttgtgtatataatcgtctctttagagttccagacagctgctagtgtccaaatatgtttttctaaagaaatattttgtttgtgagtaccaacagtcttagtaactctcttatccctcttatgtgctgagtacagtcggaggaagaggaattggagttggtgagtgtgggtttctgcttgaaggaagttgaaaaagatgtagaaagtactaattctcttacgtgttgttatctaaccaatgttccctttgttacacaaatttttttaaacactattcaaacactttgaataaagcaatctactggtactacagactctagtttttctatttataattgtatgtgttgacccattttatttgttggagggaacattggaatagagccctttaaaaacagtagctgtccatgagcataggatacttgttaatttttttttaaggaaagatacaaaataccttatatagctctccaaattattgaaatatttttagaaaatgacttcaccctcgaagttcctcagattgtaacacacgatgttgtgttgtttctctttcaaaaagattacatcatttttggtgaggtcacctttttcagcgttggaattatttcatcctgcatgatacagcctgaaccacaagggggttccctgtttactaaaaggaatgtctgtaattgaatgtgtatataagtttacttttctatcagaaggcgctcttttcttaaaagcaactattgccctttttccaaaacaaacgttttctgttggcttttcctctagaaaataaacttgactaaaagcaacttgcag

SEQ ID NO: 167342 - DNA, 501 bp, Homo sapiens
gggagggaaggtgggccctgtggagtcactgtgatagcgaggctggcaggccacttaacaaggagctggagtgtgaggccaaagctgcagagagaaagcagcctagaaaacacctctcagggaccagctaacaggatgggatcagatgacacttccagcaaaagaagtgtgggcccaaaaataagaaaaagaaaaagtcctttgaggacatgtactatataagctaatggcttttgaacagctttctcaactctggctgacattttaaatacttgatcaaaagaccccacgccagactccaacactcctgggaatctctccaggcatctctttcagtcttctgataggagtcctcaaactctggtgcccatcaaactgaagatttagcttttctgtgcttccccttcagatattccactctgatggactgtctgctcagcgctccctgtcccctcagagaccaactgggctcatatctccaaagtcaacacatcaatcctc

SEQ ID NO: 167343 - DNA, 451 bp, Homo sapiens
aaatgagggatcattaacccactgaaaccattggtatatacaggaggcattgtggaagtgttaaaagaagaaaagaggaatggacatctgtgcccttgaacttgtattcacataagaaatgagacaaacctacaaacaaaagataaaggaagacatgggaaaaatgtgtaggacaagtataaattaataattaggtacacaaagatcaaaaggaagttgaaataaatggataaagtttttacagacataagatttttttatagtgatgaagctaataggtgttgaaaaaaggcatttaccagtaaagacctataattccagttaaggcttcctgttcctatggccatcccaaagactaattatattcactaaattaagattaagggctaagcaaaaaagaaatttcaaagttccagttgagattctcaaattaagggtccaacacctggga

SEQ ID NO: 167344 - DNA, 427 bp, Homo sapiens
tgattttctatatcagcactatatttttgtatatcatcctatcgataatgttaaaggctttggaatggtttgttaatccaaatttattctctggcaaggtgaattttttggattgttaaagaagtgagatagttgaaggcatagctactagtgtaacgcatatgcccaatgttgggatttagtccttacagggaaggaaatgaaagcaagagaaactgatagtaagcttttttccaatgtgattgcttttgaaggacctcgtagtcttgaagtgccttaaataaactttgctaaaacgtttgaaacaaaacaaagattagaaaggtcagcaacatttgggcagctcagagtttcttgttttattctttaaaaatctgtatttcgttgtttggctaactattcactttattgcttttatatcactaga

SEQ ID NO: 167345 - DNA, 461 bp, Homo sapiens
tctgaggctagttttctttattgagtactttgtttataggataaggaaaggcaacactttaaggatgggagaaaatccagctcaaaggctgcagttcactccttggtttaatttcatctgtgtttatttgtctgcatattgcctttgagaccaatttcctttccactgtaaatttcccttagacctgcactgtccagtaaggtggcctcatgtaactaatttcactaaaatgaagtatgtttaaaaattccattgctatattgcattagccatattttaagtactcagtagtcatgtaggtaatgtatgatacaccatagatactgaacattttcattatcatagaaagttgggctgggcgtggtggttcatgcctataatcccagagctttggcaggctgaggcaggaggatctcttgaagccaggagtttgagactggcctgggcaatatagtgagact

SEQ ID NO: 167346 - DNA, 280 bp, Homo sapiens
tgcaagatgtgctttgttaaacagatgcttgaaggcagcatgctcgttaagagtcatcaccactccctaatctcaagtacccagggacacaaacactgcagagggccgcagggtcctctgcctaggaaaaccagagacctttgttcacttatctgctgaccttcgctgccaccttctcactgtatcctcacatagtcatctctgtgtccaatttccccctcttatgagaacaccagtcatattggatgaggatccactctaaatacctcattttaacttt

SEQ ID NO: 167347 - DNA, 2209 bp, Homo sapiens
acagagctcaggacagggctgaggaaccatgtctccatccccgaccgccctcttctgtcttgggctgtgtctggggcgtgtgccagcgcagagtggaccgctccccaagccctccctccaggctctgcccagctccctggtgcccctggagaagccagtgaccctccggtgccagggacctccgggcgtggacctgtaccgcctggagaagctgagttccagcaggtaccaggatcaggcagtcctcttcatcccggccatgaagagaagtctggctggacgctaccgctgctcctaccagaacggaagcctctggtccctgcccagcgaccagctggagctcgttgccacgggagtttttgccaaaccctcgctctcagcccagcccggcccggcggtgtcgtcaggaggggacgtaaccctacagtgtcagactcggtatggctttgaccaatttgctctgtacaaggaaggggaccctgcgccctacaagaatcccgagagatggtaccgggctagtttccccatcatcacggtgaccgccgcccacagcggaacctaccgatgctacagcttctccagcagggacccatacctgtggtcggcccccagcgaccccctggagcttgtggtcacagaattctcagaagccaccgctgaactgaccgtctcattcacaaacaaagtcttcacaactgagacttctaggagtatcaccaccagtccaaaggagtcagactctccagctggtcctgcccgccagtactacaccaagggcaacctggtccggatatgcctcggggctgtgatcctaataatcctggcggggtttctggcagaggactggcacagccggaggaagcgcctgcggcacaggggcagggctgtgcagaggccgcttccgcccctgccgcccctcccgcagacccggaaatcacacgggggtcaggatggaggccgacaggatgttcacagccgcgggttatgttcatgaccgctgaaccccaggcacggtcgtatccaagggagggatcatggcatgggaggcgactcaaagactggcgtgtgtggagcgtggaagcaggagggcagaggctacagctgtggaaacgaggccatgctgcctcctcctggtgttccatcagggagccgttcggccagtgtctgtctgtctgtctgcctctctgtctgagggcaccctccatttgggatggaaggaatctgtggagaccccatcctcctccctgcacactgtggatgacatggtaccctggctggaccacatactggcctctttcttcaacctctctaatatgggctccagacggatctctaaggttcccagctctcagggttgactctgttccatcctctgtgcaaaatcctcctgtgcttccctttggccctctgtgctcttgtctggttttccccagaaactctcaccctcactccatctcccactgcggtctaacaaatctcctttcgtctctcagaacgggtcttgcaggcagtttgggtatgtcattcattttccttagtgtaaaactagcacgttgcccgcttcccttcacattagaaaacaagatcagcctgtgcaacatggtgaaacctcatctctaccaacaaaacaaaaaaacacaaaaattagccaggtgtggtggtgcatccctatactcccagcaactcggggggctgaggtgggagaatggcttgagcctgggaggcagaggttgcagtgagctgagatcacaccactgcactctagctcgggtgacgaagcctgaccttgtctcaaaaaatacagggatgaatatgtcaattaccctgatttgatcatagcacgttgtatacatgtactgcaatattgctgtccaccccataaatatgtacaattatgtatacatttttaaaatcataaaaataagataatgcaccgtctccacccctctcatatttactttctgaaggaaatgttaggtcttctcaaggtaaagttctatatttattatagcgtttaggcatttcttgaccatctaatgagtgtaaaactgtaccactgggccaagtgcagtggatcatgtctgtaatcctagcactgtgggaggccaaggcaggaggatcgcttgagcccaggagttcaagaccagcctgggcaacatagtgagaccccatctctacttaaaataaagaagtaaaaattgttttaaaa

SEQ ID NO: 167348 - DNA, 476 bp, Homo sapiens
ctcgaggatccactctggcatgcatgtgtcagagaaaggggtttcagggagcctagatatctcaaaaggggaatggagatatctagaggatatagggaaccacggggaagacctaacattgttttgctttcttagaattctcagaagccaccgctgaactgaccgtctcattcacaaacaaagtcttcacaactggtgagtaaccaggcatttcatgctcagcagaaaggagtgtgaggacggagctctctcttccattatctaagcctgtaggcttttaatcacttcaccgaactgtccgtctcttaccaagaaagtccttggtgtgaggctagagcatgggtgcagagtggagctctggggttcagaaggaggagcgttttgggtgatggggccatttcaaagatggcggagccaaggctgtggcgggacgaccgccatccctacgcactgctcccaggatgaagtcctaggct

SEQ ID NO: 167349 - DNA, 2529 bp, Homo sapiens
ccaccgtgtctaacacgaacaagtccacagagagcagtacgccaccatgccttgccctcctctcccaccacccccagccatggatctgctttcttctccatctcctatagatttacctattctggatatttcatgtaaatgacctcataaactatgtggctttttctgaccggtttctctcacttaaattacattcctgtgtgtcttttgaagaaattattaggacagagtaaagcatatgcatgcaaatgtcttatcaccgcgcccagcaggcaggaatgtccataaaagcgagtcctggcatctggtccctttcttctttcctcagggctgtgtctggggcgtgtgccagcgcagagtggaccgctccccaagccctccctccaggctctgcccagctccctggtgcccctggagaagccagtgaccctccggtgccagggacctccgggcgtggacctgtaccgcctggagaagctgagttccagcaggtaccaggatcaggcagtcctcttcatcccggccatgaagagaagtctggctggacgctaccgctgctcctaccagaacggaagcctctggtccctgcccagcgaccagctggagctcgttgccacgggagtttttgccaaaccctcgctctcagcccagcccggcccggcggtgtcgtcaggaggggacgtaaccctacagtgtcagactcggtatggctttgaccaatttgctctgtacaaggaaggggaccctgcgccctacaagaatcccgagagatggtaccgggctagtttccccatcatcacggtgaccgccgcccacagcggaacctaccgatgctacagcttctccagcagggacccatacctgtggtcggcccccagcgaccccctggagcttgtggtcacaggaacctctgtgacccccagccggttaccaacagaaccaccttcctcggtagcagaattctcagaagccaccgctgaactgaccgtctcattcacaaacaaagtcttcacaactgagacttctaggagtatcaccaccagtccaaaggagtcagactctccagctggtcctgcccgccagtactacaccaagggcaacctggtccggatatgcctcggggctgtgatcctaataatcctggcggggtttctggcagaggactggcacagccggaggaagcgcctgcggcacaggggcagggctgtgcagaggccgcttccgcccctgccgcccctcccgcagacccggaaatcacacgggggtcaggatggaggccgacaggatgttcacagccgcgggttatgttcatgaccgctgaaccccaggcacggtcgtatccaagggagggatcatggcatgggaggcgactcaaagactggcgtgtgtggagcgtggaagcaggagggcagaggctacagctgtggaaacgaggccatgctgcctcctcctggtgttccatcagggagccgttcggccagtgtctgtctgtctgtctgcctctctgtctgagggcaccctccatttgggatggaaggaatctgtggagaccccatcctcctccctgcacactgtggatgacatggtaccctggctggaccacatactggcctctttcttcaacctctctaatatgggctccagacggatctctaaggttcccagctctcagggttgactctgttccatcctctgtgcaaaatcctcctgtgcttccctttggccctctgtgctcttgtctggttttccccagaaactctcaccctcactccatctcccactgcggtctaacaaatctcctttcgtctctcagaacgggtcttgcaggcagtttgggtatgtcattcattttccttagtgtaaaactagcacgttgcccgcttcccttcacattagaaaacaagatcagcctgtgcaacatggtgaaacctcatctctaccaacaaaacaaaaaaacacaaaaattagccaggtgtggtggtgcatccctatactcccagcaactcggggggctgaggtgggagaatggcttgagcctgggaggcagaggttgcagtgagctgagatcacaccactgcactctagctcgggtgacgaagcctgaccttgtctcaaaaaatacagggatgaatatgtcaattaccctgatttgatcatagcacgttgtatacatgtactgcaatattgctgtccaccccataaatatgtacaattatgtatacatttttaaaatcataaaaataagataatgcaccgtctccacccctctcatatttactttctgaaggaaatgttaggtcttctcaaggtaaagttctatatttattatagcgtttaggcatttcttgaccatctaatgagtgtaaaactgtaccactgggccaagtgcagtggatcatgtctgtaatcctagcactgtgggaggccaaggcaggaggatcgcttgagcccaggagttcaagaccagcctgggcaacatagtgagaccccatctctacttaaaataaagaagtaaaaattgttttaaaa

SEQ ID NO: 167350 - DNA, 2263 bp, Homo sapiens
acagagctcaggacagggctgaggaaccatgtctccatccccgaccgccctcttctgtcttgggctgtgtctggggcgtgtgccagcgcagagtggaccgctccccaagccctccctccaggctctgcccagctccctggtgcccctggagaagccagtgaccctccggtgccagggacctccgggcgtggacctgtaccgcctggagaagctgagttccagcaggtaccaggatcaggcagtcctcttcatcccggccatgaagagaagtctggctggacgctaccgctgctcctaccagaacggaagcctctggtccctgcccagcgaccagctggagctcgttgccacgggagtttttgccaaaccctcgctctcagcccagcccggcccggcggtgtcgtcaggaggggacgtaaccctacagtgtcagactcggtatggctttgaccaatttgctctgtacaaggaaggggaccctgcgccctacaagaatcccgagagatggtaccgggctagtttccccatcatcacggtgaccgccgcccacagcggaacctaccgatgctacagcttctccagcagggacccatacctgtggtcggcccccagcgaccccctggagcttgtggtcacaggaacctctgtgacccccagccggttaccaacagaaccaccttcctcggtagcagaattctcagaagccaccgctgaactgaccgtctcattcacaaacaaagtcttcacaactgagacttctaggagtatcaccaccagtccaaaggagtcagactctccagctggtcctgcccgccagtactacaccaagggcaacctggtccggatatgcctcggggctgtgatcctaataatcctggcggggtttctggcagaggactggcacagccggaggaagcgcctgcggcacaggggcagggctgtgcagaggccgcttccgcccctgccgcccctcccgcagacccggaaatcacacgggggtcaggatggaggccgacaggatgttcacagccgcgggttatgttcatgaccgctgaaccccaggcacggtcgtatccaagggagggatcatggcatgggaggcgactcaaagactggcgtgtgtggagcgtggaagcaggagggcagaggctacagctgtggaaacgaggccatgctgcctcctcctggtgttccatcagggagccgttcggccagtgtctgtctgtctgtctgcctctctgtctgagggcaccctccatttgggatggaaggaatctgtggagaccccatcctcctccctgcacactgtggatgacatggtaccctggctggaccacatactggcctctttcttcaacctctctaatatgggctccagacggatctctaaggttcccagctctcagggttgactctgttccatcctctgtgcaaaatcctcctgtgcttccctttggccctctgtgctcttgtctggttttccccagaaactctcaccctcactccatctcccactgcggtctaacaaatctcctttcgtctctcagaacgggtcttgcaggcagtttgggtatgtcattcattttccttagtgtaaaactagcacgttgcccgcttcccttcacattagaaaacaagatcagcctgtgcaacatggtgaaacctcatctctaccaacaaaacaaaaaaacacaaaaattagccaggtgtggtggtgcatccctatactcccagcaactcggggggctgaggtgggagaatggcttgagcctgggaggcagaggttgcagtgagctgagatcacaccactgcactctagctcgggtgacgaagcctgaccttgtctcaaaaaatacagggatgaatatgtcaattaccctgatttgatcatagcacgttgtatacatgtactgcaatattgctgtccaccccataaatatgtacaattatgtatacatttttaaaatcataaaaataagataatgcaccgtctccacccctctcatatttactttctgaaggaaatgttaggtcttctcaaggtaaagttctatatttattatagcgtttaggcatttcttgaccatctaatgagtgtaaaactgtaccactgggccaagtgcagtggatcatgtctgtaatcctagcactgtgggaggccaaggcaggaggatcgcttgagcccaggagttcaagaccagcctgggcaacatagtgagaccccatctctacttaaaataaagaagtaaaaattgttttaaaa

SEQ ID NO: 167351 - DNA, 1657 bp, Homo sapiens
agggagaggtgctacttagagaattggggtcatctggccctgacccctactcgggaagggagggaccctccaggaaagtgagcggcatcccctagctagtagagaataataggatctctgagaagcccagatgtggcttggagggggtcctggaggtgggctctttcacctgctcctgcctctcctcattcctccaggtcctgcccgccagtactacaccaagggcaacctggtccggatatgcctcggggctgtgatcctaataatcctggcggggtttctggcagaggactggcacagccggaggaagcgcctgcggcacaggggcagggctgtgcagaggccgcttccgcccctgccgcccctcccgcagacccggaaatcacacgggggtcaggatggaggccgacaggatgttcacagccgcgggttatgttcatgaccgctgaaccccaggcacggtcgtatccaagggagggatcatggcatgggaggcgactcaaagactggcgtgtgtggagcgtggaagcaggagggcagaggctacagctgtggaaacgaggccatgctgcctcctcctggtgttccatcagggagccgttcggccagtgtctgtctgtctgtctgcctctctgtctgagggcaccctccatttgggatggaaggaatctgtggagaccccatcctcctccctgcacactgtggatgacatggtaccctggctggaccacatactggcctctttcttcaacctctctaatatgggctccagacggatctctaaggttcccagctctcagggttgactctgttccatcctctgtgcaaaatcctcctgtgcttccctttggccctctgtgctcttgtctggttttccccagaaactctcaccctcactccatctcccactgcggtctaacaaatctcctttcgtctctcagaacgggtcttgcaggcagtttgggtatgtcattcattttccttagtgtaaaactagcacgttgcccgcttcccttcacattagaaaacaagatcagcctgtgcaacatggtgaaacctcatctctaccaacaaaacaaaaaaacacaaaaattagccaggtgtggtggtgcatccctatactcccagcaactcggggggctgaggtgggagaatggcttgagcctgggaggcagaggttgcagtgagctgagatcacaccactgcactctagctcgggtgacgaagcctgaccttgtctcaaaaaatacagggatgaatatgtcaattaccctgatttgatcatagcacgttgtatacatgtactgcaatattgctgtccaccccataaatatgtacaattatgtatacatttttaaaatcataaaaataagataatgcaccgtctccacccctctcatatttactttctgaaggaaatgttaggtcttctcaaggtaaagttctatatttattatagcgtttaggcatttcttgaccatctaatgagtgtaaaactgtaccactgggccaagtgcagtggatcatgtctgtaatcctagcactgtgggaggccaaggcaggaggatcgcttgagcccaggagttcaagaccagcctgggcaacatagtgagaccccatctctacttaaaataaagaagtaaaaattgttttaaaa

SEQ ID NO: 167352 - DNA, 292 bp, Homo sapiens
tctcagctgagatgctggctcctgccttcaacatcagactttctttttctcccaggagtttttgccaaaccctcgctctcagcccagcccggcccggcggtgtcgtcaggaggggacgtaaccctacagtgtcagactcggtatggctttgaccaatttgctctgtacaaggaaggggaccctgcgccctacaagaatcccgagagatggtaccgggctagtttccccatcatcacggtgaccgccgcccacagcggaacctaccgatgctacagcttctccagcagggacc

SEQ ID NO: 167353 - DNA, 396 bp, Homo sapiens
cgatggctgtgaggagctagagtttccacttcctaatggattcaaggaggagtcttatatggagtgcagtgatttcctggggtaccctttgtggcctccatatccagtgaggatggtgaacaggcaactgcagcccctgccccctgacaagggcaagacaaccaaggccttagatattctgggtaagaaggttgaaggtcaaagttcccaaatccagaagctacccagatcagcccaagcactggctagtgtgggggactttcagacccagaggtggaggagaagtctgcaaacactggttattgccacacagtcagctgcactagtggagacgggagcttgtttcaccgatacttttaagttaaatgtttgcagaggttatagccagccactgcc

SEQ ID NO: 167354 - DNA, 590 bp, Homo sapiens
atgataggagagaggtaagctaaagaaataattgttaaatataaaggagccagaacttcttggacttgaaaataaagctttctcttttccagtttttcctgacggcagagaattctaaaattaagaagattctttatggaaggagagcaaatctagggtactgtcattaaaacatggtttatcatgaagccaagggagtgattgtaaaatcttagttctaatacctcaggaaatttaatgtcatgcctcacacagacagtagtctctctaattatcttaaggacatgacataccttacagatcctctttattaaagaaaaagtcctttgagaattttaagagcattgtccctcggcacccttataggaagctctaggacttatcttgaagagatttgtgggtacaggttttgtctaatggagtggattataaacaagaaatccacacagttttttgttgcaaattttttttagagcagttttagtttacacaaaattaagctgaaagtagaaagttcctatattctccccattcccctctctccctaaaatttcccacactatcaatatccctgaccagagtggtacttt

SEQ ID NO: 167355 - DNA, 303 bp, Homo sapiens
atactcaaatagcaacatttcccaaaatatgatctgtgggccactggggccactaggtgattctcaaacaaggcttctgtggtccagtgacctggaaaacactgcattccatatttccacttagagattcacaatgcacatcgccttatgaaggcagctgagaatgcctgtagcaagggaacctgtggagctctgtttaatcctgagtttccaaaacctcctgggtcacagaacccctttgatgtagacagcgttttactgagagtgtgggaaatgctgctctgtgatgatacagtgactttg

SEQ ID NO: 167356 - DNA, 397 bp, Homo sapiens
agaggagatatcaggtaacaggtgacttggcagcgtggcagaacctgctcttccagtttgtcatgtatgtactgctatctgtatttaaatagccatttagaaaccaaaaaaaaagctgataaaatagaccatatttcctcatattttgtctaacaaatggactcttaaaaagtacagtggatggcccagaattttttttcatcagctcaaatataaagttaccacagttcgggataagaaaaaacaaaaaatcacttccccccaacctcttaacctgtcccccaaaacaatcagcttgtcatgtcttttcctctctccttaatgagtattcttataatgctttaataacaaataaccaaaaagttttcaatatataggtttttttctgtatgtctta

SEQ ID NO: 167357 - DNA, 466 bp, Homo sapiens
gctggaaatcaggaatccccttcctcccaaaaagctagtcattaaaacatttaccatcactgcatcactgcatagagctctcagccttttaagagaataacaattcattgcattgatatgccataatttattgaaacattccacaggttatttcttaaattcatgctctgctcaccttgggaaaatacagataacaatttgattcgctatgaagtagagcagataagcagcagaggaagaagtttaaatccatagtcaattatgcattaatgacagcaggagttcaattataacaccagtgagtggagatctagagaaatgaacatacattggcatatttaaatgtgctgcaacgaggaaaaaatgttttctctaaaaagaattcatcctatacagatagccaccacagaatatggaactgtgaaattatagtcctatattttcaattcacttgccaattttagct

SEQ ID NO: 167358 - DNA, 277 bp, Homo sapiens
cccattctccaaattcctgaggtctttgtaatcctgacacccttttggtgtcatgtcctccagccctgagttatctgtcttaggactgtcacttctgggagagccccctcatcctccaagctagtccctttgtgcgattattgcttctttttcttcccaaatagcatcaccatctcaaatcccgatctgtttgtttacgcgattatcctctgtctcttcctcaccagaaatgtatgctctgtgatggcaaactcttccaacttcttgttccccatga

SEQ ID NO: 167359 - DNA, 308 bp, Homo sapiens
caaatcaaaactcctaatgccttcaaagtttttaacagtctggtcccaattacacagcttccagaggccctacctcagctatctgctcaaacatgccccagaagaccatgaattatcagccttcttaaatttgcatataatgttcccactgtgtgacccattcttctaccctgttctctgtcctccaacttttttcatcatcaaggcttagctcaaattctttctgctctgaatcttttcccaacccctctccaagcagaattcattgctgccttttttatgcttccattacactatcagaggtgagt

SEQ ID NO: 167360 - DNA, 593 bp, Homo sapiens
cacgctcaaagacgagagatagagaacgagcaacaacgcatatacgtgaacggtgactggacgcagcgtgggtgagtagtgtcaagggtgaaggtacgctcgagcgtggtcattgaggacaagtcgacgagagatcccgaggacgtctacagtcagccttacggagaaaatcagcttcctgtttggatacccactagacatttgaagttctacaatgcacccatcggagatgcaaagaaaagcacctccgcggagacggagacaccgcaatcgagcaccgttgactcacaagatgaacaaaatggtgacatcagaacagatgaagttgccatccaccaagaagtctgcaggtgtacccaacagctccgaagagacagcgaccatcgagaacgggccatgatgacgatggtggttttgtcgaaaagaaaagggggaaatgtggggaaaagcaagagagatcagattgttactgtgtctgtgtagaaagaagtagacataggagactccattttgttatgtactaagaaaaattcttctgccttgagattctgttaatctataaccttacccccaaccccgtgctctctgaaaca

SEQ ID NO: 167361 - DNA, 706 bp, Homo sapiens
gcccattctaaatgctgcaaaggcttcgatgctgcagaagtgttcgtcattattatgacagtaggagcagcatggaattattattatctttatccttattactgatataattattcccaataacctggggttatgatttgcatcctgtgcactgcgggaagaaagaggatttgtgtttaatgaaatgatatgcttgtaggccgagtgcagtggctcacaccttaatcccagcactttgggaagccaaggtgggaggatcacttgagcccaggagcttgagaccagcctcaccaacatgacgagatcctgtctctacaaaaaaaaaaaaaaaaaagtgtttagtatttttaaaatactgaaaaatcaaatataattctctcaattcttacgttaaggttttttaagtcctgtctgtttagaatgaggtgcactcgtgtgtagtacgtatgtgctctgtaagcaaaatcattcattcctccttttgccctttttgggaattctggtcaatttttcacctccctctcgttgagatgctaaaaccttcttgaattggagatcatttactcttgggattaagcagaatggaactgccctattgcttgtgtcatgggccaggctcacagccacacagctggggtctctgcccgtcgtcctgggcactggggctgggggcagcgggaagtgatggggagcttgatacttggta

SEQ ID NO: 167362 - DNA, 251 bp, Homo sapiens
tgtgtgtggtatttcctactttgatagagcagtgttgctaactagagcatacattgtgtagaaaaccctcctgactaccttttatggagctgaataaatatgtatacttgagtgctctcatgttagtcataacctttagtttagcactgttatatagaagtgacagtcacgtagcccactacacattatactagtttgaatttaaacaaagcaaaacaactttataattttaaggggaagaggaatggttc

SEQ ID NO: 167363 - DNA, 555 bp, Homo sapiens
tcaagtgacattaggtttatgagattgattctcctggctgtgtttttccatttttgctgtggaatgatagcattcttcagtcaccacaggtctgcagtcaggcacagaggaatctttgatctagtctcggctgactggtttactttttactcctcaaattttctgtggatcttcccgtgagatttgacatccagaaagctcttcctccttctttcctgctcgctgtgcagagcccagctcatcagcagcaggagtgcagggttcctcccgcagcaccctaaatgcaggctgttcaaaggcacatccgggctgtcagcaaaacggctgagtgatgcgactgtgggtgtctctgtcagctgcagagcaggatgacaggatggcccagaaggctgcctggcgtgtggcccttcctctggcacaggcaggtgaacctgctgacaccgtcacgctgacagctccgtggcacagattccacccgaataccggattcagtgagcaccggctcctgccaagtctctcacatgacccagaggccacgagggcctgggcggccgc

SEQ ID NO: 167364 - DNA, 115 bp, Homo sapiens
cataaagggagcttaaaagtaataagcttaaggaaagccagatactgaagagcacatactctatgactccatctgtgaaaagctgaaaacaagcaaaagtcatctacaggaacag

SEQ ID NO: 167365 - DNA, 514 bp, Homo sapiens
gacagaagataccatgaagagtctgataacaaatgacaaactgggagaaaatacttgcatcattcaaaagataaaaagtactacccctaccatacaagagttctcagattgataagaaaggtgaatagtagcacaaaaacaggtgaagaataaacatagacaaatcttagggaaaaatagaaaatatattccacttaactaattagtagataggaaggagcaaaataataaccaaataccccttttcaaccattggactggcaaaaattaaaatggtttataacatctagtgttcacagggtatataaggaaccaaacattcataacattgcagttggggatataaattataataaataatcttatgatttctcaatatcaaggtcttgccatttgaatccattatttcttctttggagaatttattgtacagaaataaatgtatcagttacataaatatatatctattaatgatgtttattgaagcattgttcagtgtcaaaaatcaggaaat

SEQ ID NO: 167366 - DNA, 187 bp, Homo sapiens
tggcctatgagcctggagaagctgctggagagatgtaagtagaggagtgacaggatcagactgtggtttgaaaggtccccttgctgctatgtggtgaggaccgtacggtggaaaaagtggagataggcttacaaggcccagtgccagagtgcctcgctctgcctctctggccttatctcctaccact

SEQ ID NO: 167367 - DNA, 247 bp, Homo sapiens
ctggaccacttcagagtacttccagagtaggagtagggaagaaagaaagcaggggatcatgataggattacagaaaggaatgggtccacatgtccaagccacaacttaactataagaactggcatttggccatcaccaaggcagtcagtgtattcctgaagcacgaccgtaggctagatgccaggatgtgttggtactgcctctgctatttgagaggttttgagtaacattttggaaaatgctgtca

SEQ ID NO: 167368 - DNA, 454 bp, Homo sapiens
  misc_feature (340)..(340): n is a, c, g, or t
acataattaggctatttacataaaaggcaaagtttgaatacaaaaaaaatggcatagctggaagaatgtaagtttagattatctcacttttacagttacacatttttaagttatttgacctcggtattaaaaatcctcgtgttccattttatgtgtagtccagaaatactttttaaataactggtacagtgatgtccttatatagagagtgttgaaagcaaaaggctctgaaatctatcattacttgtagtccagtttgccctcctttttcagcatgtctactctccatgttcaaaattttccatggctaattttttgtccttaaattcattttcccctngccaccctgtcaaccagccaatcagtcaacaaataacttgggtgggtactatacatagggtcaccaattcattcctgaactgtcccggttttaaagctgaacattgacaacctg

SEQ ID NO: 167369 - DNA, 1436 bp, Homo sapiens
  misc_feature (1352)..(1352): n is a, c, g, or t
gacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaactacaagagattagaaatataaaccttgcctggctcttgccaggagataacaaaatgggttgctgatgaactgcacccttttacatgtgggtagaatataagctcacatggcagtgagatgttgaaaagtcaaaagagacctgtctctctcctttcttttctatctttaaaccagaaaacctcatactcagtcctcagtgaaagaaagtaaagtattaaggactttagacagaagagcattgtgtaacttggactgaagatcatccattaatagttattaggcatttaggtaaaattttctaatacctaaaaaattgtcaaaaacagtcaatagggctactgctggcccaaagaccatttaggtccacctcctcttttttgctctttttttttttctgtgacagtttcactgtgtcgcccaggctggcgttcagtggtgcaatctcagctcactgcaaactctgtctcctgggctcaagtgattctcgtgcctcagcctcccgaatagctggaattacgggcatgcaccaccacacctggctaattttggtatttttaatagagatggggtttcaccatattggccaggctgatctctaactcctggcctcaagtgatctatctgcctccctcagcctcccaaagtctgggattgcagacaagtcatcgtacccggccttcttttttgcccttaaaagtaagggatgtgggtttgtacaaaaaaaaaaaaaaaaaaaaccagcatacatatgcaaaactatatatatatgtatatgtagagaaaaatacttcccattgatcatttttaaaaggcttctgattggatattgtgttttaaccaaattttaaanattaatggaatcatgaaagggaaaaaaattgatacaactatgcagattttataaatgtgcaataaaagtatttgttttaccttt

SEQ ID NO: 167370 - DNA, 995 bp, Homo sapiens
gacctatgtagccgatttgcagctgtcatggagtcaattcagggagtttcaactgtgacagtgaaataagctcccacatgttcaaggcccattctggttcctggctgcctgcctcttgcacagaagttcgttgtcatagtgctcaccttgggaaaaggattaggtgggcacataagattccgatcagaccccaaccatgctgcatgtgtaaagaaggattgaaaataaaattgcactttttaggtacaaaatcataaaagctgtttcactagaaaaggcagaaagcagtgtattaaggtgttgaattacgccagaagacctgaaatgccttgtacctacaacaatgcttaggcttttctaagcctcttgccacttttaaaattatccttcaggcataaatatttttgacagcagaatagaagaatgattcatgagaacctgaaccagatgaacagctactagttattttatcaaatacagatgacatttaaaaattcttaactacaagagattagaaatataaaccttgcctggctcttgccaggagataacaaaatgggttgctgatgaactgcacccttttacatgtgggtagaatataagctcacatggcagtgagatgttgaaaagtcaaaagagacctgtctctctcctttcttttctatctttaaaccagaaaacctcatactcagtcctcagtgaaagaaagtaaagtattaaggactttagacagaagagcattgtgtaacttggactgaagatcatccattaatagttattaggcatttaggtaaaattttctaatacctaaaaaattgtcaaaaacagtcaatagggctactgctggcccaaagaccatttaggtccacctcctcttttttgctctttttttttttctgtgacagtttcactgtgtcgcccaggctggcgttcagtgagccgagatcacgccactgcactcaagcctgggcgacagagcgagactccgtctcaaa

SEQ ID NO: 167371 - DNA, 579 bp, Homo sapiens
gaggcattgtcgaaggtttaaaagcctccagagcacccagcaggggaaagcccctcagtgagtcactgcagcatcagatccttggggcttccggctttcctgcttacttattttcctgttggggtgcaggagtgttaggcatgcagcctccttgggatgttttgaattaggtaagagtagagagcagtagtgggagtaataacaatttttgtttaaagactttgcctctcctgtccccaggctattgtcaaagaacacattgctcttaagggagaatcttgttagagcaaaacagacaatgccggcagagagagggaattttacaatctgcctctttcacatatttaaacataggcaatcgcctggcaaggtggctacaactccacctgccagccgccatgctttccatgaactccaccgtgttacttggtccagattaaggaataagcttttgtggagaggagaatattcacaaggcctgagccaataagggaagaggggccaggctcccaggctcctgtgggccaaggcctggggattcactggtcagacagcccatgtctaccttccaggggagga

SEQ ID NO: 167372 - DNA, 246 bp, Homo sapiens
attgttgcagtcaggatatgtcaaagtaaagctaagaaaacttgctaatgaattaacagtggggtatgatgacaagatcagaataaaggaaaactgttactttgtatgccttgagccactggataatgaatgtgccccttactgagataagtaagacacagaagaggaagtttggtggaaaagagaaggaaaggataaaggactcaatgtgggataagcaatcggcatgtacatttggaaaaagct

SEQ ID NO: 167373 - DNA, 302 bp, Homo sapiens
catttgtaaaccactgttctaatagatagtagatgttatcaccataagcaatttggattcccttctgaaaatccaccagtttttttttttaaaccaaaattaaacataaaagaatgaagtgtttttaaagaatttttttttcctttaaaagcatacaagagaaatgttaacatgtagatactcttaataacagtacatttactgaacacattttcaaaaaaatgagattaggatcagaaatataaaatatgctccacttaattttaaacaattggttatttgtcactcatagcttctaattt

SEQ ID NO: 167374 - DNA, 458 bp, Homo sapiens
tgtatgcagtgtccgaaggtcctacttaaagaccctgaaagcaaatttaaatacaactcttcaaaattattaatctatagggaaacaaaatttatgcttaatcaggcagaatccaccaattaacctctgattacataactagaaaatttctacctaagtcaggccaggaaagctggcttatacctgtaatcccaccacttcaggaggccaaggtgggcggaccacttgaggacaggagttggagaccagcctggctaacgtggtaaaaccccgtgtttactaaaaatacaaaaattagccatgtgcggtggcacatgcatgtaatcccagctacttgggaggctgaagcaggagaattacttgaacccaggaggcaaaggctgcagtgaactgagatgatgtcactgcactccaacctgggccacagagttgtctcaaaacaaacaaacaaacaaaaa

SEQ ID NO: 167375 - DNA, 325 bp, Homo sapiens
aggcggggtgcagctgggcagccatgccagtggggagcgcctgcggcactggcttgagtgcctgggccacagtgaccaccgcctgaagctgtggcacccgctggacagcaagcctgtccagctcagcgactagcccatgggccctgcctgccgcccctccactacagctgcctgaaacgtccccacaaaaatgatggcggctggggctgccttaccctcatgcccagccccaagtcagagaggtgtttcctctctccccgctttcacattcaccccaccccaaatcatggagccgaaataaacatctccttcaagccagatgaga

SEQ ID NO: 167376 - DNA, 580 bp, Homo sapiens
taactgaattcccagagaagaaataaaaacaatgagaaatatactttaagaactaatgatcaagttttccaactttaataaaaactataagccaaagatgaagaaccacaataatctctgaagatagcacttctaaataaaaccatgcaaagcacatcataatcaaactgctaaaaaacagtaataaaggataagtcttagtcttggtgcggtggctcacacctgtaatcccagcactttggagacaagagcaaaatttgtataataataaagatatccattctcaggaagatatagttatatgcatatgtgtacataacaagacagcttcaaaacacatgaagaaaaatctggcaaaactgaagggagacaaacagaaatgaacatgaagatgaacaaaatatgaccccccacaaaacaaaagagaggctcactacctgtgggacaattatcaagtggtctaatatatgtgtaactgaattcccagaagaagaaataaaaacaatgagaaatatactttaagaactaatgatcaagttttccaactttaataaaaactataagccaaagatgaagaacc

SEQ ID NO: 167377 - DNA, 524 bp, Homo sapiens
tcaggaggctgaggcaggagaattgctcgaacccaggaggtggaggttgtggtgagccgagatcccaccactgtactccagcctgggcaacagaagcgaaaactctatctcaaaaaaaaaaaaacaagcaggagtggctattctaatatcagataaaatagacccttacacaaaaataatcattagagacaagagcaaaatttgtataataataaagatatccattctcaggaagatatagttatatgcatatgtgtacataacaagacagcttcaaaacacatgaagaaaaatctggcaaaactgaagggagacaaacagaaatgaacatgaagatgaacaaaatatgaccccccacaaaacaaaagagaggctcactacctgtgggacaattatcaagtggtctaatatatgtgtaactgaattcccagaagaagaaataaaaacaatgagaaatatactttaagaactaatgatcaagttttccaactttaataaaaactataagccaaagatgaagaacc

SEQ ID NO: 167378 - DNA, 375 bp, Homo sapiens
gccctttctccaagcagggccgccattgcaaggcctcacgtgcaacacaaatgcccagttcctgagacttcttcagaatctccaggaaaagggtgaaaaggcatttaaacctctatgaagtagggccaggcacagtagctcacgcctataatcccagcactttgggagccgaggcaagcggatcacctgaggtcaggagttcgagaccagcctggccaacatggtgaaaccccatctctactaaaaatacaaacattagccgctgtggtgttgggcgtctataatcccagctactcgggaggctgaggcaggagaatctcttgaacccgggaggcagaggctgcactgagctgagaccacgccactgcactgcag

SEQ ID NO: 167379 - DNA, 422 bp, Homo sapiens
aggattcttgaggggacagtctaggcagccattccaggttctggggctctgtcgggggacacctgcttgagagggggcacaacccttcaacacactcaaatacattcatacatattcacactattaccttttccattaccacccctgaccctccctcctgcaccatccttgccaatgtggagcactcctctgctatttcagaaataccaccacaggtgtcctaaactggatccctaggagccaggagttcaggaagcatgtctgctggagtgtgcatgcacacacggtatgcacatcacataggagcacgtgcatgtgctcttgccactgggaggaccacatacccaagcgtacaccgtgcactctcctgggaaacagcacacagccacatgcctgatcatctgcacattctcccacacgca

SEQ ID NO: 167380 - DNA, 431 bp, Homo sapiens
ctggtttcaagtgagtcatgtagccctcactcagccagggcccttgaggcacgatccttaggctctcaccctggaagcagggtcaacagaggtagagtggcagagggattacacatgtgggctttgaaactatcagacctcctttccccctttttcctttttttttaattgtgtcaaaatacatgtaacatcaaacaccattttaaccattttcgtatgtgcaattcagtggcatcaaatgcatacacaatgtcatgtaacaatcactaatatttccaacactttttcatcatccagtacagaaatgctgtaaccattaagcaataaccccccatctgccaccacctcagcccgtgacaacctctattctgttgtctctatgaatttgcctgtttaattacctcatctaagtgcaatcatacaatatttgt

SEQ ID NO: 167381 - DNA, 217 bp, Homo sapiens
cccatcccccatcttagaatggagccccctgggaccacgcgggagcaccctggtcttgagacgctctccccgctcatggagggcaggcaagggatgttgtcaaagttttgcttaaaaataattcccggatacatcgcgacagtaaagcaatctagggctgttttttttttctttcctgaatactgttggggttttcttggggggagggagattgagg

SEQ ID NO: 167382 - DNA, 332 bp, Homo sapiens
gtccccttagtggagtcacagcctcagcggtatgttgaatcttggtctgagagtcatcaacccacatatagcccaaatccatgtatgagagtcaattttccagcttttggctacctccaaatatgagaatcagaacttcaacagtgagctgtattcatgtggaaagatgacaatctttactgtcggctgggtgtgcatgtgtcacaatgtcacctgtgttctgggcctcattataaaactctctgtaccatctgaggtctttatacagtattcatgaaagtcacaattttctctgaaactttcttcctggtatggattcataatcatacctg

SEQ ID NO: 167383 - DNA, 531 bp, Homo sapiens
gcgattttgcattcttttaacccatttttcattccattctttctcatttaatgtcttgttacataaattttaaacataattaaatgcgtgagtcaaaatgtttaagagtattctctggtatctgaactactttgcaggatcagatataatactgtggagagtaatatcagcacttttataattatgaaaatgcttttatgtcagaagatacttaagctgaagattcatgggttacaaaaaataaacatttcaaactttaaacttattttctggaatgatacttgctctgaaataatattcaaaacacttttccgaaatgcatctagccacacaggagaatgagcatgcaaggaggtagagggtcggtggtgaaaaaattatagatttcaaagttattgtttgaaataacccaaacaagcaaaacattagtatttttatcttgaaattcttggtgaattttatgttctagcccataatatattagtttattttaacacaaaagtttcttccaaaatggacatgtccaaaaga

SEQ ID NO: 167384 - DNA, 229 bp, Homo sapiens
tgagaccagatggaaaaccactactgggtcagagagtgaaaataaatcctagagaagatgccagaaagatttggctaagcactacttaatggaataaaattcgtgaccggggtactgactgtgttcctaatgttggattattttagccttgctctattagtagtcctcagctttgaacccagcctctctcccttcctgtctcttcccacatcccattgagtcccccctt

SEQ ID NO: 167385 - DNA, 513 bp, Homo sapiens
acaaagaacagaagagaatttggagagacaaaaatagttaagacagatttgatgagtaggtaaactgtaaaagaaaatagaattttagaccaatcataagagtttgctactaaatgaaagtcctgtgtgtttaaacctttctgcttatctgatcttctgacttatccttcttatctgcagatcatatctgggtgtccatcagcatgttacttcacatctctgtacctcagtttattcatctttcaaatggaagcaacatatagagctgccttatagagttgctctgggtattagatgtataatatatgtgaactgcttggtactgggcctggtatatggtatgtgctcaataaatgatagttgtttattattgtcatttatcatcatcatcatcatcatcataattaaatattattccaagcaacaatgtgttcctcatagtccaacaataatttaataaatgtaacctttccaaaactccgatctgcaaattttaaataaatattttcaatt

SEQ ID NO: 167386 - DNA, 468 bp, Homo sapiens
tgggggtgatttgttacacaacaataaacaactaagacaccagcccaatcccagttccccacgagcagcccttctcctactgctgaataggcagagctgctgccaaaggcccactgtgctgggcaaagaaccacattctcatcctccccttttccagctctccctgttcccttcgtgggcctggggcagactgggaggcctcttcatgggcctctgcacatgcatcagcctgcactccactgtcccatcatcttccctgagagcttgcaagccacgagtggtttcctgtgtcagctccaatttttgaaataccatccatgaattcacaacacagtaattaatcactctgtgaacttagctgatggattagctgagacaatcaatttttaaatgttctgtttcatctgaaacaggtttagtcaagaggcacaaatgcagtgaattctaaagattcttagcaggttatca

SEQ ID NO: 167387 - DNA, 127 bp, Homo sapiens
cttgatgccatcctatgaatccaccaaccatcatcttctctgaccctttaaaatgacttccctcacaccccctgccatgagatgatatgaagaactaacaacagataatttctatatcaccacattt

SEQ ID NO: 167388 - DNA, 356 bp, Homo sapiens
caggacacttgccactcaccctctggttctggcctaggaaattcttcctcattcgaggttatcatgaaattcagttgggaggttctttcaacctgtgactgcttcctgagttagctggcggacttccatgagatacactgtgaggcagaataatgaatggctccccttggtctactctgcagactgggaaagcacgcaaggctgctcccactgccgttcctacttttatatatgtcaccacttcctaaatcagttccagtgttgagtaggataaaggtcttcccctgtgggttggattgtcaggttcccctgtaggggtgtgtatcctggaggcagtctcttccactctcaccctc

SEQ ID NO: 167389 - DNA, 507 bp, Homo sapiens
aaaattgaacccttttaaacaacgcattagcgttatctttgccctaggagctccaactccaaagaactgccccagagttctgaattctgttacaggttcgagcagagggaaggtgcggggcggcgggtgttggcggggggagctcccaaagcgctgtttaagaaagtttttttcctgctctttctaggagctcccgttttaggagacggttttggaaaagtaccctggcatacactcttttttaaacgtctgatctctaatgctctgtaactagccaccacccattcaagagatttcatctcctaaactgccaacgtggtcgagtaaaagctgtctctcctgagggtctcaaatctttccatagcggttgctaacacaaagtaacaatttactgttgatttttaaagcataatattaatactcttgaattttatacctttttgtttaatggggaaaattctaggaaggaaccacgtggaagtcaagtaaccacgatgttttaacaaa

SEQ ID NO: 167390 - DNA, 179 bp, Homo sapiens
aatagcactaaaaacaaaagtagctgacaaaatctgtgcaggtttaaaaatgcatatagaaaaagcaaatctgttaccctagactttctaagtcacatctggactgtattataacaattttcagaagtgaccaactatcgttgcttcttgtggttacagaggggacccataattaagag

SEQ ID NO: 167391 - DNA, 515 bp, Homo sapiens
acgacagagcaagacacagtctccaaaaaaataaaaaataaaaaatcttttccattaccaaagaatacagtcttaactttataaactgaggtctgcagagaacatatttgattcaaatccaaactatcttcttcacttttcactgtatttccaacaaatccactatttttactttgatcaactttcatgtaaaatctagtccaaagctaatcttgctgaggttggaaaagctgatgagctcactgtcccaggtagttggaggagtttaattagattagctccactgttcctactctaaaaataaccataactcctgccaaactgaaggttaaagagtaacccactggagggtgaggaaaaaagacccaggtgccattttaatttcactaagaaattccagtgacctagatttttcttgtcttaataagaataaagccttaaatttttaaccaattacatgacaaaatattaactaaaaaccaggcagaaagactttactacgctggataagagta

SEQ ID NO: 167392 - DNA, 488 bp, Homo sapiens
ttcctgtatgaaattattttggaactttcccaagtctaattgcagtacaaacaagtatgtgaggctctactgtactatttcatcaaattgttatgagtactttgtgtgttttcaagttcatctctttagtgtccttgacctttataaatatggcatattgtgatactttaagctagaagaaaaatatgacagtagtaaattaacagctttctacccacttattgagtcacttatcacaggccaaacactgccttcagtgctttacatatgttaacctaagtaactgtcaccacgacaacttggtaagatgaatactattattctcgttttatggattttttttttttaagctgggcttaaggttgctgaacatctcacattggggtaagtgacagagttgagattcaagccgggctgggaaagcctagcagggcatggcggctcatacctgtaatcccagcactttggaagccaaggcaggaggatca

SEQ ID NO: 167393 - DNA, 454 bp, Homo sapiens
gacagcactgagatcaccagtgagcagttttagcggcataagcaggggacagagcccaggctaaagtgtctggggcgtgtgcatgcagtcaaaatgctaacaataaatggggacacgctttcaagaagctttaaagtatgtaatatgtaccacataagtattacatatatttatatggataacatgtaatacagaaatatcaaagtatacctgtataacacataacatataatgtgtaatacataaacattatacataaatattaacgcatatatagtaaaaggctgaaatacaggagaaataaagatttaagggttggaagaaatgagatccaaagcacagatggacaaaattagccacggacaggaatttgcacttttaccactgggacaaaaaggaggaatggctacaaatagaggtaataataggagagtaataacaaaagatgagaaaa

SEQ ID NO: 167394 - DNA, 343 bp, Homo sapiens
gattttcttcgttcgataaataaaacatattcattgcacaaaatttagaaatacagataactcccattccgccccccaaaagaaagaaaatagaaattgcctcagtcttattatccagagataccattgttaaaccctctgttcactatgttgcttcaaggactagaaaattataagaaaatactgtaagttgcaaagctctatataaataagcggtatttttattgagtcaacagaattcaaatttgaacctcttcacagccaagaagccctatattatttaacctcattttaaatttcattttgtttacattttttctgaatattaaaataacaatgctga

SEQ ID NO: 167395 - DNA, 337 bp, Homo sapiens
cgatgggaaaaagctgtgcccgccgggaaaagcaagtagctctgagaagattcacgagagatctggacccaaaagggggaaacatgcctggacccacagactgcgtgagagaaagcagctggtgatttatgaagagatcagcgaccctgaggaagatgacaagtaactccataagtgaaccttcggctcaccctccacatccctgcagatgtgctattctgttatgcctcagggatacgacacatgcccatgatgagaagcagaacgtggtgacctttcacgaacgtgggcatggctgcggacccctcgtcatcaggtgtatagcaagtgaaagcaa

SEQ ID NO: 167396 - DNA, 100 bp, Homo sapiens
actaagtcttcgccacttgggcatatgtcacaggtagggtacgtctcagttcagactctggcccctggcaaccacgctggacagcacaggtcaccggtag

SEQ ID NO: 167397 - DNA, 629 bp, Homo sapiens
gtaccctttctcgcccccgactcgtgttgaaatgcgaactgactatgtatttcgagagggagtcttgctctgttgcccagtctgaagttcttttttcattaacctatcatcaacccgtgaaaggttatcatcacctctgtgatcttatttacactgcgacttgatggcagtgaattctctgcctcacctgcattccaagttatctgtctattgcagcgtgactttcaaaggcaactgatgatttaaatcccaaacatattcacttccgtggccagacacttgggggttggcctggaatgcccggatggggcacaggagctaggcagatgggaaagaaactgaggaaggaattcagaaagatgaatctgattttaaaagcccagaccaaccaattcctgtgccaacaagagggtagtgtggcagccctctgaggggtgacaattggttggggacagtacaggaagtcatcagctcaaagttatgcctaaatgcagtgtgtggtttagtccatcacattgaaataaaatagttagctaataacttttcatatgttatgtcttctgtaacattttattcattacaactatgttggcatatcaccagagaaaagatcatatttgctaacttat

SEQ ID NO: 167398 - DNA, 457 bp, Homo sapiens
agtgtgtacatgaggcgccttcactgtccctgcatcaggaatctagctgttggcaccttataatgagaaaacagtctcaaccatgaagttaactctgctggaagatttccaaagggaaagtccctcccgttactcagaggggaaaaaaaaattacctacttggtctggaatccggggatattttatgcagatgtctctaacagaagttaataaagggaagtcagcttgcctctgattattcaaacaggctactgctattaaggattgcacaacttctgggcaaggcagaggtgggtttggctttttaaaaattttttcagcctgtcctcatggaactacatattcttttctaagaacttttcatcctaacctccctactcacatcttctaagtgtctctgctctggtgggaatgtgatggacaacacagagccatctcagaagcctctgtggccacc

SEQ ID NO: 167399 - DNA, 670 bp, Homo sapiens
  misc_feature (592)..(592): n is a, c, g, or t
aaagtatttcgtctctgagccaatggttctcaaatactagtgtgcattagaatcacctggaggccttgttaaacagactgctggatcccactccaggaactgctgattcagtgggctcgggacagggccaagaacttgcatttctgacaagttcctggtgatgctgctgctgcttgtctgggaaccacactttaagaaccactgttcagtcaatgaaactctggaaaaatttatgccattctctttgttttgagtttctctcatcaagctgtattcttatgactggtgcttttttttttttgagacatagtctcgctctgtcgccccgggaggccgaggttgcagtgatctgagatcgtgcactccagcctgggggacagagtgacactccgtctcaaaaaaaaaaaaaaaaaaaaaagaaatgcctgttttgggttcttcatttttttcctataactggaactatattgagcattctatatttatcatcagttctttgttatattagctccagaataacttacgaccatttagagtcctgaacaaactcagtggtttattgtacatactcatttattaagggggaatttgngttcctcttggcttgtggcttggggcaagcgccctgggccagaaacttttcttcggaattcgtttgggggaagggtta

SEQ ID NO: 167400 - DNA, 1387 bp, Homo sapiens
ccatttcacctgcatagatagatgatggagagatatatagatgataataggcagatagacgatagatcgatagatacatagatgatgcatagagagatcatggatagatagctatgtagatagatgatagagagttagttggatgggaggcaggtggggcagcctgtccagaggcgcagacctgtgtgtgtggggaaggggtgatgggagatgcagactcggcagtgcttgttaacagaggtgtgaatgccgcgccttgcttgcctgaagatttccacccaggatcctgacaaaagtcagatgtgcacttcagaaaggccaggcgggctgcagtgaagagaatgactcgagggggtgcgggtgtgggacaggccatcgaggcaaggaggccaaatggaaagctttggtcaggacacaggtggtgatggattcgggggagaaatgggggagggtgacgcaggcagagtggccagggttatcaagtggcatcattcaccacaaaatgcagtccaagaggaagcccagctgtgagggggggacaggtggggcccaggtgtgaggggggataggtggcattcagacatgtcagtacacagagtcaatggcagagacagagccagtgggcagttgcaccatgtggataaggacttgagtgagacctgtctccaaagcaggggatcactcttctaattttttatatggtgtttttcattctattctgactcatttgtaataaaacctcctttgttttttatcatatatatttcaggtgtcaacatgctggtttgatataacatgtacaaagcaaaataataacttacactccagctgtgagtgtaccatctcacagttacctttttgtgcatgtgtgttaagcccacctaaaatgcacttagaaatattcagtatcttcactgtggtcatgctgtactgcagatctctagatgtattcgtctgacatcattccagctttataccctttgacccacatctccccatccccccaaccacctctctctgtttctatggactgtatttgactattttagattccacatattacctctaatcctcaaagctctattagggttttgtgtatttccttccagcattttcctacatacacacaatttgcagaatcagcataattctgtataggtactttatttatttatttattttgagatggagtttcgctcttgttgcccaagctggagtgcagtggcacaatctcggctcaatgcaacctctgcctcctgggttcaagcaattctcctgcctcagcctcccaattagcttggattacaggcacgcgccaccacgcccaggtagttgtgtatttttagtacagacggggtttcaccctattggtcaggctggtctcgaa

SEQ ID NO: 167401 - DNA, 299 bp, Homo sapiens
aaatctactatttaagtttctctgatatataagcacattcttccctttattccaggatgaaaaatggtgtcagatcatgtgttaaataggtgatatcctacaaatgctctgtgatttgtcgtaatcagcatcaaaaatggttgtagggctcactgtgtacctcatgtcgcatattcaaatattattgatgcaggcagtgaagtacttacacataatatttcataacccaaatcccaagaaaagcatttccctgaagcaaaaacatggcaaatataattcgaaatttaggccacaaacct

SEQ ID NO: 167402 - DNA, 337 bp, Homo sapiens
tcactctattgcccaggctggagtacagtggcgctctcttggctcactgcagcctccacctcctggttccagcgattctcatgcctcagcctctcgagtagctgggaacacaggtgtgcactacaaggcctagctcatttttgtatttttagtggagatggggttttgccctgtcagccacgctggtctcgaactcttggcctcaagtgatccgcccacctcagcctcccgaagtgttgggattacaagcgtgaaccaccatgcccagccctttaaattacttttaaaaagatacatttctccacattaattctcttaggttgtattctctaggaag

SEQ ID NO: 167403 - DNA, 551 bp, Homo sapiens
gaggtgctttggggcgtggagaggaaggagccatgcctggggaggatgggaaacagccttatctaaatatgccaaatccaagcagtcaagacacctaggttctaaaatctttataagaacaatctcatttcctttgatgcagaagacacagcccagctgtgatctagtatctgggcattctgatcaaggagcaaaaggtcaggagtcattgcctgatcaccaaacagaacagaagggtggatctcaggacctggagagtggggatagatggtcagaattagagagaatggaccacagaaaatctatttgaaaagcaagccagccatctgtaagcctcttgagagagagtcaaaccacacagttttgaaaacaaattctcagctgcttgagcaggcaggtggatcagcctgggctaactctgggagatctaatcagttgcaggtgcattttgggtgttttaagagcatgttagtcataggggtaaactgtcactttgcacagttgaggttgaggcatagaactagtactttctctttactggagttgctgcc

SEQ ID NO: 167404 - DNA, 364 bp, Homo sapiens
aaaatgaaaccctcaaaccttaactcactggcttctaattcaccacagtcagattgccagggaaaaagaagggagtgaaataattttaattgtgttcttaaaatgaacaaggcaatgaaccaggtgcctcactaatgtcaactcttttcataaatttgccagcccctgggatagataccattagccctattttacaaaaagaaactgaaaaattaaattatctgcccaaggtcacggtcatatagccttacaaatctaggctgtttctgccctatcagagtttattgcagtcaactaacagacagaaatgactctgagtatttaaaacaaagggagtgtaacatagggaattggttacccaggt

SEQ ID NO: 167405 - DNA, 552 bp, Homo sapiens
aaccccaccacacaatctgcttggccaagtccaagtttgtagctccctacacaagagtgtgagactggcaggtatctcttcctgttgtctgtgcctccactgagctgccaagtactagattctagggtttgcatgagcagttttgtgtttgcataggcatttctcaaagccactgcatggcaggtatttgaagaggagccaggcaggtcacactagaaagaagcagctgagagggcatatggggcactgtatagaaaaagatcttgtgtgaagtgtgggcccagggactacactctgttaaaacagcaaaactatgtgcagtaaatggaatcccgcaggcctggctgcttttcttcccagacagctctgcccgcagagcgggcagcgtcaggaattcgttgttatgctttcttccctcactgacctttgctgggtggttgagctgtgctgggatgtttgaagcatttttttttttttttttttttttttttttggctgttggacagaaaagcaagaacaggtgcgtgcctttctgtaagggagcggcggccg

SEQ ID NO: 167406 - DNA, 170 bp, Homo sapiens
ggaatcatttcacattcactagctcagcaaaaactaaaacatatggcaaaaagagaattcttctgtttcactgacaggaacataaacagttataccgactttggagagcaaactgactgtatctagcaaagttggatataccttatgacccagcaaggcccaggcagagg

SEQ ID NO: 167407 - DNA, 403 bp, Homo sapiens
agtgcctgaagaatgtcctcacaggaaactgaagattggtgacagacgggcctgtcagtggctctagtttttactctcatggaagcaaaacccaccaggcacttttttggctaatgggttcaaggcaccaaaatgcatttagaggtgttggccgtggcaagggctgcagtggcgctgccaagttctgcagatgctgtcccaggtccccctggcctctcactgagcagctctcccattcctcagtcctcatgttcagccaggtttcctctcctgctcttatgctgtcgccctgaaggcccagcgctctcacttgcagtgtggtgagactggtttgcaaactccaaaaagccccatgtctgtcttactcccactcttagtttagccagaactgcagggagataga

SEQ ID NO: 167408 - DNA, 388 bp, Homo sapiens
aatgattgtttatattctctcatgtgacctataaagatgattaatagctaccatttattgaacatgtgctgtatgtcaagctgtggattgggcacttcacattatctttaatttgtaaataactctctaagtagggtattatttttcccatttcgtagatgaggaaactgagacccacagagttgacatgttttacccagtggtagtaaagcagagattgacagatctctctgattcctaaatccattgaattttacattaattcactttttttttgttttttaaatactaacaaaatattctgtacttggattctaaaattaccacctacagaggcttttatctgactccatttcactatctacctttcatatgtccctgagttgat

SEQ ID NO: 167409 - DNA, 444 bp, Homo sapiens
tctgaaaaccaaaaatccacaactttgagcaccaacatgatactcaaaggaaatgctcataggagcgtttcgaattttaaattttcaggtttgggatgctcaacccatacatataatgcaaacactccgaaatctaagacaacctaaaatgtgaaacacttctggccccaagcatttcagataagggatattcaaactacatacaaattaattccctcaactctcaaaaaagccaggtgagaacctgggtacctacctggctagaattaaataggttattctatgtaaagtatttagcagtgcttggcatatagaaagtacttaatattatttcccactcaaatttcaagtaatttcacaaatcttttttcttttttttttgttttgagatggagtttcacttttgtcacccaggtaggagtgcaatgacgtgatctcggctca

SEQ ID NO: 167410 - DNA, 494 bp, Homo sapiens
catcacatcacactaccttcccataactagtatattgcagcattgcttatatagttacataggattatacaggcagaaacttattatccatctttaaggaaaagttaagaatatttgccctaaagcatactgtgacttatgaaataaggaacaattgggggttaggttattgggcaaattgttctctcattaaaatatggtttctttaactggatatagaaataagttggggactgctttttttggatctctaatccaaaaatccaaaacactccaaaatttgaaactttattgagggccaacatgatgccacaagtggaaaattccacatctggtataatgtacaaaaacttttccatgcacaaaattatttaaaatattgtgtaaaatatttgtgctatctgtataagatgtatatgaaacacaaatgaattttgacttgggtcccatccccaagatatctcattatgtatatgcaaatatccccaaatctg

SEQ ID NO: 167411 - DNA, 255 bp, Homo sapiens
ttgagtgacaacatgatgctcaaaggaaatgttcattggagcatttcagatttcagagttttggattagatgctcagtcagtaaatatgaagcaagtattttaaggtctgaaaggtttctggtctcaagcatctcggataagggaagctgctcaacctgtattctcatcacttcgcactgctctgtaagatgtgcatagatatctgccaaaacagaagttcaaggttcaagtatgtttggaaaaggtagggtaaa

SEQ ID NO: 167412 - DNA, 231 bp, Homo sapiens
acacgagagaaagagaaagtgtgttatttgcctggataaaacacacataaatcaataaatgaaaatgaataggatggtgtgaggaggtgggacctttgggagatctttaggatatgaagatagagccctcatgaagggattagtgccttagaagaagagacaggagaagcatgtgcactcctgctgtgctctctctctctctgtcttctctctctctctctctctctccct

SEQ ID NO: 167413 - DNA, 428 bp, Homo sapiens
gatgttacggacaaggatgttaccgacaaggatgttacaaatttcccctcccccagtccccgaaaccagccctcccccccatcaaatcaggcacagcctgttgcacaaactcgaaggccttatgacacaatggatgcaggacacatgcccgtgtacacacagtcacagatcctccatctcacacctacaaagaccagcacatttggccaggcgccgtggctcacgcctgaaatcccagcactttaggaggcagaggcaggaggattacttgaagtcaggaggtcgagaccatcctgggcaacatagcaaaaccctttctctcaaaaacacaaaaaaacctagcacatttcacatggactcagacacacacagacacagggaggggggactggctaggagttcctggcaggatgtcaatatctgggctg

SEQ ID NO: 167414 - DNA, 463 bp, Homo sapiens
tgagatactaagaaatagatcatcccggtgactcgtcccatactcatgaacgtcattcttgtgctattcgggcttagataaaaacaggaaatgagtctacctgacgaggtgtaaccatagagggtgaaggaatttatctagagaccacgacacagtagaaaaattagttaatatatgtgtaaaaataacatgatttcagtgttaaatgattgtctgctattaactgtttattgagttaaagtgcattttggagtgagcaggattcagttaagaaaataaatatccaagatgtgttttgtgtgtggtggttgctgatactaagaaatagatcatactgtgactcgtcccatactcatgaaggtcattcttgttcttttcgggcttagataaaaacaggaaatgagtctacctgacaagttgttaccatagagggtgaaggaatttatctagagaccactgagca

SEQ ID NO: 167415 - DNA, 376 bp, Homo sapiens
aaagattgtaatagtctaagatgagaaatgataacacagtagctgctgaaatagacacatcaacaaaaaaaaaattttaagtagagtccatgaaatctgaagcttatataaaaatttggagatgggacagtgggtgaatgagaaagataatttgagaatgactcccaggttcctggcttgaaggactatctgaattatgagagacttttagaaggtatcaaatgaattaaaaagaagaattaaagagcagatatgtgaaggggacgcatgatgagaaatatatgcttgggaatcatcagtattattgtgagtgaagtgaaaggagtagttgatagaacaagtattggggaaacaagagagaactagaaggagtgac

SEQ ID NO: 167416 - DNA, 231 bp, Homo sapiens
  misc_feature (178)..(178): n is a, c, g, or t
aaagattgtaatagtctaagatgagaaatgataacacagtagctgctgaaatagacacatcaacaaaaaaaaaattttaagtagagtccatgaaatctgaagcttatataaaaatttggagatgggacagtgggtgaatgagaaagataatttgactatatgagagacttttagtcgncatcatggagtatgaccacatgtggggtgtgacacgtataacacttcgcttgt

SEQ ID NO: 167417 - DNA, 238 bp, Homo sapiens
acccaccatgggacatggatatggcccctggtgacttgtttaaagaaagacagaaggaacaggaggaattcatgtcatcccaggcatccatcccagccctgctgctgagctgatgagctcgaagggacaatgactgggtttttgacagttcagtacgtgaaagaattcaaatttacagctgttggaattttaaattattctgacccttgagaggaatgtggctaggtggcttgactca

SEQ ID NO: 167418 - DNA, 236 bp, Homo sapiens
actttaagcaaattacttaacctctctgagtgtctgttctcatttctttcattcatttaacaaatatttattagatacctactgtatgcaaggcactatggacacaacagtgttgtgttttttttttgttttttttttcctgagacactggagtgcagtggcatgatcttggctcactgcagccttgacttcctgagctcagatgatcttctcacctcagcctcccaagcagctgg

SEQ ID NO: 167419 - DNA, 346 bp, Homo sapiens
ataaaatattaaaatgatgtatacaagagtcaattaatattgttactgcttcatccaggactttttaggtgaaactggcttttattctttttctttctgcaagtagacagtggtgaagaatacaatgattactagttcattttgttgctgctgccttgatttgttttaaggcaccattagttatacccattgcttttgtaccatcatttcaaatgtaaacacaattgtttcaggataaatgatgagattcgaaaagttattgtacattttgaatgtttcagcattccttgtgtttgttgtcatgcattaaaataaaacacctttgatgactggccggtgctggaaa

SEQ ID NO: 167420 - DNA, 463 bp, Homo sapiens
gcctatagtaatcctcatagtaagtcctgacaaaatattaaagtgctcgatatctttagaaatacccttttggacaaagaccaaggttatcaagaaaaagagggagttgtcataatttgcctccagataattctctacccacagtatgctttatattgttaaacagtaggcagcatccactattttttactgtagtagcagaggaattaaaaccaaataataatatatttactgtaacatattgtgagctattactataatttttcaaaattgttatgagtttgatatctgtcaccctttctttaaaagtatcaggaaataattttatttttaaatcctaagtgtgagatgtaagacagatcttgtagcatttatagttgcctagtagagaaaacaatgagtatttacttatgttcatgaatctgatttttaaattgtgttgttacagggatatacatataac

SEQ ID NO: 167421 - DNA, 281 bp, Homo sapiens
tcctcccaatagagaatctgcaatgtccctctccctttcccatatgtgaatgattcagatcctttttggaaactaaaacaaaggaaaagaaaaagaggaaaaaatggaaagaataaaggaagggagggaaggagggaagaaagaagggagagaggaagggatggagggagggaggcaggcaggaaggaaacaaggaaggaaggaagaaaagaaggaaggaaggaaggaaagaaggaaggaaggaaagaaggaaggaaggaaggaaggaaggaaggaaggaa

SEQ ID NO: 167422 - DNA, 263 bp, Homo sapiens
tttgcttccctacctttagggtgttggggcgggcaacaacaggttactgtttgtccccatacctggttggaggaagtcatcctttctctcatagatctggccacatggcctggccctacatgggtcggtgactagccacttctgtaacttctaggtagttagccacaaggttaagccttgataaactgcccagctatcagtgcagattacgtgtcaccttcttggtgatcaccatttacattgccctgagttcagtttattag

SEQ ID NO: 167423 - DNA, 558 bp, Homo sapiens
ctgctacaacaacaagtttcacctaatttgtcatgatcatttaattaatttaatttatttaatttatttaactggttgcttttaaacctaagttcatggatcacaactaatatacaagctgagattgtcatattactattaattttactttgtatttttcttttaaaccttgtacctattacttgttaaatttctacagaacaaatcttcacagaataatactggcccaacacttttagataatagtaaatgcctacagaatagacaaaaacttaaacttaacacttgattttaggtagatgtagcctgagaaccactctctccaaacccctcttgttgctcaaatgtagctaaaagagtttagacactaactccaattacaccttccaatgtaggaccaaccaacaacgtgagacaggttgatcccagctgcctcacctagggataatcaaaacctaactacaaaatggttaaccagtgatttttttaaaaaatcttgatcaaaaaaggaaatgtgaaagttgtcagaataaaaataaagtcacctgtgttaaaaag

SEQ ID NO: 167424 - DNA, 612 bp, Homo sapiens
tccatcttgctcttaggagcacccttcccactgcggctgtgcaaggaggaagccctgagtctggggtgagaccctcatgcctgtatttaaaaaaagaaagaaaaagaaaaacgatgcctttgatgaatctgatgtttagccttcatcagactagaggcatttattattttattttagttttttatttctgtaggtttttggggaacaggtggtgtttggttacatgagtaagttcttcagtggtgatttgtaagattttgatacacccatcacctgagcagcatacactatacactctacggccataccaccctgaacacgccgggtctcatcagactagaggcttttgaaagacatttaccttccacgactgaagaattttattgatttatttgtttttccgtcttggctgcactggccctgtgctgtggtaaggtatacagcacagaggcccaagccttcgttcctcaccaccccccactttgtgtcctgtcaccgtgtgaattggtgaaatccctccacctcagcaagccatttgccaagtctacctcataggaacaagaatgtaagctttgtgaaagttcagtcgaactgtgaaggtcaaatggtgtc

SEQ ID NO: 167425 - DNA, 341 bp, Homo sapiens
caaggtttccaagtttgttcaatggggaaagaaaaatcttttcaacagatgatgctggaataactggatttccacaagcaaaagagtgaagctggacccctaactctcaccatatacaaaaatttactcaaaatggatcagtgacatatctaaacataagaactcaaaccatcagacttttagaagaaacataggagtgtacttcatgacctttaatttggcaaagggttcttagacaagacaccaaaagcataaataacaaaagataaaacataaattggacttcatcaaaattaaaaatatttgtgcatcaaaggacattatcaaaaaagtaaggcaac

SEQ ID NO: 167426 - DNA, 451 bp, Homo sapiens
cacatagaaagatctgggaccccaagcactcagcttaatgcagttcagaagtctgtctcctaggtggttctgttaccaaaaaaagattcccaggagaaaagcgtgacctgtagtccagtgacttcgactgctgaaggcactagaaagacaatttcagtgtcccttttcccttgtccttggaaatggaaatattttacttagttttaataacactacacaacacttgtaactttggcaacacttgtaacttgtaactgttcaagttacacaacacaacacttgtaactgttcagaatgcacagtaccaaactgaattctaataagcaatcttaacgcaggataggtattattataagcattttacagaagaggaaactgaggttcagagtgatttaagtaacttgcccaaggtcatatagatggcaggtgagagcggcagggagaacgactt

SEQ ID NO: 167427 - DNA, 307 bp, Homo sapiens
aatcctctacaatacaaatttgatcaggtaactaccatgctcaaaacccttccttgagaaaatgtatacacaaggctattcattgcagcacaatctgtaatagcaaaagagtggaaataaccaaaatgtatgttaaaagagaactaattgaatttctaatacatctactcaattgagtcccacaaaactataaagaggaaagtagagtatctctgtgtcctgtcaccgagtgactgctgtgacacagtgcggtgcagacagtatgttcagaatgtcccttttcataaaagaaatgagaattataaat

SEQ ID NO: 167428 - DNA, 392 bp, Homo sapiens
ccatcctggggccctttggggagctgctgacagaggatgacctggtctacctggagaagcagattgcagacctgcagcttcggcgccgctgtcaggagtatgagagtgagctgggccggttggcggctgagctgcaggccctgctgcccgagcccctggtcagcatcacggtcaacagccacttcctgccccgggcgcccggactggaggttgaggaggcctcaatcccagcggctgagcccgcagggtctgcggaggcctcagaggtggcccccggggtgcagcccctgcccttctggtgcagccacatctcccgcctggtacgcagcctgtccctgctgctgaagggcgtgcatgggctagtacagggggatgagaagccatccacccgg

SEQ ID NO: 167429 - DNA, 138 bp, Homo sapiens
gggatagagggaggtaccaagaggggtgcagccacctcaagcctgtctctgggtctcaaggtcttccctttggggtgtgttttctatccatctctgttcccctgtcccttaatggttactggctgtgtccttaatgtc

SEQ ID NO: 167430 - DNA, 309 bp, Homo sapiens
ggttaaaactacaaagctatggcaatttgagcacaggtattgataacagaaacaatctgttaggcagagagaccatgattaacatttgtaaccaattagaaatagctaaaaagacaatcaatgacaggatcaatactagtatcgaatgggaatgatataagggttagagcaaagacattgtttaagtgggtaagaaagaagcaggaagcacctcttctattcagaacttcttatttctctctcccgtttgagggtggagagaattaggggaatggagaacaggggtaaccaaggtatctcccttatctc

SEQ ID NO: 167431 - DNA, 352 bp, Homo sapiens
acccaagtacctggaaccacaggcacataccaccatgctggttaaattctgtaattttttttttggtagagatgggatttcaccatgttgcctaggctggtcttgagctcctgggctcaagtgatctgcccgcctcagtctcccaaagtgctgagattacaggcaagagccatggcaactggccaatgattcctatttttgtggacactgttgatcccttaatttatggactgtatagaaaagcatgcttcaaaatttatagatgacccaaagctagaagagatagcaatataatgctctagctgcatgctccaaagcaagaaaaatatcagctgaatagatgagggtataa

SEQ ID NO: 167432 - DNA, 315 bp, Homo sapiens
ggcacgttgacaagacaactcagaggctgccactcacctgctgtgcacctgtttcctaacaggccatggactgtactggtttgtgggggtgggtgacccctgctctaaagaatgtagtcccaaatatgtataagatagggtatgactggatttcagatatttcattaaaagtaacttttccatttggttcaagactaaaaaaccaaaatggattgctaatggttctcctgggcagccttttctgcatcccctctgcttctcaatcccatcttccctttggcattcccagcttggggcagtgggaagagattcttc

SEQ ID NO: 167433 - DNA, 116 bp, Homo sapiens
gtatagtgttatgagctacagaggaaggacacaggcagaccaaatagccttgagtcacacattcctccaggaaattatctttgggccctatgatttactgagcaggtgctcagtaa

SEQ ID NO: 167434 - DNA, 379 bp, Homo sapiens
acttttagggaaaaggggcaaatctctagtaaacgagttgacttcaggactcttcaaaaaaagagtctgtttattcagcaaaacccaagggcccaaaacaggtccccacccaagtagtcttacctgtaaggtcaccaagctggctgtggtggccaggtcaatcttcccaaatttgatgagatttccataagggttaaaaggaagagtgaacggtttcctttggcttaggggcttttctctaaaattccttgtcttcttcccatctggacttttccctctgaactattagcttactgccaaccaccgtctccacagaaatcacaagagtttaggcaaatgaaaagcaagttctgcccagccttttacatctaagcacaac

SEQ ID NO: 167435 - DNA, 214 bp, Homo sapiens
accacccctgcagagttggaagcatgtggttcccagaatctgctacgaggaaaattggggcttgaaagaagagatctttgagcaggggtggagggtgaagcttgagtcactctggtgacatccccgacgtatcatggagggtaaatatgacccagatcctgcctttgtggggaacaattccttattcctcagcaccttcagcattcctgctcag

SEQ ID NO: 167436 - DNA, 337 bp, Homo sapiens
gtctgcctctctctctgggcaacacctttgggaatactgctgtgtatggtccctggggaatctcacagcagctgggaagaagttctctgcctccgtggggccgtgctacctgggcagatgctgaggagtggtctctgcagggccgtccagtgcagactggttccacgaaggggctaagagcccagatgagacattatgcctctgggcgtctctcacattacccaggtgtttgggggcaagccaaaacataaatcaggaaggttagtcagaccaaacagtctccctgagccggagctggagagtgttagtttgccatttcactcatcccgtactggag

SEQ ID NO: 167437 - DNA, 370 bp, Homo sapiens
tgaagggaagagttccaaagaatctgtgaagatattttgaaatcaccacagagctaatattgtttccttatggtaatgcagagagcaaagctttgtaaaaggacttcctagtggccgggcgtggtggctcatgcctgtaatcccagcactttgggaggccgaggtgggcggatcacctgagttcaggagtttgagaccagcctggccaaaatggtgaagccctgtctccactaaaaatacaaaaattagccgtgcgtggtggcaggcacctgtaatcccagctactcaggaggctgagacaggagaattgcttgaaccctggaggcaaaggttgcagtgagctgagatagtgccactgcactccagcctg

SEQ ID NO: 167438 - DNA, 335 bp, Homo sapiens
cagcctcagcccactgtgccctgggcatgtgagggcttctgaaggccaagcctgagcatctcagggccgaccccagatgtctggggcagtggtgccctcaatgtctgtcctgccctgtgctggctcatggccttacctgaccctaggtcaggtcttcaggtccccagcagaccccagcatttcttcattaattcaacaaacatttattgagcaactatgatgtgcagccttctttctggaggctgacggcacagcagagatcaaaacaaggtccttgactttttgcaggggcagcctggcaatcaatggaaccaacgaggaagcaaaaaaaaaaa

SEQ ID NO: 167439 - DNA, 362 bp, Homo sapiens
gtcaaaaaacaacagatgttggcgtagttgcagagaaaagggaacccttttacaaggtggtgggaatgtaaattagtacaacctctatgaaaaacagtgtggagatttctcaaagaactaaaaatagaactaccatttgaactagcaatcccaccatgggggtatctagtcacaggaaaagaaatcattatatcagaaagacacctgcatttatatcttttttgcggcattagttacactaataaaatcatagaattaactaagatgcccatcagtggttgactggattaaacaatgtggtatatatacaccatgaaatactaatttcataataaaattgaatgaaataatgtcttttgcag

SEQ ID NO: 167440 - DNA, 469 bp, Homo sapiens
gaaaaaggaagataaaactacaatagctcatttagcaaacaagtttttaagaagtccctaacctttattttggttgactggttaatcattaatcacaagctatctattaaattcctactctattctagaaactatactggcatgaactgcatctgtttctgaagtccaaataaatattaacatttatacagtttaaagtctgtgaataacctgctactatttccaaatgaacatgatgaacagaccatttctccagagtcctaatttgtgtcaatatcaacactatactctgaggcatacaacttcaatttatgaaagtatctttgaaaactgcattagcccccacacatccacataagttgacaatgtcttgtcggttttacttccatagcatctctcacatcatccccccatgcttaaaaaattctttctaccacattctattttcctctaggttagatagttccaa

SEQ ID NO: 167441 - DNA, 665 bp, Homo sapiens
tcagaggttcccccttattccggtgtcctcatgaagcttatctttttgtgtgatgacacaaataataaataccaaatttcagtctatggaagatgatgagttacatggagaaaactaaaggtaagaggaatggcgagagaggagcaggggagggtgactcattagtgcagtcagagaaggcctcactgaaaaggaggcatctgggcagggacctacaggaagtgaggcagtgagccagggaggaagagccagtgtaaaactccccaagacagaagcatgcttggcacagtcaatggcaaggcaagaggctggcgtggcaggagcaaggtgagtgaggggaactggtgggggtggggtggagaggcagtggagtcagatcatgctggacctttgtggccatcagagacttctgaatagaggagtcagatgattatgtctgaaaaggttcactctaggtgtgatgagaacagagtcagggaacacaggtagacacagggcctccagttaaggagtaagtaataaatgtggtggtaacagcattggtgtggtgagatttgggtgtatttaaaggtatcaaccagtaggatctgctgatgaattcaatatggagtgtgtaagaaataggaagtaaaaaaatgactctgaggtttctgacctgatgacag

SEQ ID NO: 167442 - DNA, 452 bp, Homo sapiens
cccccaaaggatataatgtattatctatcaaccactctctcagaataacttgtttgttttatcatgtactgtgataggttagtcatgaatttgcagttaatgaagggctatttatttcatgcctaccctcacaggttttctttcttttttcttttttgtgacggagtctcactctttcaccaggctggagtgcagtggcacgatctcagctcactgcaatctccacctccccagttcaagtgattctcctgcctcagcctcctgagtagctgggactgcaagtatgaaccaccatgactggctaatggtggttttgtttttttgtttgtttgtttgtttttttgtttttttggcagcaggtcggtgggtgggcagtgtttgtagagacagggtctcacattgtgcccaggctagtctcaaactcctgatgtgaagcaatcctctccgctcag

SEQ ID NO: 167443 - DNA, 481 bp, Homo sapiens
gcctccccatcgaatccatttgcaaatcatgtcagttattccttaagaaattatccaggttctaattctgatttcctccacttctactgtctgggtccacatcaccatgaccatctctcacctggtctcctttctgctgccctcgaccactctctggtctaattagagcaactagagatccatttaaaatacaagtcactttaaatcctccaatggttttccactccactaaactctatcttgacccacagaccctgtatcattacacacacacacccccctctgacctcatgtatcactctcacactcactctgttccagttgttcaaagacttctctgatgttccctgaacatgctaagcaggccccagtctcagtgtctttgcatttgctcctgcctctgcttggatagctcctgtctctgattttataatcccttgctcccttactaaatctgcccaaatgtgatcttctcagtggg

SEQ ID NO: 167444 - DNA, 321 bp, Homo sapiens
atcttgctgttgtccaggctggtctcgaactcctgggctcagcaatcctcttgccttggcctctcaaaagtgctgggattacagatgtagtcacggcatccagcagcataccttactttacaaagcactctacagatccattatttcactggtttcaagtgcaagtgaaaaaagttgcataaagacttgcatcggccaggcacagtggctcatgcctgtaattctagcactttgggaggccaaggtaggcagattgcttaagcttaggggctcaagaccagccttggcaacatagtgagacccccgtatctaccaaaaaaa

SEQ ID NO: 167445 - DNA, 390 bp, Homo sapiens
tgcataggtagcatcagagcatcctgcactgagcccgactctgccactctgtgctatatgcccggttatgtcatgagacctctctggtctcagcaggttcatctgtgaaatggggctgccaggaggttctgatgagacagtgtgtgtgtagcttccaaaaagtggtagctatcagtgttgctcttactacaaatgcagagtccctggcttcagagtgttgaacaggaacccccactgcatgggccaagtgctttgctttgtatctggcaggatgctatggtgagggctgtgctgccagcagtgtccttggagctggagagtgaacccaaaggcctcagcctcagaggatgcacctagctttgggcagggggggcagttggcatggttctc

SEQ ID NO: 167446 - DNA, 292 bp, Homo sapiens
atcagattatttacaaataataaaatttgctaccactgcagatactcaaacgacagtttcaggggctgttatacagtctgttcagtttgcttcaagttacactgggaggatgtgttcacttatttcaaactatgtaactggagatattcaggctatagaaagttagctaatatagaaaacatactgctaaaacaatgctctaatggtacatccacaattttctgaagctagaatgaagatagataattatgtattattggcagggcacggtggctcacgcctgtaatcccag

SEQ ID NO: 167447 - DNA, 409 bp, Homo sapiens
tggtgacagagctagactccgtctcaaaaaaagaaaaaaaaagaaaaaaagggggcagagtctaaaaggattttggacatgaagcttgcatactacgctcctgcagagtcgggacacattaccttcttggcatagatgtataacaatatgcatgaagtatagtagccccctccacccacagtttcacattctgtggtttcagttactagtaggcaactgtggtttgaaaatattaagtggaagattccagaaataaacaattcataagttttaaaatgcatgctgttctgagaaacatgatgaaatctcactctgtcccattctaccttacccggaacgtgaattatccatttgtccagcgtctccatactgtatacaagacccacctgttagtcagttagtagccgtt

SEQ ID NO: 167448 - DNA, 277 bp, Homo sapiens
tgacccaacgtctcccatcttattagtggaaggaccaagactggacccacaactatgctcctgttttgagtcaccatgctgccctcaagatcagatctcaaaacaagcagacatggggggctcagaaagtccccagcctagaactttcctgtcacccaacgacactaagggctaagctggctgcttattattctggattcacactagaatgaccttggggtgtgtttcacacatgccaatgtctgcagtttcacccccagctaactgactatggatc

SEQ ID NO: 167449 - DNA, 433 bp, Homo sapiens
ccagtatctgttcttatttcttatccttagtagtcagaagtagcaaattaggatggagaatgatcataatagcaaatatgtgttacatgcttcctatgtgccagaaactgctaagtgttttatatgtgttgtttccttagaggcaagtatattaatagcagccagaagtgacacctgatggcaaggggagaaaacactgttaagaccagaacagtctgaacctttgtatgaggcaagcagatctacctactcagcccaatgtctgtccctgtattccagcactgcatacatgaggacattaataatcaagaaaaggttaaattacatttctcccttgttgttttatgtatagtacattgcagcattttaagaacaaatatgtagatatatgttcaacttctctcttcccccagctaaggacgttaattatagc

SEQ ID NO: 167450 - DNA, 380 bp, Homo sapiens
ttcaaaatcttcagtcaatttcatctttgtcaactaaagaagattataaagagacacagaagatccaaaagaggttccacaaatattatttgctaaagttttaagttttaaagtgtgggtccttttattctcttcaaaagttggcaaaatctttcctttagcttatttttcctattcttaataatttagtcagcaccaggcatggtggctcacatctgtaatcctagcactttaggaggccaaggtgggaagattgcttgagcccaggagtttaagaccagctaggcaacatagtgagaatccatctctacaaaaaataaaaagttagctgggcatggtggcatgcacctgtagtcccagctacttggaggctgaggtga

SEQ ID NO: 167451 - DNA, 348 bp, Homo sapiens
aaacattcttcacagcctctctcccagtttgccttcctttcaattcttctgttcctttttgtcttttcatctcatgatatttggcctcatagagttaggattgagtaagagggaaatggacagatatgtgtgtgcctctgtgtgtgtgtgtgtgtgtgtgtgtgtgtgtgtgtgtgtgtgtgtgtgtgtgagacagagagagaaataggaagaaaaataacataattatatgtactttccactcctaacttcgatgcttccttcacaccaacacaatcattctaatcatacaaactaaacttttttggagagactttctcccatttttaaatttattttttaaatttt

SEQ ID NO: 167452 - DNA, 412 bp, Homo sapiens
cgccaccggccccgctgcgggcctctaggggactgagacggtctcttgttcgcctggacggcgccggggagcggaggatctgcgctccgggtctccaggatgtgcccgtctgagatggggacgctgtggcaccactggtcgccggtactcatcagcctggccgccctgttttccaaagtgacggaaggtcgagggatccttgagagcatccagaggttttccttgctgcccacctacctccccgtgacctaccacatcaaaacgcggacgtctccttcttcgtgaaggaggccaaaccaggatatcatgaggaactccagcctgcagtcccgggtggagtcatttctgatttacaaatccaggaggctgcctgtcctcaatgccagctacgggcctttctccatcgagcaag

SEQ ID NO: 167453 - DNA, 207 bp, Homo sapiens
gataaaagtaccttctctggggcagacataggcaatggctggtgctctagtacgtgatgaccgctgtcacaggtaatagtatcttaagccacaaatacccatttgcatagtattacccagtttaaaaaaatccttccatgtgtgtattttcattatctctataaccatgatgttttgcctttttcttttaagtaatctacaaaaagc

SEQ ID NO: 167454 - DNA, 188 bp, Homo sapiens
ggaagaaacaatagactaatttttaaaatccgtggagatttgaagaatacaaataggacttccagaaataaaaaatagaataactgaaactgaagatcttcagcaattggcacacatttgtgtaagttatttttatgagcaacattaagatagcaattctcataaagatatatcaaagaaagtatttt

SEQ ID NO: 167455 - DNA, 298 bp, Homo sapiens
aatgagctcctattacattccagacactggatataaggcgatgaacaagatagacaaactaactgggtttatcaccctacagtagaggtgtgtgtgtgtatgtgtatgtatatacatatcttctagattacacctcctgaaatcggattcacttatctttcacataccctagccagagtaagtactcaaaagccattctttgggctgggcacagtggctcatgcctgtaatcccagcactttgagagggcaaggcgagaagatcacctgaggtcaggagtttaagaccagcctggcca

SEQ ID NO: 167456 - DNA, 425 bp, Homo sapiens
gatgcagtatgatcatatgatgagcttcttttctacgtaactttatattgctgttgtaaccttggttttaagaaaagttaaagctctctctttcctgattattattagatttttgtgttcatgaatgttttgaaaaattaataactaagacactgaattgagatgttttaaacaaattttattaaatgaaatatttacagtccatccaaatggatatttgtaattaaaaaaaaatgcaacatttaaggaacctcaacaagtcttcaaaaaatttagtttgggtttgggctgaatatattactggatggcttttggcttaaaaattgctgtatgcagaagttggggagggaggctgaacaaaaacatcataggcacatacctagattatttaatgaaaagaagaatttctcctccgctaaaaaaaa

SEQ ID NO: 167457 - DNA, 343 bp, Homo sapiens
agatcacctgaggtcaggagttcaagaccagcctgttcaacattgtgaaaccctgtctctactaaaaatacaaaaattagctgggtgtggtggaacgtgcctgtaatcccagctactcaggaggctgaggcatgagaatcacttgaacccaggaggcagaggttgcagtgagttgagattgtgcaactgcaccccagcctgggtgacagagcgagaccctgtctccaaaaaaaaccaaaaaaataaaatgcaaagattgtcagactgaataaaaaaatgaagttcaactatatgttgtttacaagagatacatctgacatatgtttacataaatattgaaagt

SEQ ID NO: 167458 - DNA, 233 bp, Homo sapiens
accttgcgtctgggaattctactcacagcatggtcactggttgggcaaactgcccctctggtctcacagacattcctcccttacaaggcagatccccaggggaaaggtggagctcaagctacctgctgtcatttacctttgggcgacccgtccgtatcagtgacagctggagaagggccatgtggttgcaactactgaatgtcccttcagggaggccaccataacgactaccc

SEQ ID NO: 167459 - DNA, 682 bp, Homo sapiens
attcccccatatctaattttatcctcaataacttatcaggtaccatcaattttatctcctgtataggtctcaaatctacctgcttctctctatcattctcccacctccctatttcactactatataactcactaattttctcacaggtctatcctgaccattctcccatctgtgttctccatagtgaagccagaatgatctttttagaatgagaatttttccccctccctgcctggtctcttctacaccacttaaagccacctcagtgatttttccattgctgttatattgaggtctatgagcctaaatatgttagcaagccctgcccaccctcttgtcttaaacctcccctctcttcctgtatctttgccctccagacacattgggcttattttgattttggaatgcttcttacctactccccctatcccccagtctttgcctaattaatgactaattattctttaagtcctaggtcaggcatctgtcactcagggaagtctctgacatcccagagtactccatgccacccctttattttaatcaacattaagtaaactgtgcttctttcttcagagaattatctcagtttatagccatgtagtcataattgcattcctttgattaatgtcagtcttctccccaaactggaaattccatgagagcaggcatttgttatttt

SEQ ID NO: 167460 - DNA, 139 bp, Homo sapiens
tttttgtttttgcttatttttttttaattatgccgtgtgttggcacacttcatgaaaagcacctatttctggccaggcacagtggctcacgcctgtaatcccagcactttgggaggccgaggtgggtggatcacctgag

SEQ ID NO: 167461 - DNA, 398 bp, Homo sapiens
ttgagattattcagctagccccagcagagagtaggggcctatataaaaactgcattccaaacgtattgctaggattcaaagaaaagtctgtccaacttggggacttcccagtttagctgagacagagataaacaatgttgcagaatccttatgcagccatcaacacagaagaactggtgaagaaaggagaaagtggccagtctggaataggatcagtgggaagggcatcccagaagactgctagaagagggaaaagaaagactaacatgctagggtaaggattccagggaacagcagaaggaagaaaaaggtgaacaggaaatagatctactttctcaacaatttcactgcctccctattttactctctccaattttttttttttttttttttggaaa

SEQ ID NO: 167462 - DNA, 450 bp, Homo sapiens
ggaagtatcccatttggacccagcagaacggccggaggctcggggtcatccctagggccggggggaaaggagttctgatgtctcccccaccggcactgccccttcattcaaggcatcctggggagcagggcctggggcaccacctggtaagaggccttcagcaggcaggtggctcaggcccagcggggtttgccatgggctcccagcacctctgccctgctcaagagtggtgagatgcctggtgtcatggcagtctcctgaagaggcacagagatgggcacctgtggccacacactttccacttagctcctctgggctgttctcctgagcctaaacatatgcttggggagaggaaccacgtccccaccccatcccaaccagaaccacagcctgagcactggagtgggaagagggaaatctgggctccaaaagccctcatggcactgggat

SEQ ID NO: 167463 - DNA, 537 bp, Homo sapiens
tgacctcctgggtctagcgcccacccggggcaggtcctccagctgtggccactcagccaatatctgcacaggtggcggttgcccggtcaagggcgggctcacaatctgcggggcggggagagggaaggagccagggagaaaagggagagaaagagggggcagtgtggcagaaaggaagaggaaggggcaagtgtcagagtcggcgagatgaggagggagggtgtaggagaaaggaaaatagaaagtgggtgagaccgtgggagagggagactgggggagaaaatgtgggcgtgtgcgcgctgagagagagagagagagagagagacttggagagggaaggaagggaaggagcgttgagagcaaggaggagcgagttgggggcggagacgaggaagtgggtgcgaggcgcggggcgcaggccgtgcgcgcgccgcccgctgcatccctgcccggagcgcagccggcgcgggcgcgggaccgaggcgaaccgggtgcggagccaatacccgcggcagcagcaccaggtaacgcggccgc

SEQ ID NO: 167464 - DNA, 281 bp, Homo sapiens
tctccaggcctgagaccctcaggggtgtggctcacccctccctatttttaagtacctatactagtatttacttatcattttctgtaaaccaacttgcttttatttactaaaatatattcatttatttttacagctttattgagatataattggcatacattgacagtgtaatgtgattatttttaaagaaaacgtaatattatcctggatatggggagcagagccacttgtcataaattaaaggtaactgtaaaattaaattccatgaaaacaaaacaaca

SEQ ID NO: 167465 - DNA, 329 bp, Homo sapiens
cttccagcaaaattaagaagtaaacatttagaaatgtacagtaccttgctgttaagtcttcgcataagtataccaatcaaacataaaggccaccttaaactttcatttgaaatgaaagacaatttttaagaggttaagggctagtaatttgttaaagtcctgaagttaaattagctcaagtaaatataaagactttcctttaattaaagccttttaaatgaacactttaaagcatgattatgaagctccctcaacttacaatgtgctatttgcaaccttagatgctatcattctggcttttctaccttttagcaacaataagcacaccc

SEQ ID NO: 167466 - DNA, 594 bp, Homo sapiens
cctcagctgcacaaaaggtatctgcaggaatgactgtggtttttcttaactaacctgagtatgatgattacaacaagcaaatttccaaacactcttaaattcaaactgttaaaattcttaagaattcttacattcctgagaaaattatttgcttgttatgactaacagcttatctgaggactcttctaaaaaatcattccaacatattcatttagcataatgtatttaatatggtaatttggcaaagccaagattcaagtcacaacactaaaaagtaaattatttatgaaaccccacctgaaaaatctaaattaatgtaagtgaaggtggagatattatatgatcaattaagttggccacaaaaccacagcttactgatgcttttcctcttatgtaaaaatcacaaataaccaatcttttaaaaactacatatagaccaggaacggcggctcatgcctgtaatcccagcactttaagaggccaaggcaggtggatcacctgaggcaggagaatcgcttgaacacaggaggtggaggtttcagtgagccaagatcccaagatcacgccactgcactccagcctgggcgacagagc

SEQ ID NO: 167467 - DNA, 274 bp, Homo sapiens
atagatatgagaaacccaatggaaagaattaatactgaacttctttttaaggcgataaacaaaatcaaccaatccgtatctagactaactagaaaaaggactattccaacaaataagatcagaaatgaaataggagaaattacaacttttaactctaaaatacaaaggattacaattgttcatataatgaacatttgtatgccaacaatttggataacatggaagaaataaaaacatttccacaaacatacaacttaccaagactgaatcaaga

SEQ ID NO: 167468 - DNA, 404 bp, Homo sapiens
atgatttgcaaatattttctccccttctctgggttgtcttttcattctgttcattgtttcatttgatgcactgaagtttataagtttgagtggtcctgttactgtttttgtttttttgcctacttttaaattgaggttttttgtttgtttgtttgtttgtttgtttggtaagctgagctttaagagttctttgtatattttgaatacaagttctttatcagataggtgttttgcaactgattgtggcatataattccttatacacattgctggatttgactgctaatattttgttgaggatttttacaactatattatatctaatttcttatttccttttgggattataataagttttttaataaataaacatttttaaatattgggatctcaaatccaagcaa

SEQ ID NO: 167469 - DNA, 405 bp, Homo sapiens
gggccattgtatttcttactgtttgggtggtcacgatcacaaaatttttgaaagaacactgacctagaagttaacaaaaagagccatggagttaaaaagttaaaaccattcttaaagtggaattggcaagtgtgaaaactggcgactgtgtattgcttttgggaaaaggagatagaaaataaattaggagtgtttaaaaatttgggaccattaaatagtgctccagggttagagaggtcgtctagggactctctttgtccagccagctgtggctcatcctaaatatggcttaaatatcacttcctcagacccaccttgtcgcttctctcctctgtcacctttttttttttaatagaacttatcacaatgtgtaactatacatttgtttgtgtgtttctctaatgt

SEQ ID NO: 167470 - DNA, 415 bp, Homo sapiens
ccacatctcctccatccccaccccaggcaatcatcattctactctctgcttctatagttttgtgctgacttattttacttagcataatgtcctccaggttcattgatgttgttgcaaataacaagagttgcttcttttgaagggctgaatagcattccattgtgtaaatataccacattttctatatttattcacctgttaattaactcttagtttgattccataccttaggagtaattgtgaggaatccacttcccctttttttcatttgcttttacctctttttatttttatttctagaagcattttaatttaatactataacttatgattgttacatagatcatctgagcttgatttgggtcatgagctatgagcccagatttacatccttggagctgcgtctgctgaggag

SEQ ID NO: 167471 - DNA, 577 bp, Homo sapiens
ggaacaagactgaaggaagggtgatccactgcgatgctatggcaacagccctgggaagaaactgcgttgccccagatcggggcagatgactgtaggcaaagagcaggtgaatttgagagaaattaagaaggcaaaattaacatacctccatgataaatgaatgataggctttatggaaaaatatcagagccaagcagagtggagccagccactcaggaggctaaggcagaaggatcacttgaggccaggagttcaaggctagcctgagcagtacagcgagatcccgtctcttaaaaataaaataatggtgcagtggttcatgcatgtagttccagctattcaggaggctgaggtgagaggatcacttgagcctgagtttgaagctacagtgagttatgatcacactactatgctacaaattccatcctgggtgacaaagcaagactccatctcttattaaaaaaagaaaaataggctgggtgcagtggctcacgcctgtaatgccagcactttgggaggccgaggagggtggatcacgaggtcaggagactgaaacatggtgaaatgctgtctctac

SEQ ID NO: 167472 - DNA, 358 bp, Homo sapiens
aaaaatgacaaggtccctgaaggagtattatcacaaagtgtaatggattctgttttgcttttgtttttgctcatctgacagattacaacatcactctggccatggaggagaaaatactggggttttctttccttgatatgatcaacatcgtcctagttaattagtactaaatttacttaggagggaggaaggctgtccaaggaataaagaaaaaaaaatcaaaggtttgttttatgggggaaagatggttatacacatccaaaagagctggcaatgtggcctgtgacacttcaaataaaaccagcaccgcttactgaccctccgtgataccgacttgcctcaaatcgcctgtgtaagg

SEQ ID NO: 167473 - DNA, 332 bp, Homo sapiens
cattctatgtctggtgattcccaaatctgtatctacagtctagatctctcagtcaactccagcctccaactgacttaccattccctcatagccatctaacaggtacctagaacttaacatgcctgaacctgaactcttgacaccccatcctgaccacaccccagcacgttccctaccccagtaacggtaccaccattcacctgccaggccacaaatcttcagagttattattgactcttctcttacaaattcccaatccaattcatgagcaaatcctatcagctctaccttcaaaatgagtctagaattcaacccttcctatcccttccacc

SEQ ID NO: 167474 - DNA, 417 bp, Homo sapiens
gaggagaagaaggagaagaaagaaggaaagagagagagagagtaagaacataactaaataaaaataagggaagaccttcatggatggataataggaaaccaggacctagctagggaagaggccttgaggcagtggaaaagggagaaaggcctagaagagccagggaatctttggtgccaaagccagaaggctttgcttcttgttgagaagcctagagctttttcttctcactggggtttttatgggaagtttaagcatgctagagctgggaaggctcagctgtacccctccctcctctctcacctggctgctggtttagacaggactgtcatgtttggaatttcacacctcttgaatctgtagactggtgtctttcatgtgctttggaaaactcagccattatctcttcaaatacgt

SEQ ID NO: 167475 - DNA, 351 bp, Homo sapiens
agcaatggcccacactgacacacaaaaatacaactgagttcaaaactgcaaacattactgagtatccaaaaccttcagagcaataccaaattgtctaacataggcatgttttgaacctcagaaagagaagaggaagagggcagaacaaaagaaatatttgaataaataatagccaataaatttccaaaatgacagacaccaaaccacagattcagaagatcaggcagggcgcagtggctcacacctgtaatcccagatctttgggaggcccaggcgggcaaatcacctgaggtctggagaaacaccatctctactaaaaatataaaaattagccgggctgtggtggcacat

SEQ ID NO: 167476 - DNA, 628 bp, Homo sapiens
gcatctcactgataacacctcaacccttaatgactaatggtggaattaagttcaggaatggattcattgccagcagcttatttcctttctagactcttctgccaggaagttcttcaaacgctcagtgtgagctgtgatctgagtgaaatactaagtgtgataaccttgtcactggttaatcttggtgcttggaacggtcagtctatttggagagtgtcctttgtggcagtggaaatagtaattacagtttctgacttaagtggccttggtagagttttccatccttttctttcctcaggagtttcttttttaagcaaaattcatcttatttgtgtttaccatgtcaagttagagtggggcataatatatagatgtatttattgtggcctttttttatataaggactagcccttggaaatcattgtcctgtgggccccactgtgcaataatcctactggataggttttagataattctttcctggcaaactgctcttttgggtacctagcaggaatctgaagtcttggttttattgaaaagaattttgagattcataatttctgattctagattatagtttgtaacatgtttgaaacagaagcttcgaaagagtgatttctcaacttag

SEQ ID NO: 167477 - DNA, 477 bp, Homo sapiens
cctatggcaaatcacatgtaaaagtgtttaagatattccctttaatatcagaaaagtggcaagaatgccttcttttatcttttcaatgctgtaatgcattaaagggcttaggcagtgcaataagaagaaaaaagaaataaaagagagattggaaagcaataatcaaagctgtcattatttgaggcagatagataattgaaagtacctctgattggttgcagcagacaatcagatgtttgcatagagtaagtttgtaacttcagcctctggttgctttccaaaacaattagactgattgccggccaccacttcatttacatggggtgaacaccaagtggccaatgggaaacctctaggggatatttggaccccggaagatactgtaaccgaggcccttgagctgctgctctggcccactcccaccctgtggcatgtactttcattttcaataaatttctacttttgctgcttcagtct

SEQ ID NO: 167478 - DNA, 296 bp, Homo sapiens
ggaggcagttactattccacagaggaggaaacctggacctactgtgtagtgctagtgtgaagattactcaaggaaaggcatgtgacgaactcagcacagtacctgggatagaataaatgctcaataaatattagtcactgttattatgatcatcattattatctaaaattaacaatagttctagctcttcctctcaacttgctataggatcttaagaatgtcgcttctcacctcccagcctcactgttccagtccatcaaatgagaggtttgatgagatgatctctaaagtctcct

SEQ ID NO: 167479 - DNA, 249 bp, Homo sapiens
cctgtcctccttacccaggacatggcctcgggagccatggctccggggtggctggaggggagtgagtgggtgatcagcaggtctcagcagctccttggctcctatactcctagaggagctggtgataccgtgggatgccctgccttcctgcagagacatgctgggccctggatcgagacaggtcccagacagggtatgtgtcatggtggatttgatgccagatcctttgagagccaggagaggaccgat

SEQ ID NO: 167480 - DNA, 437 bp, Homo sapiens
attcgaatccattcgatgatgagtccatccatttcaatttcatgataattccattcgtttcctttcgatggcgtttccattcgattccattcgatgttgattccatttgtttccattggatgatgattccgttcgtgtccattcgatgatgatcacattggatttcattccataattctattcgattccattcgatgatgattccattcgtttccatccggtgacgattccattcgattccgttcaatgtttattccactcgagtccattcgactattccattcgattccatttgatgatgattgcattcgagtccatggattattccattctatttcattagatgattccattcgagtccattcgatgattctcttcgattccattcgataattccggtcgacgcggccgcgaatttagtagtagtaggcggccgc

SEQ ID NO: 167481 - DNA, 388 bp, Homo sapiens
ctttgacatgcggcaggtctcaggctggcagcagaagccaggaatagtaatgtgaggtagcaaagaggcagaggttaggaaacggttctcaactcttaaaatgcacagcctgacattaagcaatctgggaaaattacactgagcatgtgggctcagctagtcctgagattctaccctactcatatgtagccaggcacgaaattgtagtccactgcaagtccaccctctcttagtcttccttgcacctccgactctcacgaatgcacccgccttgacgagtctgctctccaaatgccctgcaagtcttcccttcccattgccctcgagcgtcattcaatctcaattttgcttttgtttaacaggatatcctgcctccagatgcatgaca

SEQ ID NO: 167482 - DNA, 129 bp, Homo sapiens
gactcacacaattcgtttcacgcaaccaatgttttgtgaatactcactatatgcccggtactgtggcagttatccaatattctacaacataaaataaatacctcattccaaatatcccttatcatccgg

SEQ ID NO: 167483 - DNA, 501 bp, Homo sapiens
gacacctagtaatggtaatgatacctgtcttaaaatattaaaaactggccaggagcagtggctttcacctgtaatcccagcactttgggaggtcaaggtgggaggtctgcttgaacctaggagtttataactagcttgggcaacatagtgagaccccatctctactatttacgtataactggtttgagattcttgtaatttttcatataaccaaaatattttctattatgtggttcttttttgtctttagggtttgaatcataatgctgagaagtggcaaagtttttaaattttcaagtttatcaatctgtacaataatggaatttaaagttgaagttttaacctctcatttaacaaaatatgaagatagagttatatcttcatcctttctgaacatcccaaacaaacactttctttgactccataaaaagatcttgattgattaatatgtttttcttatctttcagggaaaaagccaaataaaccttaataagaataata

SEQ ID NO: 167484 - DNA, 361 bp, Homo sapiens
ttccagctttggccactcggagctctttcaggttggctcctgtgtcattcggacaggccccatgtcttgtcttttcttcttctttcttggcgtgtccttactttctggtgtaacaaggtgccccaggctcatcctgtacaggcctccctagaatcaaccatttctccatggagccctggttccttttattggagaatactatttagaaaccaagatctgagcaccggatatgctcattgttacagaggtgccaagtaggctgtaaaaggcaacagaatgggctgggcacagtggctcatgcctgtaatcccagcattttgggaggctgaggcgggtggatcacttgaggtcaggagtttga

SEQ ID NO: 167485 - DNA, 442 bp, Homo sapiens
ttccagctttggccactcggagctctttcaggttggctcctgtgtcattcggacaggccccatgtcttgtcttttcttcttctttcttggcgtgtccttactttctggtgtaacaaggtgccccaggctcatcctgtacaggcctccctagaatcaaccatttctccatggagccctggttccttttattggagaatactatttagaaaccaagatctgagcaccggatatgctcattgttacagaggtgccaagtaggctgtaaaaggcaacagaatgggctgggcacatgggaccgcagcaatttgaaaagttatcagtgtgacctggacagatgctcaagggtagtgagaggctgctttcttaagaggctgggttgggtgggtgaaatcttattttgggccatgtgtttagtataatagcttttttttttttttttaat

SEQ ID NO: 167486 - DNA, 239 bp, Homo sapiens
ctagtggtgtgtccgcatagtttatggggggtcagggaggtttgacatgagctaagggagccgctgtgctaggcgctcgcgaggaccgccgttgtgagcagttcgactttccgcccaaactgggggatgctagaccgcgggcacctctgaatcttatgccttcagtgatataatcctccgtgtccttcgagtccctcctgctgcagacaggtcccctatacttcggtacacacgagcct

SEQ ID NO: 167487 - DNA, 605 bp, Homo sapiens
acttaaccaggaatggagtgggcaggagctgagggttaaggctgcctctcaccaccccacacacccccagtagaagcactagatgaagggaagggtggagaggcaaggggctatatcagatttttccattttcagaatcctgttctggctgcaggtttgtgccaggagtaaaggctgctgggaggggcagccggaggagggaggtggagctgagtgactcacaagatgagtcacagatccagttataagcacagaaagaggccaaggtccttcccacccctactcctcttaactgctgccagccagcttccgttgctcttttgtactgccccttacccacttggccaatgcaagagatggcacagagaaagtctacatggggacatcgtaatattttgttacccaactgatgtatggtggcaaaataccctgtgatttgcagactggctgtctgcaaagtagaagagacagaatgcctgcatgactcatccagatctatagttgaaaggcctggagggaaagaaggaaattagaaaaatctggagtgcaggtgattccaggccgggaaggggcttctaattctgtcttctcacctgtggctatat

SEQ ID NO: 167488 - DNA, 399 bp, Homo sapiens
cacacaccaacaagacagaccaaagaatcagggaataaacccatacacacaatcaagcaatgtgacgaaggtaggaaggcgcttctggagaaaggacaatcttttccacacatgattttggaacaacaagacattcatatgcaaaaaaaataaacttcaaccaatactcacaccttatacaaatattaagtaaaactggaccacaaacaaatgtaatttaaaactataaaaggtttagaagaaaatgttggagaaaatcatacctaacctgagttagacaaagaagatttcttagatataatactaaaagcatcgtccagagtagaaaaaagagtttaactggatttgctatgtgaaagactttttcttttttttttttgaagatggagtttcactctt

SEQ ID NO: 167489 - DNA, 439 bp, Homo sapiens
gagaccaaagaaaagacttaatcttttaaaggcatgctctactggctgtaagaaaaaaggagagaaaattacttaaaatacacaaagaagctggaagcctgatgatagccaattaagttaatacaccctcctaattaaaccttctccacagaaaccaaattgtggaatttgagttccttgcgtctcttccaatagaatccctaatgagccgtggggagacccaaaggtgaaggagaggaaaaagacaaccgagagcctcgaaaattcagcctcagacccttcatgcctggggcacaaagggatgcccatcatccgccctctcctccgacggcccatggctacaggggggcatctgatctctcatccctgtggttccatatcaggatggggtgggggtgcacaggtccctcagctgtcccctcctgaagagggcgcgagg

SEQ ID NO: 167490 - DNA, 103 bp, Homo sapiens
gggctaaagaaacttcctttacaaagttctgatgccactgattcctgacatttaattcttccttaaaaaaaaatcacagtcacattcataaaatgcagaagtg

SEQ ID NO: 167491 - DNA, 374 bp, Homo sapiens
ttacgtagggctcacagctatcggttcaatcaggtgtgacatttacatattatgcaaatgaactttcattggccagagccatcttgtctactccttactgtacatgtggctggcagagaagggaaggtggagctgccatcttgaacagtcttgtccctagtacccatataagttcccagcttgcttgtctgtgtctgcagtttgactttacaggctgccgtctgttagaaaacgatttggggctgcttttcatttcgttaaaaagaaaagccttaccgaggactcccataaccttactctctgcctaagtgatttcttcttaactcctatatcactggtatgtttctgtagtagttcttggagcaaaagttcat

SEQ ID NO: 167492 - DNA, 352 bp, Homo sapiens
ttttaaaatagtcaatgggaagcacaaacaatttcacacaaactctacacacctcctaattaatacatttcttggccttcaaatctaactggttttaaataaaataagaaaggaaattgtcaaggctggcaaagaacactgaaaggataaactgcaagcccctacccgccatggaagtttcaggagggttgcaaagcttaaagcataaagcatactgcctcttttctttcaggtatgaaggatacatttaattgggcgcagtggtggtgggttggctggggcaagaaagtgttagtatttcgcttagctttcacatcattttgtgaatcctgcaaataaatactccctaaaa

SEQ ID NO: 167493 - DNA, 255 bp, Homo sapiens
aacatatgcattacttcacatatttatttgtgatgagaacatttaaaatctcttggcaactttatttcttttctttttccttccttccttcctttcttctttcctcctttctttcttgacagagtcttgctgtgttgcccaggctggaatgcagtggcatgctcttggctcactacaacttctgcctcccgggtttcaagcgattctcccgcctcggcctcccgagtagctgggattacaggcgcccgccaccac

SEQ ID NO: 167494 - DNA, 457 bp, Homo sapiens
tggcctcaagcaatcatccgcctcagtttctggagtagctgggactatacatgcacgccaccacgcccagttagagctatagtctaagaaaacaaaagacccaccaggcccaacttacgatgtggtcatttaatagttacatgattttggttattttaaaatattgtatacctcatttgtcaataatctaacaaaagaaacatgcacttactgtagaaaaattaagatactgcaaaaatagatgaaaaaattacaaatcactcaaccttaccatttggaagtaattatcattagttattatggagtaattaaaatgtaaaagtaattatcattagttaatactgtggtgtaaatgtatgtttacaaacatggaaccacaacatatgattctacagccttcacataacatttatatagggcaaactgacaaaacaatgtttaaggctgcacaacgttc

SEQ ID NO: 167495 - DNA, 259 bp, Homo sapiens
taaacattaactgcacaatcagaaaatccgctttatgtccttatgcaagtccttgaggatttatcgtttctccaaagtattaccagcatgtgtaattaaaatccacattttaaaatttatgcataatgtgccttatattatgctgaaaggggtttaaaacaggcaagtcataaacttgctcttggatgaacaaatgtacagaggtaaacaaaatttcattttctacaagttgtgataagctagccagaaaatcaagggc

SEQ ID NO: 167496 - DNA, 391 bp, Homo sapiens
tactcagttacagcaaacagtctctgtaaagatatggagaaaagcaagagagcagtatgtatttagtgaaatgtaattaaattgttatgattcaggcatagaaagtggcaagaaggttagatattgtcaaaagtgataaaatgacactacaggggaagccaagggctgaaacatgaaaagcaaagcatgttgtaccacatttagaacagagttggaaacacaataaatgttgggtaaataaatgagaattgggtggctgtgataaggactttggatttcatattgttggtagcaaacgattagtggtgagtcggagagaaagataacattttaagagataactaggagggaatgttgataagatttgcttgtgttgaagggatgataataa

SEQ ID NO: 167497 - DNA, 444 bp, Homo sapiens
ttaacaggatctcggggtgtgtagcatggtactgcctgagtgtcaagggattacgaggttgtagccgtctcgtggttctagtgatggtgtacatgctaggtgtggaggtagcacttgtgtgtttcacatcatgaaacacagggcagtggctaccagctgctaagtggggtgggaagatgatgaatttgagatgttctgagagtgacaggctaggctcggagatgtccagcagctggaaagtccgaaagggagggaggccgttcctcaccctggtctgatttcaaagtccctactccttccactcttttcacaatttcccgatcctcgcatgggccctgggcctggccttccattggctctcacatgccgctgccactggaggattttctgggagggtgcgtgtctgcattttatttggttggatggacgagctacacgtgcaag

SEQ ID NO: 167498 - DNA, 433 bp, Homo sapiens
tggacaggtatcgtgggggagctgggcacccctgctctaggaaatacaaggtgtggccatctctgatacaggatggtgtacatgctaggtgtggaggtagcacttgtgtgtttcacatcatgaaacacagggcagtggctaccagctgctaagtggggtgggaagatgatgaatttgagatgttctgagagtgacaggctaggctcggagatgtccagcagctggaaagtccgaaagggagggaggccgttcctcaccctggtctgatttcaaagtccctactccttccactcttttcacaatttcccgatcctcgcatgggccctgggcctggccttccattggctctcacatgccgctgccactggaggattttctgggagggtgcgtgtctgcattttatttggttggatggacgagctacacgtgcaag

SEQ ID NO: 167499 - DNA, 219 bp, Homo sapiens
gcaaaggctgctggataatagtaataacaaataatgtaaagtgctttcactcctgttctcattccttcgtcacaaagacactagaaggtaggagttactggcctaacttgactgatgaggaagttgagacttgacctaagtgactcagtaagttccacacctagttcctagtgttggagaaggatttttctcttttttttttttttttgaggccagatt

SEQ ID NO: 167500 - DNA, 215 bp, Homo sapiens
ctatggggttcatgtaaaacaaataggggccaggctaaggctggggagaaatggcattcaaggaagaaacttctgcctagagaagataagctgattataacttactggtggtctcaactcttcaattagttgcacacagaggcccttagcattttatattagaaagagaccattcggtcagccttttacctatatagaaattcaactcagtaaac

SEQ ID NO: 167501 - DNA, 202 bp, Homo sapiens
atggaggaggacaaggtaggcaaagggaatggcacgcacaaagctgagcagtagtcaggcaactctgggtaactttatggtgagagcaaagggcggggaccacagctggaataaagctaaagaagaatggcaagaggccaggtcacacacagccttataggccctgtcaaggattgcactgggggttggcaagacaagtaag

SEQ ID NO: 167502 - DNA, 354 bp, Homo sapiens
aacaccatgttcaggtataatggttgagtgaaggctattacaaactcaaaactaattcatctggaaatgccatggttcgtttttgcagatatatcccttataccttcccatttggaaaaagaaaaaaggaaacctaccacaggaacaacaaaaactggaatttgtttggctagcagtcagtaagccacattcatttctgaggacgtagaggccgttcagtcctctcagggacatccgccatgataaacagcagtgcttggtcccagcaccttgggaggccgaggcgagaggattgcctgagcccaagagtttgagaccagcctgagcaacatggcgagacccccgtctctattt

SEQ ID NO: 167503 - DNA, 557 bp, Homo sapiens
acacagcaagactctaatagacacacagacagataaattttaaagtttccattaaaaataagaactattggcagggcgcggtggctcacgcctataatgccagcactttgggaggccaaggtgggcggatcatgaggtcaggagatcgagaccatcctggctaacatggtgaaaccccatctctactgaaaatacaaaaaaattagctgggcgtggtggtgggtgcctgtagtcccagctactcgggaggctgaggcaggagaatggcgtgaacccaggaggtggagcttgcagtgagccgaggtcgtgccactgtgctccagcctgggcaacagagtgagactccgtctcaaaaaaaataaataaaaataagaactatcagttacttgagaatttctataagaaccttttaatgttggtattacctagtgaacctcactaaatccattaattttcactaatccaattccttatgaacacagaagtttctactgagcaaatattagcacttaacatgtgaactgtctatcaacggtgtttttaaaagatttacaggc

SEQ ID NO: 167504 - DNA, 361 bp, Homo sapiens
ggaatcttctaaatgtatgtcaacccactactgaatcatgacctgcagtctgaaaaataatgctcttacaaaagggtgattagattcacatgatgatgccgctagaggaatggttacaggcatcagcaaatacttaggcatgatgagaccctcccatcctcaccccacaaaaaaaagtcacaccttctctctgcatataagagatgtagagaggtggccaggcacactggctcatgcctgtaatcccagcactttgggaggccaaggcaggtggatcacctgaggtcaggagttcgagaccagcctggccaacatggtgaaaccccgattctactaaaaatacaaaaattagccgggcatg

SEQ ID NO: 167505 - DNA, 111 bp, Homo sapiens
tatttagtatacacaaagcattcagtatttagaatttctccactggatggacgggaaaagcattcactaaaatcgggaacatagaagaagaggcaggtccaggagcaggga

SEQ ID NO: 167506 - DNA, 200 bp, Homo sapiens
gtagagacaggggtgtcactatattgcccaggctggtcttgaactcttggtctcaagcaatcctcctaccttggcctcccaaagtgctgggattacaggcgtgagtcactgtgcccagcctacttcagtttttcatgctgttaaaccccatctattgagtttataatgtcagtgatttttcagttatagaatttcaactt

SEQ ID NO: 167507 - DNA, 580 bp, Homo sapiens
attcttatgttctactcactgatctcactcaacttcttatgctttccaaactcatggggatttttcaggctgtaagggtccccatccccttctctgccgcctcatcaaatgtatcatttctattttagagtcatttaatgccataccattatggtccagcacttaataatttatcctgaatctcaacaacttgctctttcttgctctgtgaatcttttaaaatcctccatttaactactaaatactgtttgagaagatcacacaatcatgtgagtttatgccatttctagtttgtgacttctcatatcagttgagcccttcatactggttaattcttttttcttgtacatggtcacatctttttccaactcctatcttatttttcccactgagtgctgcctccttgaaactctttcctccttacctttgttcacaccacaatttcctaatttttgttttatccctatgatcatcctaagctaaaacttgaaaatcatgtctgtttcttctctgtcaccactctacaaatcaaaatgtttgtagcttctgcaaatctttcagatatgtcttttcattatcg

SEQ ID NO: 167508 - DNA, 499 bp, Homo sapiens
  misc_feature (37)..(38): n is a, c, g, or t
ggcagagcagctgcgaaggcaggagggcggcgccgcnnaggcccagatgcgccaggaaattgagaggctgactgagcgactagaagaaaaagagagggagatgcagcagctgctgagccagccccaacacgagcgagagaaggaagtcgtcctgctacggaggagcatggcagaaggggagcgcgcccgggccgccagtgacgtcctgtgccgctccttggccaacgagacccatcagctgcggaggacgctgaccgccaccgcccacatgtgtcagcatctggccaagtgtctggatgaacgacagcatgcacaaaggaatgtgggggagagaagtcctgaccagtcggaacacacagatgggcacacctctgtccagagtgttattgagaagttgcaggaagaaaatcgactgttaaaacagaaggtgactcacgttgaagacctcaatgccaagtggcagcgctacaacgccagcagggacgaatacgtgaggggg

SEQ ID NO: 167509 - DNA, 303 bp, Homo sapiens
acttcagtgagccaagaggaacaagaagtttaaccctgaatagccaaagagtgaagataatgggacattaagggaacaggaaaacagagcagcccaagacagaaaagacttcttgatctccatccaaacggactcataatggacctaaaagtgatttgaggtgaaaagccaggaactgtattacgtcattctctagattttgtgtgtgcatttgatcaatccaggactttctagtaatggacttccaaaaattaaaaatacgtcaaagtggttacattatgtatcttggaatagatagtgaaa

SEQ ID NO: 167510 - DNA, 292 bp, Homo sapiens
gctagggcagagactactattggcaggtgattatattaacatagtgtgattgtgcagctactgtgaatagcaaacaagaggaagagaagtaggaaggttatgatgatgatgatgatggcgacagcaggatgtagttcgtgactgcatattacgtgtcatacaggggtcaaaatcagtcaggggttttcaacctcagcaccattgatattttgggccagataactctgttgctggggactgtcctgtgcattgtaattgttgctaagtgtccctggtctctacccattagaca

SEQ ID NO: 167511 - DNA, 323 bp, Homo sapiens
tattcagtaaggctgggtccttctaaacctgctgagagctttgtctcaggctctgcttcctagtcccggtgcacagggacagattgagtcagtggggagcggtcacctctagacggtgctgttttttaaaatattaaacctacaaacaggtttccttctgatgttgctagtaacagtgctgtcaacttcttaactcccacctacccaatgctctatagcatccctggtttagtatacatccacctgcatgccactcatttttgtggacattaagagtttggggttttgttgtttgcttttacaaaaacaagatcattcactta

SEQ ID NO: 167512 - DNA, 233 bp, Homo sapiens
ggttaagagcctttgttgtcactttagagtgaggtgtagtgagctaaaacccaagaaagtaatctgttcctaaccaattccaggaatgtaatttgatgtgttggaaagaatgttgactttgctgtcaatttttgacttgtactactcaccaactatgagttcaatggtgatagaacctttctaagctgcaaatgaaggaaatatttttgcttctcactagtcaggatgctact

SEQ ID NO: 167513 - DNA, 304 bp, Homo sapiens
gtcccttgaatcatacatccaaaccccaaattaactcctttcaacatttattaaagctgctttcttcttgatcaattcagaagagttatcatgttgaaaagtacaaagctgcactgagattcagacaatggcatgtatcacgcttgctctagcagatcactgatctttgtgggaccgcttgtaaactgcacatgctgaggaggcaacatcaagtatgaggggactcttgaaccgtttgtactagtgattatcttttccccatgtctttctgtctctttacttacactgttattggagctacacc

SEQ ID NO: 167514 - DNA, 310 bp, Homo sapiens
taagccctccctgccctaattcccagcacaccttttctaaatgtcaacctactttactattaaaaatcagcaaaagttaattgaaatttttaaattgactggttgcagattataaaaatattcctttttaaactatctgtggtgaaggactagtttttttttttccaattcatcatcaaccaagacgtggtcctacagtgcctgctttgggccacttgtgacctaccctgtgagtgaccaagctcatctatgtcctgttcagtgaggcaggattaattgagaacacacttggatgttgcagcacaaccac

SEQ ID NO: 167515 - DNA, 130 bp, Homo sapiens
tatcagctagttattctaaacatcccatgccaattacctaattcctttattaatgaacttaatttggtggaaagagtcttcttagagtctttcttactgctctctagctcctgcatgctgtatccaagtc

SEQ ID NO: 167516 - DNA, 191 bp, Homo sapiens
gagttgtatttgctgggttttcccatctgattaacagtgaatagcagaaatgtgctcttttacctcatcttcccttttctggcctgctttgaggctctcttggtaaaatgtctggcctaagacaggacgttttttgtgggctggtccagaccccatctttgcctcactttcctgcatggtgagttcagatc

SEQ ID NO: 167517 - DNA, 328 bp, Homo sapiens
cggtccccatgctctttgtcacagtacgaggggcagaactgaagtctcatgtagaagtcattacactgccttttcccattaggccaccagtaccatggccatgggtttccttacctcactctattcatgctacctttgaaaaaaattgttttcctgaccatcttgtttcatacatttatatgtccccaaatccctttgctctgctcagtccaaaataccttcagtctttccaactccctgggccttctttctctcctgcatataaatggctagcagctgttttcactgacctatgaccttatgatgcgtcccactttgttgttattct

SEQ ID NO: 167518 - DNA, 317 bp, Homo sapiens
gacacacagtggggacatgccaattaaccagacatgcacatcttggggatgtgagaggaagcaggagttcctggagaaaacccatgcaggcatggggagaacatgcggaccctacacagacggtagccctgtccaggaatcgatatttattctcatctacattatagcaaaacaacattgaacagaacaactttatctgaggacctgttttacttgtacatctttgggaaaatcttttaacttttattactcataatgttcttctcaataaaagtgtgttaagaatacatatttcaggaggttttttgagacaatca

SEQ ID NO: 167519 - DNA, 276 bp, Homo sapiens
tgaggtataagtgaaaggacagacattgtgtttgagtaaactcctagaagtccaaactttttttctgaatatctgagtcatcactttaaagttgggtacatatatgacttgtttactgaattaataaagtatatagctcctagtttttacaacttaaaggaaacaaaacattttcatccaaaaacactggctacatctagtgggttgtttcaaggtgttagggtaaggttttttaattaaatgattagactgtgcaggttttaaagtctgtgcttg

SEQ ID NO: 167520 - DNA, 815 bp, Homo sapiens
cacattcaatatccaacaaatagagtaataaacgtttgttgctagtgttattgatattgtggatcattttacaaggatatattaatgatattattgttatatgtgaaagtttacagttgacagatgttttctttatatattaatgtgatatgaattttcacatttctgtcaaatagaagatggctgttattatcctcacttttttataggggctatgcagttttattgtggagaaagagttaggaaacattcaaaacagaactcaaatttgtgtatattatacatataaacttaatgtactttttattatgtcctgttggaagaaagagaaaagaatgcaaattccaaacatgtaaagagcaattgatgtgttttgggtttggatttcctaaaattaaccctcaaattcttctcatttctttttactgtagttaaagtgaggttagtaaagaaatgttacttattttatggaattattgaaaaaaaagatgagattcttacagatttttatgtacaaactatgacagtttctcttgggggtattcaaaataatgctgaataggctattaaatattgcttaactaatgtatacataggtttcagttcatcttgtagatgtatactttacatgatgcctgatacacatggctaagaaaagcattcacaaaatcagtgtttcatctcctacttggaaaagaagtgaatccctatgctcccatttaaaattttttattaatttatggttttgtgacttgaattataagtgatattagatgaacatagtatctttaatgtttggtttggcaagattatta

SEQ ID NO: 167521 - DNA, 355 bp, Homo sapiens
catcaatccactttgtagtttgctggaatgagttaacatttgtgatatcgtaaactactacagctgcagcagaatcacggatgtacctgggaatgaggctacggagacgttcctgacccgccgtatcccacagccgaagcccgattgttccatcctccaagaacaccagcttgaatttcctcagcggattcccgaagtctccgcccgcggacatggtggaactagaggagctgtcgccgcctcagcccagagacctcccggaccgatgctgctccagccggctgacgaaaaaggcgagcggaagggcgggcgccgagctctctgcgcccctgcaagggccggtggaggagcccgg

SEQ ID NO: 167522 - DNA, 853 bp, Homo sapiens
tcacacctgtaatcccagcactttgggaggctgaggcaggcggatcatctgaagtcaggattcgagaccagcctgggcaacatggcgaaatcccatctctacaaaaaatacaaaaagtagtcggcattgtggcatgtgcctgtagtgccagctacttgggaggctgagatgggagaatcgcttgagcccaggagtttgaggctgcagtgagctgagatcatgccactgcactccatcctgggtgacagagcaagaccctgtctcaaaaaaaaaaacaaaaaacaaaaaaccctcaaaatttagcagcttaaaacaacaatcattatctcttacaattctgataattgaatgagctcagctgagcagttcttcatatgctatattatttaattaatctgagggattaattaaaaggtccaagatggctaacttgtatgaccattagctggtactatcaggtgggatctcagctggggtggccagttgcagcgccctgattctcctccatgtggcttgagctttctttagcttagtgggattctaagaatgaacatctcaagagtgttaccagggggaaggaagtagaaactgctagtcctcctaagtgctgggctcagaagtcccaaaacagctcctccatcacattctattggtcagagcaattgcagggccagtccagattcaaggggagaagatataagcatatagaatggggataaatgttggaaaccatctttggagactagctaccacacctgtctgcacaggttcttccctgctttgaaatgctcttttcctgtcaaacctttgttcatactgcaagatgcagcttataattcagtacccatgtaga

SEQ ID NO: 167523 - DNA, 434 bp, Homo sapiens
ttaagcctctgttgttgctcctcaggttgtcatgactgggtatgcccagtctccttgggatgacagtgtttttttctaggcccagcttactctattcacgaccatgtctagctgttgatctccagtaattgccagctctactgttttcaacaatgttctgagtcataaattgctctacaagctaattctatcatattgtgactcctttgaagaaaaggtttcacatttgttctaatcccaggagaggtcctgtgagctgtcttattccctggttctcctgcaaactagctggtctacagtttatacagatgttgaatctcttcagttgctttttaccacaacctctagtggtatgtcctgagatttgaaattatctgtgctgtgttacaaatgaagtccctttgttttggaagacattaggggttatttcatct

SEQ ID NO: 167524 - DNA, 429 bp, Homo sapiens
ctacacacacagtcccagtgttgcgctgttgctgtcacaggccaccctttgtagagcagtggcgggcttcccccaccagtcatttccagagatgcttttctccccacttcaaatctctgtgctgcagactgtgatatcctgtgttctaggaagacattaaatcacactctggcagggaatgggtggagaggtgggactgtccctccacctactaaatgcaggcggtggtggggaaggcgactgtcacctttcccgcggttttgctgatcctccagaccccgccccgggggtgggggcgggggtgggggtaatgcgggctgagtggaagctagccccgcccctggggttctctgggaaggcaaatcctcacccgcgctggccttccccttcgcagtgtcatggtgtttgatctcatcccctgctggcttt

SEQ ID NO: 167525 - DNA, 125 bp, Homo sapiens
cacttccctgctactttcctggaagcggttcttaactttgaagacttacctatctggacagttaaaagtattgctaaggatactcccttttccttgttaaacagtggggaagccttgaagcatgt

SEQ ID NO: 167526 - DNA, 152 bp, Homo sapiens
ttaatcctgaagctgtgttgcctctgcagtattcggttaagagttctgctgcctgagttggcatccctgctttgtgaagttattgtgtgtcggctgggcacggtgtctcatgcctgtaatcccagcactttgggaggccgaggagggtggat

SEQ ID NO: 167527 - DNA, 439 bp, Homo sapiens
tacctggggggcctcccccgactctcagcccggctcaggctgtttctggcttgacgatgatgtgagtgtccagccgtaaattctccagcacaaaagatatttcccttgggaaacctagaggaacgtgcttttgtttttgtaagacccgctggggcttgaaccacagacatttggagttgggtgccgagctctgcctgggcctcacgggtgcatccgacaccaaccctgggaggctgggctgctgctttcactctgatgtgaagctaaacctctctgtgcctcagtttcctcatccataaagggagggcaacagcagcgtccaccccaaggacggatgactgagtgcgcatgctggcctccacccaggcctgtgcagggggcgccccggaggagaggagcgtggcctggggtctggtgcagtcaagtccacactgagaag

SEQ ID NO: 167528 - DNA, 392 bp, Homo sapiens
caaaatatgtacaactatgaacataaataaaacaggccaggctcggtggctcacatctgtaatcccagcacttggagtggccaaggcggggggattgctggaggccaggagctcaagaccagcctgggcaacatgccgaccctaggcatggtgccacgcacctgtagtcccagctactcaggagggtgaagtgggaggatcgcctgagcccaggagttggaggctgcagtgagctgtgatcgcacaactgcactccagactgggcgacagagtgggagaccctgtctcaaaacaaaaaacaatggctcatatctataatcccagcactttggaagaccgaagcaggaggattgcttgagcccaggaattttgagaccagcctgggcaacatg

SEQ ID NO: 167529 - DNA, 347 bp, Homo sapiens
agcctggaggtgaacttggttcaactaagatcacatatgtgttgttacatttccaatccatttctgttttttctactgtgacccacaaaatttattcaatttgtacttaattaaactaaaaagtttcagcacagcaaaagaaacaatcagcagagtaaacagacaatgcacagagtgggagaaaatcttcacaatctatacatctgacaaaggactaagatccaaaatctacaacgaactcaaacaaattagcaagaaaaaaacaaacagtcccatcaaaaagtgggctaaggacatgaacagacaattctcaaaagaagctatacaaatgtctaacaaacatatga

SEQ ID NO: 167530 - DNA, 147 bp, Homo sapiens
ggagtaaccgtacattttaaaccaaaaaataccttatatataacatgaaatatattcaattccacaaagaaaagaaaaaaaattagaaaatgagcaaagaacatgaagaagcaattcaaaaaagctgaatagtgagtggatgacgag

SEQ ID NO: 167531 - DNA, 282 bp, Homo sapiens
gactggcatttgagaaaaccaccacactaaggctttttagaaccaaggaaataatagagttttcaccactgaactcatccagaagcaaagtcacaacctcaagaaaaaaaactcctgtcctagtgaaaataaatttaataatagcaagaagcagatgtgtctctggatgtgcagaaataagcataaagttacaggaagcatgaaaaagtaaggtattataacaccccctcaaaggaacataggaattccttagcaacagattctaaccaaaaatgataattg

SEQ ID NO: 167532 - DNA, 535 bp, Homo sapiens
aaggcctgatttacctgaccctcccaggtcaagggatggctgggttgagggtggactgtgcgaggcctggcggagctgtagcccacacaggtccaggtggtcgggaggccactcatggccagacgcttccggtgcaggaggccttgctcttgtgttgaggggacaccaggatgaggtcagagagtgcactggggttcagggaggagaagaatcctgagagatggcacatgtgcaacacaggtcaccgtcgccatcgcccgggcccaccgcaagcatcactaatccatccctgcactcctggaaagccgggtcagcctctgccggctgagctgagtggaccaccaggcgcttcctggttgtcctctgtgtgctgttttcctctgtgtgctcttgtcctgggctggaccacacctgaatattccagccaccaaagtgctcagcaggagctgctgtgtaggagtcccccatgaggcccaagcacctgagcttagtgacatacacggttgacctgggagaatgctgggagcctgctgtt

SEQ ID NO: 167533 - DNA, 476 bp, Homo sapiens
gacttagaaaagatcaccatagtcacaagtcattatcaatttaaaggaattggaagaaacatatatttgttctgagttcctatccctgaattctaagagattcagctccttgcatttgagcatctcctacactgggcctgccctgtttaggtgggcctaaaactttgtagaatcaccttacatgtgcttacctggattggtaaagatcctctatacccatctgaaccatactggcctctcgggatgggaggtgggatagggtgtcaggctaacagccattcacctcactgaatcttttccatgttgacccaggtgtcctacaacctaccagccatgggaattgctgccattttccaatctcctcacacaaaatgagcaccatggaaacctgaagcttcaggaggggagagaagtctcagttcaaggcaacaagggagttgtaggcatctaaaccagatctgtctaggaatgcttag

SEQ ID NO: 167534 - DNA, 484 bp, Homo sapiens
agccagcaaactcaattaattgaagctatacagagaaaagttaatgggagggctatctgggattcttatcctactatcaagcacttcaaagcactgagcttggggctaccaggcttgctttcctaggaactagtcctgtgatctttcaccatttaacctttttgtacttcatttctataatttggaaaatgatgatcatatccttctctaactgataaattgtttgaaattcaaatgaggtaacacatgtaaaaggatgctataaactttacaatgccatacaaatgtaaaatgtcactgttttctaccacttaactcatgattttcttaaaaggtcttaagagcagtttcttatttgattcataaattttgaacaaacatttgaataaagttaaaaagtatatacatatttaagcttgaatattttacatttaattttattagcagtatacaatatttaccatttattaggtaaaaggaatta

SEQ ID NO: 167535 - DNA, 272 bp, Homo sapiens
tcttttcaagtttttaatctgtgtgacttaaactgatgaactgtggtgttcacctcatgaagaatttatattttctccagaatgttttacttgtttattccaaatttgtacttgagctcataatcccacatgtgtaaacttcagtgtgcctaggatgcttaagacgcttcttgaaggattcacatgaaacttgacagtgattatgttgacagttttagagagattttaaaaatatcttttaaattatacttatgtatctattttgtgatatt

SEQ ID NO: 167536 - DNA, 479 bp, Homo sapiens
gcatgcagtcctggcttgactaaaaaggccagtaggggccttaagacatattcagaaagttccctgccccagagggccgccgccaaacctgaagggtagtgacaggtggccatactaccatgtgatggttgccccaggctgggcctggagagctgcagatcattgactctgaagatggaaggctccatgaggctgtgggaagggcccgcgcgtttctggggaagggaattgcagatggcaaggctggtgatgcttgtggggcgggccctgagtgccatcgaggcgcctggaccttctcccgggggcagccgcggcctgaacgtgtgggggcgggctcgcggaaaggctggcctcgactgggtggggctccggcgttggcgcatccgcctccggccgccagggggcgccgccgcccgtgctctgccctgcctggctggtcacagaggctgacgtcagcgggtcccgcggaggccgctgga

SEQ ID NO: 167537 - DNA, 519 bp, Homo sapiens
acccgcagcacatttcctcacacataggtaggtgctcaatgagtgcttattacactgagcagggactttgtgatgcaaatgactgtatccccaatacctagcacagagtggtacccagcaaatatttgacaaataaaaactataaggaatattaacatttaaggtgtagacaggataggaatccagccaagaaattaagaagcagtggctagagtggttggggggatggtgtagagaaaaagaacatggataagttcaaattggtttcgtgccttatttgactaaaggcgagtttcttgcattcattcattcattcattcattcattcattcattcattcattcagagacggggtctcgctctttccccaaggctggagtgcagtgacgcgatcgcggctgactgcaaccttcatctcccgagttcaagtgattctctcacctctgcgtccccagtggctgggatttacatgcaggcgcaagcacacccaggtaattttagtatagttggtagagacgg

SEQ ID NO: 167538 - DNA, 240 bp, Homo sapiens
acccgcagcacatttcctcacacataggtaggtgctcaatgagtgcttattacactgagcagggactttgtgatgcaaatgactgtatccccaatacctagcacagagtggtacccagcaaatatttgacaaataaatgtgtatttgaataaagtggaaaaatgttaactgccatgggaaatgtcggagacgggtgttccagatcatgatttctctcaagagcattcacccggtcaccat

SEQ ID NO: 167539 - DNA, 157 bp, Homo sapiens
ggtcaacacacagacacacacacacacacacatagatatatataaaaaaaatagcaacagttttccgaaacatgtttcagagagcttttggcttctgttgctctctgtccatcaccagtctccagcaggacccgcctgctctccaccctatcttcgt

SEQ ID NO: 167540 - DNA, 358 bp, Homo sapiens
cccctgagtctcagaggctacggttatattctgaaccagcagtgactaccccacagcctagtgcagcctgggcatgttaacaagcccaacaaaaggggtgtgggaatgattggaaggatgtccttcccactgacaaagtattcagcacatttttgagttggcttggcaattaggttagaggattcaacatgctcaataaagatactgaagaattaactaagggcccagaagaaacattgccccaggacaaattacaggttgtagccataaaaccttatgtatgtggcgagtgacttaagggatagccaggtttaaatcttgactgtgcctaacttctatcaggagctaacttgtcaat

SEQ ID NO: 167541 - DNA, 299 bp, Homo sapiens
tgtatgtatttctggcccactctaggaatagtcatctttatcattcagattaaaatgttttctcctgtatttaagtacccacagttactcaccaccctaagtcctgacaggcaggcacctgcctctcattcttgggatgttggagcattagacggggggacgatacaatttaatgtaatctttctggcataatcgccccacctaggctggaaggacagaagtgggactttatccaggtgcacagcagctacagcaaccagcacgtctgcttcatcactaactcagaagagagtgtggga

SEQ ID NO: 167542 - DNA, 244 bp, Homo sapiens
gggaagtaaatagcaaaacacatgtagatcttagactttgaaagactagcattgtttcaaaatcacctttatcagtgttaaaacctatagtgaatgtcaaatggttcactctagcaaaaatgttcaaaaatattttttggctgggcgtggtggctcacgcctataatcccagcactttgggaggccaaggagggaggatcacatgatccaggagtcctaggctagcctgggtaacaaagtgaaa

SEQ ID NO: 167543 - DNA, 548 bp, Homo sapiens
agactagctatagatcagtaaaggaggtaatagctgaaataaactgttgaagatttgtaggcaggtcgaagtgttattccaagtaaagagaagtctatgagcaagggacaaatcttcaatgatttagtgccttctgttatctacacatggttttatttggctgagtgtgatataataataaatatttggtctttttcccttgttcctggcatggagcccctaaagcctttggaatttactctctagtctgtgctaatcagatgagtggcgtgggtctgggtgttaggggaggagaggctgtgtagcttccacttcagggtgggtactctttaccactgtagttagagggtgagaactttcaaccccagtccagcatccggggagggaagaggggctgcagattgagcccaatcaccaatggccaatgatttaatcaattatactttaatgaaatctccagtgccgtgtgtgtgtgtgtgtgtgtgtgtgtgtatgttttttttttttttttttttttccttgagacagagtctcactctgttgcccag

SEQ ID NO: 167544 - DNA, 328 bp, Homo sapiens
caatgtttcttcatccccatgaaacattagcagagaaattatacccaaggtttcaacctggtcattgccgctccctgctatcactgtgcaaactatcattttcttctgaacgtttttccacacagaaaaaacatcattttttttctgaagttcttttcatgtagactgtggtctctgaaaatctaatgaaacctctgttttccttgttatattctcagtcctccattctttgcacatattttcaaaatttattcttgtcctctgtatctgtgaaaagtgaatagcccaataaactctgaggtttaggcattcttcttttttattgcat

SEQ ID NO: 167545 - DNA, 484 bp, Homo sapiens
tacctcccatacctccctcacaacctgcccacaaggaaattccttgtggacaaaggacagacaaaactcaaagtcatccctgtactcctgtgagacaaatgcatatctgatttcttcctctgccctattgtttcactaagccagactaaagcttaagtgactattcctctatcttcctctcacatgtaaattgtgtattcagtaaaaggctaatcagagactcaaaagaatgcaaccttttgtctcttatatacctatgacctggaagccccctcccctgctttgagctgtcccgtctttccagacccaaccaatgtacatcttatgcatattgactgatgtctcactgttacagcaggtagctagccagacatgagcagggaaggagaggatcccccacccccatgccaccaccaggaatgtcaggcaaccatcaggtgatggtcaggtgattattaaactgtctctctaaaataataattgg

SEQ ID NO: 167546 - DNA, 427 bp, Homo sapiens
catagcaagactcaatatttgctagtcgctattagtaatattattaccatcatcaccaccacctcctctccatcctgaaacactattaaagtgacagtaaaaacagtcaaaggaaatgagagcaaagacatcaatagacaagacatttccacaagacactggaagacaaacactggatgcaaagaaggtatcttgacttaacactgataacagaggcctgcaaggggtatacccatgacaagaactgattccccaccacaagctgcagaaaggctcagcacaaggaggcaccaggaggctactggaggatatactcaagcaaagtgagggagtaaagccagagagaggaagagaagggaatttgaaacagggaaagtagcaaagggaagtcccaagacaagcaaccaaaccagatcagaccaggagg

SEQ ID NO: 167547 - DNA, 420 bp, Homo sapiens
ctctgcctccatttaatttttaagagaaggtgaaggtaactattagaatataatatttgaagcagctctgccttcttagggctacccaaaacagttctaggtgctaaaattcagattttcagaggatgagaaatagctggtttccaactctccacaaaaactcttattactgttgggacttgggattctgacttaccccaaacccagaacatgaagaagacctttacagtttgtgctctactgttactaggctattaatttgagatcgtccactgtcaagtgttttactatctcactgctgtttttatgattcaggcttataacaaatattgtatcctttatttctgataagacatgaaaggttggccttactgttgaacaataagtaaatccacaggctcctgttgtaatctcatttct

SEQ ID NO: 167548 - DNA, 198 bp, Homo sapiens
tgggcatctaagtaggggaccaataatctcagcccaagaatgtaaggctgccaggaatcctttctctatgcttaactccatgattaattaaactcttttaaattatgccagaattaaccctgtcaatagaaatgttgcccacaggctttgttctcagccttttgaatttccctttgtccttttgtgtttgttttatga

SEQ ID NO: 167549 - DNA, 508 bp, Homo sapiens
tagaggatcccctcataatgtgtgcccagttttgagatcgaatgacttgaacttgctgagaataactagctagtttttctttttgttctcaaccatcttggatttaagtttcttcttagtaattgtatttaatcctcagattagaaggcataagacattagctaagaatggaaatcaaacaggagtagggttgtttctctttgttatttgttaatattacattaaccaccctatgggatgggggtgggcttcactcttcctttaacctataaaatgccatttattccacatctcttacttcgtcaagtcacagttcatcctgaggctttagccttattcactatattcttgtagctctatttcactcgttataatacttgttttatgtgcccaatttttaccatctgttgtaagtggttttttaacatctgaattccagaaagctctctgtgcagcgcatcagatttagatacgttccccttttcttcttcttatcagtgtattttgc

SEQ ID NO: 167550 - DNA, 131 bp, Homo sapiens
cctcagtcagtggcagagctggtacttgagcctgggtctgcttggttctaaagctcaagctcttgccattatatcagttccttcggggtactcgggtggggcctgtagacttttcagatgaagtcagcacc

SEQ ID NO: 167551 - DNA, 121 bp, Homo sapiens
gcggcaggcggaaaacttaggaagagctggatgcctcccacggagagcgtcccttccaagcggccccggagtggagtggagtggagtggataggggtagacttttcacacggggacaaatt

SEQ ID NO: 167552 - DNA, 383 bp, Homo sapiens
catttcatctttgggctcccagagtagagggtctgtcaccaaggacttagtcaattcataaagagatattgcaatctcaaaaaaaaaattgagattggttagtcttccagctagcaggacagactatttttttctgacaagatataccatgatgtaaataatgaacaatgtcttgggaaaaatgtgatttatcctttgaaactttgtgcccctttcctgcaaagtctgagagcaaaaataaaacaaaacttttcaaagagcttccttgttctctgagcaaagtaaaagagcaccacatgctgcaccataactgaacctcaagagaaatgtaattcctttaagtcttgatttaggactgagaaaaaataagaggggttatcaaa

SEQ ID NO: 167553 - DNA, 140 bp, Homo sapiens
ctgggattacaggggtgagccactgtgcccggccctaaagtccatcatttcattgctggccgacctctgcatacttttctcttgttactaagtaacttgccacccctaaaatcaccgttttgccccccggcctttgttcc

SEQ ID NO: 167554 - DNA, 530 bp, Homo sapiens
ttcagtagaaaggctgttggtatttttaagggaagctggaacagcaataaacatcaggccaaaggaccgaggagacaatgctaggagaggagtgcagtgcagggggatttcctgtcacacaagaatacttcagtcttccaggttcaatctcactcacttagctgtttaaggagaacctgccagatgccaggcgccattcaaggctctgggaataaagcaatgaacaaaatagacaaaaacccctctttcatggtgcttattcagtaggggaaggtatgttaaagattcttagtgtggcacagtagctcacgcctgtaatcctagcactttgggaggctgaggcaggcagatcacttgagctcaggagtttgaggctgcagtgagctatgattgcaccactgcactgctgcctgggctgagcaagaacctatctgaaaaaaggaaaaaaaaaaggaactcatttatggaaatcggaaagactctctcacattctcaagtaaattatcacctttattgaaccggatagcttg

SEQ ID NO: 167555 - DNA, 246 bp, Homo sapiens
ttcagtagaaaggctgttggtatttttaagggaagctggaacagcaataaacatcaggccaaaggaccgaggagacaatgctaggagaggagtgcagtgcagggggatttcctgtcacacaagaatacttcagtcttccaggttcaatctcactcacttgcttactgtgtgtcaggtactgttccaagcactttaactcatttagtcctcactacagtccttgaactgggtagtatcctcatccac

SEQ ID NO: 167556 - DNA, 416 bp, Homo sapiens
agccaagtaaagcagtgagagcagagagggaacagagcaatctgtaactggttgtgatcatttagttgtaaatacgaccacacttggactagccttttccagtttttaaaggctgccttcattccttggctcatggccccatcttccatctttcagactagtagtgtggcatcctccaatctctctccatctctgagctctgcttctgtccacatgtctccttcattctgactctcctgcctttgttttctaataaaatttttttattgagatgaagctcatataacataaattccatcattttaatgtatacaattcagtggtttttagtatgcgcacaatttgtgcaactatcatcattaattccagaacttcctccctcttataagaactttttttttaacttttcttctttc

SEQ ID NO: 167557 - DNA, 210 bp, Homo sapiens
ccagtggtgagtatggccgaggctccaccaccagcccccaggcaggtgcctgcagacagggtgctcacacagggcgtgaggcctggcttcccagtgagggcagcagcccagttactggggacgtcggccccgggcaggtcctgctggctggctcctcaggctacctggtgggctttaaattcctggaaagtcacggctctgacagcggct

SEQ ID NO: 167558 - DNA, 305 bp, Homo sapiens
ctcccagagaccattcctaatcttcaatttcagttatacttttgagacaaagtcattgctttttaatctctttctgaacttttgttcctgatgattgagcactaaaacacagagccttagggcatgactttgaagccatatggctgtgttctccattatctggcaacctggttttaggaatcatgtgacgtgaattatgtagagcatcagaacagtgcccaggacaaaggatgtccggcacgtggtggttcatatcatcattacacttggctgctgagctgatgtcttgcagaaaacctaaatga

SEQ ID NO: 167559 - DNA, 266 bp, Homo sapiens
cgctatatccccaacacttagagcaatgcttgttcacattggacgcccaatatgttgaatgattgaatggctgaatagacgagtgaatgaatgaatacacagagcgaatcagatgggaggtgagccaagcctattgtgtgtgtatggcgtgtgtgtagtgtgtgtgtagtgtgtgtattgtgtatgtagtgtgtagtgtgtgtagtgtgtatgtagtgtgtgtgttgtgtgtgtgtatagtgtgtgtgtattgtgtgtgttgtgtg

SEQ ID NO: 167560 - DNA, 132 bp, Homo sapiens
ccttccctccccagtggtcctcaccccaccaggcatctagagaaactcaatttccgaggctgtttgtccccatgcgggagtctggggctgagcccctgagagacccggagtggcgggacctgcctttctcac

SEQ ID NO: 167561 - DNA, 176 bp, Homo sapiens
ggaactggatgtgagaatggatgagggcagagggggaatttaacacagacaaacagaatgaaagacagagaggaattgcctgctaaagtatgcccgccctcagctcccacagcaatttacttactgctaactgaacacccaaggaccgtttgcatctttgcagattttcctaccag

SEQ ID NO: 167562 - DNA, 270 bp, Homo sapiens
aagagttaatcccttttagtactagccaataattgactgccatatttgtttgacatcattcagtctgaggaagaggaattagaagaaagtgagcacaatcgatgaacacagatcaactggtggatgtggtagaagatcatggagtatttccctaagccagtggtccccatgatttttggttatgcaccatcataaaaaaaattgcagacacaccccccaatgtgcctatattttaaaagatcatttaaaaatgcatatgctactgtacta

SEQ ID NO: 167563 - DNA, 393 bp, Homo sapiens
caagatgtcagcgtctgcctattccagttactagtcaagaaggtgtaattaggaaatccaaaaaaaccctgtttgaaatgctaggtattccaggacaacatcagaaaaatatcttccacaaagactttcatgtttcaaacataatacgccacaatattactttttaaatttcatattaacacatatcaagatacaaagacccaagctataaaaatagaatttccaagaaagctttaaattaaaaaccaggttttgcaatgaggtgctcttacattatatcactgaaatacccatcttgagcctgtgtctgacacaaggctcaaaatgggaggatggtctgagcccaggagttcaggaccagcctgggtgacatagtgagaccctgtctgtacc

SEQ ID NO: 167564 - DNA, 447 bp, Homo sapiens
tgttacgaagaggaactaactaactaaagaaagaaagaaagctgatttcaaactgaggctcctttatttattagcattatgtcttttgtcaagtttattaacatcttcagtataaatgagggcaataagtttatttcataggaatgtcatgaggatcaaactaagtaaagcagataatgtacttagcacagtgctgggtacatagttagccccatatctgtggttaatgactaaacctggaaatcaatgccgggcatggtcgctcatgcctgtaatcacacttttggaggccagggcagggtgatcgcttgagcccaggagttcaaggctgcagtgagccatgatcatgccattgcattccagcttgggtgacagaatgagactccaaatctaaaaaatttaaaataaaaatagaactgtaaatcagtgaggaactaaactaaaaag

SEQ ID NO: 167565 - DNA, 125 bp, Homo sapiens
tgctgggattacaggcataagccaccatgccaggcctctctttcaagtcttatattttctttcttgccgccacctacattctgtcctgcctccaccttctaaattgtcacctgttcttttatatt

SEQ ID NO: 167566 - DNA, 1008 bp, Homo sapiens
ctgcttcctcccttatttcgcatgtcctgcttctgccatttgacacgttttgcttctgcttaagctaacctatgtccaacggtccccttcgccccccgaatttctctgctattctcctgcctcaagatgtccgtgagtctggttcacgcctgtggtattgggggtggcctgaaggtgaaggtttcctgtcctgttctgctccaggtctcaggtacagagggaagggtccagggtcccttggcaagaggccgaagggagaagacccctgggtctctggaggatgggaagggaaggattggctctgagggccgggaaggggcccgccgccacgtggctggggtatgacctttgctaccttgatacacactttatcgtgtgtattcacatctggtagctcttatttcaaaatttgcattccacagtccaggggccaagagcaacatccgccggccagctctgtcccactcaggccggccagcaatgcacagggcggccgcctgcaggctgcggcctcgggactgtccaccagggggcgcccacccggccggtgctgggcggcccggctcaaggggtgcggcccgagaacttggggccctctcctgtctcctgtcattgagaacaatcaaccacagcagggagctggcttcatggggtctttgttgaggacctgcacttccaggtgctggaaggtcttccccagcctcctctcccctatcccagcccttgaaattctgtgtgtgttgggggtggatttagtcattcaacaaacatttattgagcaccttgctttactgagcagtggaggaggtgaagtcagagaagccgagggggcgcggggagcagacctgccgggctttgtgagccaggcaagggttgggctatgagggtaagcatgatggagaaccatagagggtttggggcagggtctaacccaaccttctttgcaggccttgctacagctggaatgtggagaccccaccctccaatccccctacaatctggatgggg

SEQ ID NO: 167567 - DNA, 390 bp, Homo sapiens
aagagacagggtctcctgtcgcccagactggtgcagagctcactgcagcctcaaaaactcctggattcaagtgatcctcccacctcagcctccagagcagctagagcctagctaaaaaattttttaaaaacattttatggccaggcacggtggctcatgcctataatcccagcattttgggaggctgaggcaggtgaatcacgaggtcaggagttcaagaccagcctggccaagatggtgaaaccccgtctctactaaaaatacaaaaaattggccaggcttagtggcagacggctgtgatcccagctactcgggagaccgaggcagagaattgcttgaacctgggaggtggaagttgtggtgagccgagattgagccactgcactccag

SEQ ID NO: 167568 - DNA, 455 bp, Homo sapiens
ttaggattttagttcatttttgagttaatttttctgtatggttttgaggtagggctctagaggctttttatctttggatccacaaaacaatcaaacttatttcctattggttatttttgtgattgttttttaaatttccaatattgagagtataaaattgtggatctgagcctatccttagctgctcatgagtagatttttattatttactttatgattgatttatgtatgagacagggtctctctctgtctcccaggctggggtgcagtggtgtgatcatggctcactgcaaccttgagctcctgggctcaagcagttcccccacctcagcctcctgagtagctgggactacaggtatacacgaccatgcctggctaaatttttaggcagagttgtatagatgcttgccgattacactaataactgcagtaaccagaatgtagcaagcaatctg

SEQ ID NO: 167569 - DNA, 375 bp, Homo sapiens
tgggcaacatgacgaaaccctgtctctacaaaaaatattaaaaagttagccaggcatgatggtgtgtgcctgtagtcccagttactcaggacggattgattgagcctgagaggttgaggctgcagtgagcagtgatctcatcactacacttcaacctgggtgacagaacaaaccccatctcaagaaaaaaaaattctattttgtgttcattcctctttctgtatttctactgcagctacccctttccaggcagatgtccacaacagtcatatgtttaacaaatattgtctatagactatatgccaaatcctgtttagacttcttgtagactcttttcgcttttagtatttgttgcatatcactgtgatataactt

SEQ ID NO: 167570 - DNA, 566 bp, Homo sapiens
gacagccaaaccaaatcattccagtgctggtccctctcaaatctcatgtcctttgcacatttcaaaaggcaatcatgccttcccaacagttccccaaagtcttaactcattctagcattaacacaaaagttcacatccaaaatctcatctaagacaaggcaagtcccttccacttaggaacctgtaaactcaaaaacaagttagttacttacaagatacaatggggatatacaggcattgggtaaatgttcccattacaaatgagagaaattggccaaaactaaggggacacaggtcccatgcaaatccgaaacccagtgaggcagtcattaaatcttaaagctccaaaatgatctccacctaataaataaataaacaccaaaataatacgccctgagcactgtttatagacgtatgtgcctctagttttcaatatatgttgaagctattataaataataaaatacatattactgttacagaatatagaatgcattagagatttcttcagtattgcatgtatatcaacatatattaactgtataatttatattacatgggtgttgg

SEQ ID NO: 167571 - DNA, 146 bp, Homo sapiens
gtcttaggacctcggtatcagcagagaagaaatacaggaagggttaatacatcccagttggccaaacctgcagaagcagtcaccccctcccagtgtaccttgtagtttgaccatggcacttcacacacttctctgctggatacctt

SEQ ID NO: 167572 - DNA, 325 bp, Homo sapiens
caatggaatattattcagccataaaaaagaatgaaatcatgtaatttacagcagcatgaatggaactggaggccattatattaagtgaaataagccaggcacagaaagacaaatgttgcatgttcacgttcatatatgtgagctaaaaaaatacatctcatgaagattgagaatagagtgatggttaccagaagccagaaatgatagaaggaggatggaaggaaaaaagaatatagctatacttattaccactgaactgtatgcttaagaataataaagacagtaaattttatatgcatattttgtctaaataaaaaaattaaaa

SEQ ID NO: 167573 - DNA, 212 bp, Homo sapiens
tgcaataatcgtcccaatcctgtggctcccaagggttttctggatccagtgcaaactcctgaatgtggccactaaacacttcaactggctcaccctgttttccttgccagctccatctggtttcctccatcttgtgtggcaagatactgtgtccccacccttgtttaagaggtagtgcctgtccctcatcaacctccttccactcatgccag

SEQ ID NO: 167574 - DNA, 615 bp, Homo sapiens
cccatgttgatttttctaattcaggaatttctaaatattaatggttagctgtgatgtaaatgtaaacagcagagagatattttaaggccgaagagcagtcttattcaatatagatgcctaccataggattttacctaatagagagcttcttcttctcccagctctaggttgaggagcatgaaacacacactgaaactccggcatggcaggacttaatccacagaacaaggatttcatcccatcacttatctctaagctccacaaggaggtttggtacaaagcaattaaatcatccttcaggccacccagctcccaatgtgggttttctcccaaacagctacgctcatttcagttattaaatgtgacagtggctttaagtacattgtcccagaagtcctaaacaggaagaatactgtaacctctcgtttaagagatcatgaaccctgtactgactgtgacgacaatcacgaaagtaagcaaagagaagttctgagcagtcaccatcccttcacaaatcaaagcactaaagctcacacccagaacctcaagaccatctaagaccatttccccacaatgctaactaggggacacttcaatagataagattagaagcat

SEQ ID NO: 167575 - DNA, 268 bp, Homo sapiens
attttttctaaggccagtctggtgacaatgaattctctcagttcttgcttgtctaaaaaggatagctttgctgggtttaatattctaatattcttggctgacgggttttttttttctttcagaactttcaataggtaattccattctatcctggcctgtaaggtttctgctgaaaaatccacagttagtccactagcaattcccttatatgtgacttgacactactctttgctgtttttagaattctctttgacttttgacaatttgg

SEQ ID NO: 167576 - DNA, 400 bp, Homo sapiens
caactacagtgggcacctcacaggtttttctacctctattcttgctcccatcctcaatatattatccatggagttgtcagagggaccttttaaaattacaaatcaaagcaagttcctgtcctgcttaaaattctccaatggcttaccatcacatttgcaatgaatccaaatgccttttcctgtatcaaaaagcccctacttttctgacctcatctcttgctactttccctattactttctatgttctggccacttgaacctccttcctggtcctacaatacagcaagatgttcctactttagggactccacattcattacttcttctgctcttccccaccacctttatgacaggcttagtcattcagatctcaactttaaagtcacctcctcacagaagc

SEQ ID NO: 167577 - DNA, 479 bp, Homo sapiens
ctgatggcccttaaagcaactgccttgtaaagtggcctctgtccagagccatgcttcatagatgctgaggttcagtgatggttgtccctgtcacaactgcccagttgtgcatactgaccctagctgagacagccgtttctgactcctctctctctcttctcccatttcctattccaagcttcaggtgaaccagtcattaacaatctcagcctattaacatgctctggtggccataatcgcactgtaaaggaagggaggtggtaatgacagcttccacatcacacatcacacatcacgaaatgcttttatacattagccccttggaaccgcaaatgactcccccaacaatagacagaagttattatttctattttattcatgcgatagataacgcagcaaaataggtgaatggctgaatggcttggtgtattactcaagactcattttgcaagtaacagaaacccaaatccttttagctc

SEQ ID NO: 167578 - DNA, 398 bp, Homo sapiens
ctgtctaatgaattcctgaaacagcataaaagccctgtgtcttgtagttacagggatggccttgtgggtggatgttgctggttgaagaaatattagttaatatcacacaagcctgttattaaatgttagaggcagctttgcaaatgtccccaggccctggtacccacaggggatgagcaggtaccaagggtgccacccttcatttacaggaactggaaggagggaagacagagccgatgtccactggcactagcatgaacatggcagctaaacattggcacaagtcttcatggctctatctcaagcacctaagaggaaattaaagccccctaaaataaaattaagggacctagaataagggtgacaccaaacataatgctatttgttgttttccccaa

SEQ ID NO: 167579 - DNA, 246 bp, Homo sapiens
ggctgcaccagactgatattcttcagaggtagagagaaatgctagacagatggggagaagccacagaaagccagtatgagtgggcagagaaaagacaaagataggtgacacattttgtgaaaaaattgccccaaattacatttatgattcatccatttaccagctttcctagaaccctgaacaccaaaaaagtgcaatgcatggtgttaggattccagtattggggagagaaggacaggtaagaag

SEQ ID NO: 167580 - DNA, 183 bp, Homo sapiens
cctaaaaggcagaaggcccagcaagagaagaaggctttctcacttcttgtgatctaaggctcacctccccagacttcattacctgtccaggatcaattgttccagggtgctggacaatgggagcatccaggcccttccaaggtgtgtttgacctccatgactaggtcagatccccattaggag

SEQ ID NO: 167581 - DNA, 441 bp, Homo sapiens
gcctcccaggttcaagcaattctcctgcctcagcctcccgagtagctgggattacaggcgcccaccaccacctctggctaagttttgtacttttagtagagacagggtttcaccatgttggccaggctggtctcaacctcctaacctcaggtgatccgcttgccttggcctcccaaggtgttgggattacaggtgtgagtcaccatgcttggccagctcagggatttttatggaggattcgttacgtatgcaggattgactaaatcactggtcattggtgataaactcaacttttagccctccaaacacattgttggttcccctggtaaccagccctcatcccgagggactgtccaggaacccactaagagtcacctcattagaacaaaaaatgctcctaccacccaggaaatcccaagggatttaggagccctgtctcag

SEQ ID NO: 167582 - DNA, 284 bp, Homo sapiens
aatattttccccagcttctgggaaactcaaggctaaattctatgctcattgcttggcccttcctttatggttggtttcctttcacttgcaccttatttctctttctcattttgatgacttcattgcacctgatactttattctaagggagctggaacctattctggaagtaagaatgatatataaatcaagcatgaatacaactttcatttggctgaaaagaaaagcctttttatactttggaaagtcaatgtcttaagctagtgctcagtctctggaggaatc

SEQ ID NO: 167583 - DNA, 298 bp, Homo sapiens
gtgaggccccgcccctggaacgcgccctttggaagccccgcctccttaggactcagaaaatccgctaacccttcaactcttacgatttggtcctctaggagactctcccagatggataggccctggtctctcataatatatccactgggaggctgcgccgcccaacttttcgttactgtatctgagagtcccttgtcccttccccacccctctagttctacatcacttgttctcttagtaggcatctccttgaatttctacccagttagaattgcatcctgcagcgggctttgccacg

SEQ ID NO: 167584 - DNA, 476 bp, Homo sapiens
tggaagcatctgtgaaactttgtattaacaaaccattatatgttaataatacctatctcagagaactcctgtaaagataaagtaagctaatgtttgcaaatttcttggcacagacagcctggcacacagtaagtgcttaatatgtattgactattataatagggatggagcagttaaaaacatgagtgttttgcactttaggagtttccagaaggaagccaaattttcctgtgtaatttggaaagcataaaatagaggtcaggtgtgaaactggttcccaggagatgatggagaaagacatggaggactctacccactgttaaactgggtcagatcaggatagaccccaaaaaagctgtgctgtgaaatcatctatgtctcacagagggacattgggatccatctgcaaggtgaaccaccatcaccatgaagtcaagggtgaggacaccagtgtagccctcccccaggggcaagga

SEQ ID NO: 167585 - DNA, 352 bp, Homo sapiens
actaacagacatttaggagatttgtaaaaatgtaaaacagtgccactattcttaccaaatttttgttttgaagagttatttttcaaagaaagtcatgttattaacatgtaacattttaaactatttaaaattattttagttttaatttcagtatggcaaatactgacagatataacttggatacacagaggctttttggggggcttcagtaacgtaacagtgtaaaggatcctgacatcatagtttctttgctcttacataacaccagcatctccgtttgttcacaagatcccactcattatttacttaataatagaactcctttagttctttatgcaacaatactcttctt

SEQ ID NO: 167586 - DNA, 324 bp, Homo sapiens
atgataatagctattgaaaatgaggtaagatgatatctcattgtgatttcttatttgcactttctttataataaataatgagagcactttttgtataccagttggccactggtatgtcttcctttgagaaatgtccgttcagatcatttgcccatttgtaaattggattgttttcgtttttgctaaggggttgtttgagtaccttatatattctggttactaatcccttgtcagatgaatagttggccgatattttcacccactctgcaggttgtctctttattgatccctttgctgtatagaaacttttttgcttaatataat

SEQ ID NO: 167587 - DNA, 574 bp, Homo sapiens
tgctatcaaacacgcaaacccgaaaattcgtttaaaatgctgtttgaatcacatttgttttgtccctaggttagtctatactgattgcaatttagtgtttacagaaacgtatcagtttggtcttgttacttggtctaaggcagactaattaccacagattttaattcaaaggacagtgtaaaacagaaaacggtacaagtcaaattgaaggcaataattgaaattttctggctgatgctggaactgtttttcacagcttttctcaattaccttctcaaataaggtaaggcttacaaagttcagactccttaattgggtggcctcctaagttgtttctggggaatgaagaaaaaaattaaagtattccttaccaatactaccctaggtatttcttgagactaacaggcattttctaaggttcaaccttaagatctgttttgttagttcttaattatacagcaaaagtttaataagagatcatgctctcaactacaaaattataacaagctcctcactgagacagatttggagaaagagaccaaaataacaacaacaacaaagcattgtacttaca

SEQ ID NO: 167588 - DNA, 234 bp, Homo sapiens
tctctctgagcctcactttcttcatctgcaaaccataacacctctgaatctatttgttactctaatgctagctatctagtgtttgctctctaaatgttagttcctccacctgggggctgggcgggcggtggctgacctcaccccatgaagctgtctcctggctttcccagctagagcctgtgggtatgaagattgcagccccgtcctcctgggggagtattcagtgtaacaagc

SEQ ID NO: 167589 - DNA, 283 bp, Homo sapiens
actttgcacatgacaacatatatatatattagagacaggttcttgctctgtcacctagaccccaggctgaagttcaaggcacaattctagcccactgcagcctcaaactcctgggctcgaatgatcttcccacctcagcctcccaagtagctagtactacaggtgtgtccactgcacccagcctatcaaatacatttcaatgagggcctcctgtgggccctggtttcctcttctgtgaaggagagtggtttgtctagtagtctctaaggttccttgaagccct

SEQ ID NO: 167590 - DNA, 342 bp, Homo sapiens
atactacactgccagggctaaacttgaaattaatcagtttactactctattattgctttatcatacacaatggactatacatgatcttcaagttatcagtaagtctagatcttaactgattctaactttaggggaataacgttatgacagaggaatttccttgaggggctgcctttttcaataccagtcgatatccttcatgggggtataaaaataatgcagcattgtagataattaagttatttcaaattgcatttctgcccttatatgaagaacactaactgtcgggaaatcaatcttgcaagaaaaatacctctgtgacatattctatcaaattatatg

SEQ ID NO: 167591 - DNA, 274 bp, Homo sapiens
caaggcggcctcccgggccggcactgctttcccacctcgcgctgcccgcccggcctctctcctgacccggccttgccggtgtcaggtcttgctttcgggctctctgtctgtgcctgtttctctgcctgtttctgtctctgctgtttttctgcctctctctcttttgtctctgtcactctcatctttgtcactctctcgtctctgtctctcatctctgtctcttcttcttttgtctctgtctctcatctctctccctcttctttctgtctcttgt

SEQ ID NO: 167592 - DNA, 271 bp, Homo sapiens
caggaaagcactgtatatacaattacagttttataaaagatataaatcaggaccagccaaataaagagatgacagggcaaggtctgggagggtcctgaatgcaaagcttccatgtcctattcctgtagaaccagcatgcaccaccctctggcacattgatgggctcaaaaaccaggaagtttccccactcagctcaatgtccagagtttttgttggggtctcactctgtagacatgattgattgaatccttgaccatggatggactcaatc

SEQ ID NO: 167593 - DNA, 128 bp, Homo sapiens
gttaggagcacggtcttgagatacgaagaataatcaaagaacttattttcgtagttaagtttatattatctgccctaggcaagcaggcatcataaaacttggtggggccttgctaaggaattactttg

SEQ ID NO: 167594 - DNA, 408 bp, Homo sapiens
caagtagctggtactacaggcgtatgccaccatgcccggctatgttttttttgtatttttagtagagacgcggtttcaccatgttagccaggatggtctcaatctcctgacctcgtgatccaaccaccttggcctcccaaggtgctgggattacaggcatgagccacgcgcctggccttaattttgtatttttagtagagacagggtttctccatgtaggtcaggctggtctcaaacacccgacctcaagtgatctgtccacctcggcctcccaaagtgctgggattacaggcatgagccactgcacccggccaaaaaggtgtttctacatcaaactcttccattcactgaagaaaatagcttatcatcaatccttcagaaagcatgcttacatttgccttttataca

SEQ ID NO: 167595 - DNA, 383 bp, Homo sapiens
accacccccatactccaagtcttatagatgagccatttcctgacagctaaggagcaatcaactccactgtcctcctacataataatgaataatcttttcttgcagtcaataaaacaggctcccacgatcatatccttttatgacttggggatgctggtgaaaaatcttgaccagatattatttgatttgggagaatagagcaatgtaaatatggcattcaatatgctttaaaataattatctggaaggtgtaactttcatgctaaacatgatttacactacaaagaaagtagtctaggagaaataaaccacggaacttgtgggcattttgtaattgtctaatctagctcctttattttatagttgtggatgctggggccaagt

SEQ ID NO: 167596 - DNA, 241 bp, Homo sapiens
tgccaaagcgtagtacccaagtgatggagccagaccctgtctctactaaaaattaggaaaagaaatagcctgtctactctattggtccataacctctatcgagacagtgaccttgtctgctttattcaatgcctggatcttttcctagcacagtgcccagcacatggagacactgaatttggattctcctttttgaagtccccatatccacttcagtattgggttgtactacgctttggat

SEQ ID NO: 167597 - DNA, 225 bp, Homo sapiens
tttaggtctctattaacaatttattttctctacccccatcacaaaaaagcagaggaagtagtgtagcagccccagccacagccacagccacaccccactacttgcttcctaggtgtgtgtggtgtgtgactgcctgcaagcaactccagctctctgaacttgtttcctcatctgcaaactggaaatatttatttatttgacaaggacattatgagaatttactct

SEQ ID NO: 167598 - DNA, 210 bp, Homo sapiens
taccagactgtttcagtgtggctaacccctagcctagaaacccttatttttctttaattttaattttttattttaagttccagggtacatgtgcaggatgtgcaggtttgttacgtaggtaaatgtgtgccatggtgatttgctgcacctatcaacccatcacctaggtattaaggcaaacatatttcattttcatcaacccatcaccta

SEQ ID NO: 167599 - DNA, 509 bp, Homo sapiens
ctggaacccactgacagtagaccactgactgccaaaggtccaggtgaatgcagtcattgaggaccttgcttcccaccctcctggtcctttctggacaatattccctcccaccactataattattggatcatggtggaaatgagagcattgggtagcatttgacacatgggctgaaggagggattacaagagcacagcaagaccccaggaggccaatgggctatggccctctcagctcaggcattgtgcggcaagctgctaaggggctgtgcttggcgcttgggcaattcttctggccaagcttggaacctgcatgtttccagtgaccccaagtgagaggaaggcaaaaacactgggtaacacaacagtccagatggggagcctcaggattaacttgtgtatgctgcctcgcctctgtcccacagcaacctacaagataggaattgctgtccctaaattacagaggatgaagcaagcaagttcagaaagatttgtcagcttgtctaaagt

SEQ ID NO: 167600 - DNA, 183 bp, Homo sapiens
aggcatgagccactgcgcctggcctattttaagtttttaatacttggaaatatcttcttttggttttctaccagaagttctagtatcccaccagttttctgtaggcactaattttttgttctaatcactgaagattcaaggatattttacttaggtaaaatgccactcttcccacctcaatcc

SEQ ID NO: 167601 - DNA, 539 bp, Homo sapiens
agttccacctaaagatttctccatacataatgaactctaacttaccggcatgtaaacagacctgacctactcttgtgccaatctctgagtttcagccaatcacaggcagccaactgtttaatccctgttcaaataaggtaaatgccaagctgtaaccaacccagctgtttctgtacctcacttccattttctgtacatcattttcctttttatgtccataaatcttgtctatgtggcagctccagagaatctctggacctattttgattcaggggctgctcaacttatgaatcactgttcaattaaactccatcgatttaatttgtctaaagttgttcttttaacaccagaataatgtatatcataatctccctcactctaatcatgtggagattcagattttttcagctaatgaggctccaaccctgtctttgtttaaaaaaaatgaaaaaacaaaacaaaaccatgtcctagttttactgctaacagtatttctctgacttttctggatttcagttttgtacaatttctataataag

SEQ ID NO: 167602 - DNA, 439 bp, Homo sapiens
taaacagactcaggaggagcctgagattaacaatttgtttaaaaccctgtcagcaggaagcagttaagagcagtcatcgcccactttccccaacagcggcctgagtctccacttctgatggggggaatgaaaggagttagccagcctgctttaggcagacagtaagggaagagtccccagagaacctccaacccatattttgagcagataaaggaacttgtacagggggcttgcctaaacatgcccacatgcgcactgggggaatgggatggagccaacaggaatttgtgtcttatacaaataaggaatccagttccatcagcttgtatgtaaaagctcttatattcaactgtgaagggggcaactgggaacctgttttcaggatccctctttttgctgagagctttcctttcgcttaataaattgcattccactcact

SEQ ID NO: 167603 - DNA, 279 bp, Homo sapiens
agaacagaaaacagccagacagcagggtcacactcacagcgtcagtacccatgggaaacgtcagccactaaatgccctcaccaacagagaatggggaaaaaagagggggaaagaaaacttagagaagaggtcctggtgtgttctccccaggacggggccagacccctcacgcgttctccccaggacggggccgggtcccaggtggaacttgcttttccctctggcagtgaccatgcagccgcctgggctgggtcattcaccctcccgtctcctcccaca

SEQ ID NO: 167604 - DNA, 250 bp, Homo sapiens
gacttattcaccatcaggagaacagcacgggaaagtccggcccccatgattcagttacctccccctgggtcccgcccacaacacttaggaattctgggagatacaattgaagttgagatttgggtggacacacagccaaaccctatcaccatgcacagaggaggagctcaataaataaatctctgacagctggtgccaaaggcctgctgtgtggcagtgatatgaagaacaggactgccagagctggggc

SEQ ID NO: 167605 - DNA, 491 bp, Homo sapiens
tctcccttttagaggattcagtcagtacactttacattgttatttactgttttggtgtacttgatgtgtttctatttaccatccaacagctttacagtatatatttcagtataacaattacgttgtgatggaagagttagtaatttttacatatattcactagactatgtatatgaaaaaatcacttttgctatagcacttatttttttttggtgcagataacactcatatataacttttccactctgatctagcacaaattataatttacaattatttctaaatacttaagtggatttaaattttggcaagcatttttcatgggtgttatgcttttgacattttatgctacattgtgatgtttattttgcttcttgtttcataggacactttatagaataaaataataagaaaacatcgtacaggcaaacagtggtctaaaaacctacagagacacaatcttagttgatatataaaagtgtaaatattac

SEQ ID NO: 167606 - DNA, 159 bp, Homo sapiens
accaaaatctgagcagtgattaattctgaaagtggaaatacaggtgattgctactttcttctttgaacttttctgattttttaacattaaaaacacttattcacacagtggtaccattatactattaaattttaaaatgattgtatacctttcccataa

SEQ ID NO: 167607 - DNA, 584 bp, Homo sapiens
ctggaagcgggagttgactgcactctccctgccccactgcagggcccgccacagtgttgctcatgcctgcaaattatattttttaaaaagtaataatggatcatcgaatacaaaaaaagcatgtgggggatcagtctcctgcagaccccctagctagaagcatggatgttccgacatcacaaggcagccttgtcttttcctatgtaggcacgtacgtgtgtgtcttacacaattaggatgtattttgagtgtattttcatgtaagaacgtattctttaaaaagatgatctctggccaggcgcggtggctcacgcctgtaatcccagcactttgggaggccaaggtgggaggatcacctgaggtcaggagtttgagaccagcctggccaacatggtgaaaccccatctctactaaaaatataggaattaattaggcgtggtggcgggcacctgtaatccctgctactggggaggataaggcaggagaatcacttgaacctgcgaggcagagattgcagtgagccaagatggtgccactgcactccagcctgggtgacaagagtgaaactcttgtctcaaaaaaaa

SEQ ID NO: 167608 - DNA, 225 bp, Homo sapiens
atcccggcacgtcgagtccagatcgtcactgggcgcgtgtggctcacagtctgtgatcccagcacttggggaggctgaggcaggcgggatcacctgaagccaggagttcgagaccagcctggtaatatagcaagaccctgtctcaaataaatgaatgaatggtcagaatgggattcactttagagtgattttttttttctacttttctacagtaaatgactctca

SEQ ID NO: 167609 - DNA, 276 bp, Homo sapiens
catgccctgcctatccccaacaccaggttcagctgcctgtgaagtcatttgtttcgtgcacatttcctagttactggtatttttttaatcattaaaaatgtttttaaattattgatagtaattgtacgtatttgtagggtgcatgtgtgcagtgggtgatgatcagatcggggtgcatgtgtgcagtgggtgatgatcagattggggttaatggcagagccacctcacagttactgttttgtgttgggcgatacgtccggggtcccaagagtcggg

SEQ ID NO: 167610 - DNA, 707 bp, Homo sapiens
cctgaggagacagccacgataaaaaaaaaactcgcaaacagccacgcagagctgagtctcagaggctgtaaaaagaggtcttgatgataaggaccactcaggctccaagcctggcctgttactgatttaggatttatcttttacctacttccccaaaagatcagaggcagattatagttaagagtcacatactcagtagactcatttaaataagaatataagaatcagaggaatgtaatgagggtgaggtaataggtgagatctgcttcaattgaaaataaaatttagttctgggtatccagagttaaggcaaaaaagcaaacctatagactatcattaggcagtggaagaatcaggatcaatcagaggaggcaaattttcctagaactaaactcaaacttttataatcagaaactgatctaaggggccaggcgcagtggcttacaactgtaatcccagcactttgggtggccgaagtgggcagatcacttgaggtcaagagttcgagaccagcctggctaacatggtgaaatcccgtctctactaaaaatacaaaaattagccagacgtggtggcgggcgcctgtaatcccagctacctgggaggctgaggcaggagaattgcttgaacctgggaggcgcaggctgcagtgagctgggatcgcaccactgcactccagcctgggctacacagtaagactccatctc

SEQ ID NO: 167611 - DNA, 347 bp, Homo sapiens
gcgtttatgttttccacattgtattataaatttattaattatagcccttaatagccaacttaaaattttgaaacatctctatgtttttcttttcattgctaacattgttgatttgtgtattcctttgtaatgtattgaaattttatcattacttaccttttcatctgtagtaattccttggccttaaagtctatttgggacattaatatagttacttcaaggggctgggcatagtggctcatttctgtagtcccagtgctttgggaggctgaagtggggggatcacttaaggctaggtgtttgagataagcttgggcaacataccaggaccttgtctctccaaaaaa

SEQ ID NO: 167612 - DNA, 351 bp, Homo sapiens
tagaaaagtggcagtctgccaaagagagtgcccagaccaacccctaaacaaaaaaatcttttgtcaacgactctaataatttgtacaattcaggaaaggggggttgcacagtctttgcagatgtgcatttatgatgctatttttaagcagagcagcatgaaagaatagattcatacgaattgtaagttgatcattcattttaagcatttggcttctgctcctgctaaaatttcattctgtggaacgaaaacacagccagccctgaaacgaggtaaggcagggtgtgacaagatgaaattcttcattttcagacctgtgatgcctgctgaaaaacagaaagctttggggtct

SEQ ID NO: 167613 - DNA, 272 bp, Homo sapiens
tgtacaatggatgtgtggatgaatggatgttccaattccagtatcactaggtatctgttccactggaatacaccaatggattcagcctccttctgttcgcatgcacagccaagaatatgactttgctgtctccctcatgacacgacagtgatagaaaaaaagaagatcttgaaaggctattttgtgagcaatggatattaaataaatgcaagtgacttaacaattgctgctgattgaacagaaatataagcacaataccacaaaccatcata

SEQ ID NO: 167614 - DNA, 360 bp, Homo sapiens
ataatatgattattgagtagcattaagggccccctaagggtttgtgttcatgaatttaaagttaaatcagtcagcatgattatggtttttctccagccatattagctttataggtgcagaataggcagagttttggatttaatcagacttgtagatttgctaagggagttttacagattaacagaggagcaaataaactgagagtgtatgggaaggcagttataattattgaccatggaatttaaggtggaacacagaaggaggagaatataataaaagaatgacgtaaaaagtgatagaaccgaaagattggcagttcctataaagtcaaaggacttttgaagtctggataagtattca

SEQ ID NO: 167615 - DNA, 220 bp, Homo sapiens
agcaagaaattagaaaggtctcaaattaacaatgtacctttgcaactagaggaactagaaaaaaacaagccaaccccaaagcaagcagaagataataaatatctaaaattagagaagaactgaatgaaatttagacacaaaaatccatagaaaagatcaatgaaacaaagtgttttttcttcaaaagaataaacaagatcagtaaaccactagctatatt

SEQ ID NO: 167616 - DNA, 242 bp, Homo sapiens
accagcctgggcaacatagtgacacctcgtctctacaaaaaatacaaaaaaatttagccaggcattgtggcatgcacctgtagtcccagttactggggaggctgtggtgagaggctcccttgagcctgggaatgccgctgcactccagcctatcttaaaaaaaaacgcacaaaaaaattagccgggcgtggtggcgggcgcctgtagtcccagctacgcggcaggctgaggcaggagaatgg

SEQ ID NO: 167617 - DNA, 366 bp, Homo sapiens
cccagctattcgggaggctgagatgggaggattgcttcggtccagaagtttgagaccagcctgggcaacgtggcgagacctcatctccgaaacaagtaaatacaactaaaaatccagttcctcagttccatgagtcatgcctaaaatgctcaacggccctatgtggccagcagctactgaagtggacagcaccaaatacaacatttccatcatcccagaacgttctgtcagaaaggctgctccaaagagacagtccttgaccttccggaactgcacagtttggtgagatgtgtgcagagacagaggaaagccggcttccctttatccacacacacagatggccagcatctccgggtgtgccgagaa

SEQ ID NO: 167618 - DNA, 448 bp, Homo sapiens
ggtgggcccggttcgggggggcgcacggcctggggcgtcgggaagaggctgcgggcagcggggcctgcgggcgcggcgtggcggggcgggaaaacggctctgtcccgtggggcgcaggcaggaacgtgttcccataaaagacacagggaagaccaaccctgggcgttagccatccaaaccttccctcccgtgcgaaacccgctgccctgcggccaggactgtgagggaagcgatgggaggaacccgggagcccgcgaaggccgggccccagagtccgggcgcccctgagcggggcggaggggacaaatagaacctttttaaggacagctgaaagagattataagcgcggtgtgctgggactttggaaagggcgcgagtcattagtgggggcgaatcagaggggagtatgttgacgggataataacaaaaataaagaggcttgataaga

SEQ ID NO: 167619 - DNA, 341 bp, Homo sapiens
tggattctgaaagaagaggaggagttagcaaatagtggaggcacgagtggtgaaaatttcattttcagtagagccgactgcacattcagattcctagcacccatgaaaatgagtatgctgaacccaggaattattattttgttatagtttgagttcagcatttgaggcagcaagatatataatgctgaagagaaaacagccctgtgaagaattttgtgtgatttcgaagggtttggaagttttttctgaaaaccacgaataagcattaaagaatgtaaagcaggggagtggcataatcctctttgcttttattaagatcatttttgcagtggtatagacag

SEQ ID NO: 167620 - DNA, 603 bp, Homo sapiens
tcgagaccaccctggccaaggtgaaaccccgtctctacaaaaaatacaagccggatgtggtggcaggtgcctgtaatcccagctacttgggagactgaggaaggagaattgcttgaacctgggaggtggaggttggagtgagccgagatcgtgccactgcactccagtctgggcgacacagagagactcccatctcagggaaaaaaaaaaaaaaattatgctctatacttcccattaatttaattatgtagatttttttttggtgttttttattgcccaataggtacttttttggtgtatgttatatttggtgtttattttaccaaatatactattaaacccacacgtgtgcacacacatacacacttgagtataatgcctttcccactcgttagtacattaatattattggctaacactgttatatttttttctttgtaatgactgcataatattccatggtaaagatttaccacacttcatgtagctgttgttcccttttcgatgtcagatttttttttccacttgttttaaacagtgctaagataaatattctagtacatttatattgacatttttattcctgtgagaattggaagagaa

SEQ ID NO: 167621 - DNA, 208 bp, Homo sapiens
ggacacagcccaacacagccaaagacaatagagtccacaaggcagtaaacagtagatatctagttgatgctagaatgtgagctatagacagaaggactggaggggttgaaagcagccctgtgtacaagatgaaacatgagctctggagtgatgcagacctgatgccaatcccagctctgctccttcacatgaggtgatgggcaaattg

SEQ ID NO: 167622 - DNA, 748 bp, Homo sapiens
ttgagaaagaggaggagggaaacagaatccctatagatgttcattgtttcaccatttacaaaacacttgttaaagtactttgtgttgtatccaaatggaggccccaaacaaccttgagagaggggaacagacatcacaatccccatcgtgcagtgggagaagtacaggtgtagggaggtgaaatgccccctctgcacctcacagcaggtgaggggcagctccacgcactcaaccccaagtcttctcatttctttttccctgctctttccctgttcccaactgtgagggccttgctggaggtacatgtggataaaacttcacgttcagaccactctgaaatcctggatggattttacgggaaaggtatcctagggtctgggatctccctaggggtgaccttctcggtgctgtccccaatcagcattttagactcagcttctggcctttggccattgcctggaggctcccccgtttgatgctggttattgcatccaaacctccctttcccttccttcctccctggttcttggatatcctatacaacctgcctcagtcattcacattggtctccaaggccctctgccctcaggaggtttctctggtctcaagggggcacaactgtgtccactcaccagcaggactgcgtgctccctccgtttccctccaccagccttattcccctttctatttcctctgtcaatttgcttgatttactgtagagcagaaggtcgacgcaagatcctctaga

SEQ ID NO: 167623 - DNA, 383 bp, Homo sapiens
ttgagaaagaggaggagggaaacagaatccctatagatgttcattgtttcaccatttacaaaacacttgttaaagtactttgtgttgtatccaaatggaggccccaaacaaccttgagagaggggaacagacatcacaatccccatcgtgcagtgggagaagtacaggtgtagggaggtgaaatgccccctctgcacctcacagcaggtgaggggcagctccacgcactcaaccccaagtcttctcatttctttttccctgctctttccctgttcccaactgtgagggccttgctggaggtacatgtggataaaacttcacgttcagaccactctgaaatcctggatggattttttttttttaagacacaatggcacgtgatc

SEQ ID NO: 167624 - DNA, 256 bp, Homo sapiens
tctgcctgtgctcatgcccttccttttacctggattgctcttcagtttccactctgccctgtcaaagcttagcttacctcccccagacccttggcccaagtccagtcttctcctcaaagtcttccctagccaatttagcccaagtgaaactcccttcagtgaactcctataacttactgtttggaacactccgctcagcaattaatcctatatcaagtgttcattttgatcatttcatgcatgtgccactttttgt

SEQ ID NO: 167625 - DNA, 476 bp, Homo sapiens
tttctgactcttcttagtccttatgtggaattcagttatttccaataattagctccttttccttttgaagaaaacaattgtcttttctcagagtaatgacatcagcctcctcctttaatcaggtctttttttcactttccccctttttttcactttccccaacctctaagcatttcctggtactaggagacttttattgctcaagctggcccattttactatggacagttccaatggttgcacactcctgggacattcctgtgacttcatgcttggtatgatttctaccttgttgaatgactaccataattaacctacttctctaaaaatatttgaaagctgctgtctaatttctcttgagccttgcttttttctcctttaggctaaccatctctacctccctcaactactttcataggtcatagtttccagttcctttactagcctgattgcttttctccaaatctccaacttta

SEQ ID NO: 167626 - DNA, 361 bp, Homo sapiens
tttctgactcttcttagtccttatgtggaattcagttatttccaataattagctccttttccttttgaagaaaacaattgtcttttctcagagtaatgacatcagcctcctcctttaatcaggtctttttttcactttccccctttttttcactttccccaacctctaagcatttcctggtactaggagacttttattgctcaagctggcccattttactatggacagttccaatggttgcacactcctgggacattcctgtgacttcatgcttggtatgatttctaccttgttgaatgactaccataattaacctacttctctcagcatctgggatcctctagatcacctcagcatcacg

SEQ ID NO: 167627 - DNA, 365 bp, Homo sapiens
ggaggagtggagactgaggagccaggtggcggcgacgccttaagagtgagaactctgagggggtagtgaaggttaagggctgcatttgtggggctgctccaggttccattgcctgagccaccgaactcaggagagagggaagatttggaattaagaaaataaaagatgcagttatgacagtgcgatctcgtagactgtccccactagaacctgacactctttacatcaaatgacacacaatgaacataatgaaggcctgttggccctgggcgctggtcaccctggacagaacctccagaatccacaccatagtcggtcctccttctgcacacgaattccatcgtccaaggtcacggagtaaaaga

SEQ ID NO: 167628 - DNA, 210 bp, Homo sapiens
agaatgatataagcaaatcatagactggaattaaaatatgtatatacacatgcacacacatacacatgcatatatatacacacacatacacacacacacacatatacacacacatacatatatacacatacatacacatacacacatatatacacacgtatatatacacatacatacacatacacacattttacaaagcactctattcag

SEQ ID NO: 167629 - DNA, 357 bp, Homo sapiens
atttaagacatctactcttccaaaaacactgctaagaaaattaaaaggcaagtcaaagactgaaaaaaaaaacaatttgcaaaacatataactgagaaatgactataatatagaacatttaaaaaggagaaaattaaagcaaagttatgtaatttcgtgttaagaagaaaaaagcaattaaaaattgaaaaaagatttggaccagctgggcgtggtggtgcgtgcctgtaatccgagctactcaagaggccgaggcatgagaatcagttgaacttgggagacagaggtttcagtgagctaagattgcaccattgcactctagcctgggagatagagcaagattctgtctcaaaaaaa

SEQ ID NO: 167630 - DNA, 538 bp, Homo sapiens
aaataaagcctacctgattgtggtaaattaaatatttcatgtgcttctggtttaatagtattctgttgaggattttcacatctatgtgcatcagggagactggcctatagttttctttttttgctgtgtctttgccaggttttggtatcagggtgatgctgactttgcagaatgagttagggagaagttccttctccttggtttttttggaatagtttcagtatggtaccagctcttctctgtatgtctggcagaattcggctgtgaatccatctggtgcagggatttttttggttggtaggttttttatgattgattcaattttggaacttgatattgctctgatcagagtttcaatttcttccctgattccattttgggaggttgtacatttccaggaatttgtccaacatcaactgaagagaaaaaagctggacgcattccccttaaaaataggaacaagcaaggatgcccattctctcatcagtcctattcaacatggtactagaagccctagccagagcaatcaggcaaaaaa

SEQ ID NO: 167631 - DNA, 190 bp, Homo sapiens
cccaagttccaggtatgagaagtgccatagtaactggtctttatgtggacaatgtatttattggggctaaattatcttttcttctcatcaggctgttttaaaacattttctccaactcagcccacaaagagaaaatagaaattaacactgactcatctactaaaagccaggtgctgtgctaaacattcat

SEQ ID NO: 167632 - DNA, 532 bp, Homo sapiens
ggcaggaggctgtgaacatgtgggatgcgtgttttatctttttataacaccttgacattcaggatctctctttttaaaagtcttaaacagaatcattttttggtaggggaaaagttagctttaagatatatgcaggtggctcaggggtgttagtgtgacttcctacatgaaaaatcaccaccaaaagcatcatcatttcaggctgtaaatatagcactgtcaagtgggacaatgctgtgtgtcagcagatcgtttagaagtttaggagtatgttttaagcctgagagtagtttttttctgtatctcagaatttttaataacagctcaaattggatcttttacataatccaatcaaaatcatcctgggctcaaatacaaaatcaggcaaagagtagatcaagatttatttttgccgagcgggcacagtggctcacacctgtaatcccagcactttcagaggctgaggtgggaagattacttgaggccaggagtttgagaccagcctgggcaacatagcgagctcttatctctt

SEQ ID NO: 167633 - DNA, 452 bp, Homo sapiens
ttaagaaaatccctgtcgcaagcactctgggatttggactcaaatgctaattatacagaaccacttgggtgcccagctgctgtccattctctacacttatcccacctgatggaaggctgttaagaaaaacatcactgcaatgcctaataaacagacatgggtcccagacccaataagagtgaaaccatccccctatttaaatgaaattatggctgatgagaaagacaaattaatttctctgtccctagtattacacaaaactttggatgctgccattgttacaattttattttccccaggagctcagagtcccaccttcattctttttgtttaatgcttaagcttgcctgtccacctatggaagactagaatgagcaaagaccatgtattcaatgatctgtaaatctaacaggaaacaatataataaatatattgtgtttgctaaccaaatc

SEQ ID NO: 167634 - DNA, 237 bp, Homo sapiens
ggcttcctctccaactgatctgttcctcacaggccccagggtgcttggcaggaggcagatacagactgtgtcagtgtgaccataggacaccaatacctgcatggggagtttagcagcccacaagctattaagagttattcaggggtgggaaggatacttcttggctcttctaggagacaggatctctaaaccctaaagaccgggctcaaaggggcagttcactgaaggacatgaatt

SEQ ID NO: 167635 - DNA, 394 bp, Homo sapiens
ccaagggctcatgaagcgatgtgattgagacaagtagggtctatgcaagcagagtggagaggacaagaaagaaaggtcttttaaagttgaaggaacaatgtgacccccaggcacagatgtaaacattgtaggctgtgtttgggaaaaagttggtgtcagggggtcaatggctggttgactagattctagcacaccttcttgaaatataggagaagtcaaggagtatgaaggcagtgtgataggttgaggcacagagagtctggaatgccgtgcctagaagtcagagagctaatgagagtaagacagggagcttaggatctatgtttcctgaacttggctttgtatcctgcaaccaagagaagccagtagaaggtcttgggccagaaagggatat

SEQ ID NO: 167636 - DNA, 313 bp, Homo sapiens
gttctctgtactgtcactgcttgaccctcaaatgggggtgtaatcacaggaagtgaacagcagagtacggtgattaaacctcagctttctgactggagggccatgaaagggagggactaggaaactagaaagtactcaggagattgtgtggagggaggagctgaggacagcgacctcataaagtcgcccatggaatcccaggctcgcccctgagcgtcacacatgtgaggatgagatcttaaacagcataccaaagactaagaacagaactgtgggagagaccaccgcttggctttcagactgaccacaggcg

SEQ ID NO: 167637 - DNA, 294 bp, Homo sapiens
aatcatggctcactgcagtgagtagccgggaccacaagcataccccaccacacctggctaattaaaaaagaattttttttgtagaaatgggggtctcactatgttgcccaaactggtctcaaattcctgggctcaagcagtcctcctgcctcggcctcccagagtgctaggattacagacctagcactgtgcctggccccatacatctgttgatgaacacttaggttgattacatatatttgctattgtgaatagtgctacagtaaacatgcaagtgcaggtatccctttgata

SEQ ID NO: 167638 - DNA, 209 bp, Homo sapiens
acagccaagcctggttgtataattttgtattttatgtagagatggggttttaccatgttgcccaggctggtctcaaactcctggactcaagcgatcctcctgcctcagtctcccaaagtgctgggattacaggcgtgggccactgcgcctagcctagttgttttaatgtattagtttttctctttggctaaaggtattgactagagtgg

SEQ ID NO: 167639 - DNA, 210 bp, Homo sapiens
cccagctcccttttgaagatgtaggaagttgcctgtgatcaggtttggatgttgacctgctataattgcaggtgtctggcaatttgcctaggcacatttcctaggtagtagtcactgtctcagtggccattatattcccaagcttatatccagttcagattggaagtcactgcagtagcaccgattgctgttgccaccacatccacatcc

SEQ ID NO: 167640 - DNA, 547 bp, Homo sapiens
taccatgccgcctccttactccaccaattttccaggcacagacatggccgcttcaaggactttgcgtctgtttgccaggcagattggaagttgtgcctccacattttgttttctttggtagtggagtctttgtgggagacactgtgccctcctgataatcagaaggcagctcgagtggtcagtgtatttgctttgtttataaggtctgcccatgaattctggaggaggaaatcatgaaagacttttcctttcagactgggcatctcatttgccaaatgacaattatgtgtgctacatacatgtacttccagcaagttccaggttcccaggtcttaggaaagttaatgacaggaagactgtcctacagaacttcctcactgtggaagagattgacagcagctcatctaattagggccgttatgaaaagttggattaatagcgatttttgtttttcgcttgcgtctaaagaagcatatgttctttggcatcatgtgatggttattagatctcagcttttgcccgttttgctcagagaagctaaatgcac

SEQ ID NO: 167641 - DNA, 386 bp, Homo sapiens
tacaataaatatttcttacatgaatgaatgaatatcattcattttataggaaatgcacacatggtctacttatgtagtgtatatgtgtacatatgtttatatgtatttaaaatctaattttgtgaagttagattacagttctgttcattgagcacacttaatatacaaaagccataatgtcctagaaataatcattttaatgtaaaaatgtacaaatcagactcatttccttaagacatgtacagagctcagaagactttatgaagttgtatgtgaagatcccacttttagactctttaatggataaacatcctcaatctgccagcatgttcagatttttctcttaggctctcacactacatggttttctttctttcttttttttt

SEQ ID NO: 167642 - DNA, 462 bp, Homo sapiens
ccagaagccctgactctagcaaccatctctgcctctggaagggaaatgtcctctctctggcacgtggggatatggtctcagcagtctgggtcccattcacaggcatacctcactgtctgctcccccgtacgtgtacacatatgctcatacgggactggaaaaagtaagaaatttggagcaagataaacctgagtttgaatctcaactttttcacattctctgtgacttttgcaagtcaactaacctctctgagtttctgccattataaaatgggaggaaaataattcctgccttttctgctatcccgtgtgcaatgcggaacaagctagacaattagaaagtgctaaatccggctgggcgcggtggcttaagcctgtaatcccagcactttgggaagccaaggagggcagattacttgagatcaggagttcgagaccagcctgaaaaacatggtgaaacccc

SEQ ID NO: 167643 - DNA, 631 bp, Homo sapiens
atctggctgagatcagtgatgaaggtggctgaactaaacaatagattttcagtgcagatgaaacagccttctattggaagaagatgccatctatgactttgataactagagaggagaaaccagtgcctggcttcagagcttcaaaggacaggttgactcttgtttgggttaatgcgctggtgacttcaagttgaagccagtgctcatttaccattctgaaaatcctaggaccctgaagaattatgctcaatctgctgtgcctgtgctttagaaatagaacaacaaagcctggatgacagcacatctgtttatggcatggtttactaaatattttaagcctattgatcagaaaaaaaaaaaagatatcctttcaaaatattgtaatcatccaacagttgttttttctttttttcccaccatacaaatagagctgattcactgagacagtgatattatagtagagaaagagtgtaataattgcagagttagtcaagtgggaggactggagttattatttaaatcaccttcccctaaaatgtggaagctatggttttttaaggatagtttggcagagagggagctgggaacggggaatggagattggttgggttggggataaaattataggggt

SEQ ID NO: 167644 - DNA, 183 bp, Homo sapiens
tggttttaaatgttactatgtgctaatgactcccaaatacacacacacacacacacacacgcacacacacacacacacacactgatctgaacttcagactcatatatccaattgcatacctcacatttccagttgggcttttctttgcaaacttaatgtacattaaaaataattcctaggtgg

SEQ ID NO: 167645 - DNA, 121 bp, Homo sapiens
tgactaacaaaaccctcttcttctttgattttcctctatcctcagtgctcattcctcctgattctgctccatcgttcctctatctcttttttaagtgctgaggtttcttttacctccatat

SEQ ID NO: 167646 - DNA, 642 bp, Homo sapiens
ggaggaaaataccaccactaatgggtaggggaatttatttagaggatggcaaaaatgttctggaatcagatgatgctgatggttgtacaaccttgtgaatatactaaaaaccactgaacttcaaaaaggaagattttatggcatattatttatatctcaattttttaaaaactgtgataaggccagacgtggtggctcccgcctgtaatcccaagactttgggatgggtggtggatcacttgaggtcaggagctcgagaccaacctggccaacatggtgaaaccgcatctctactaaaaatacaaaaattagctatgcatggtgacatgcacctgtaatcccagctacttaggaggctgacacaggagaatcgcttgaacccaggaggcagaggttgcagtagccgagacgtgccattgcactgcagcctaggtgacagaagaagactctatctcaaacaaacaaacaaacagtgataaaaagacactgtgccaaacagactggtagaaaatatttacaaaatatattatgtggcaatgtatttatatatttagaacatataaagaacacttacaacaaaaagacaaacaacccaattaaaaattaggcaaaaagacacccacacttttacaaagataaata

SEQ ID NO: 167647 - DNA, 453 bp, Homo sapiens
gaccaaagggtgggcccgcgttttacagaaggcgtttgtcaggttgggtctgagaaagcagcgcctttctcccttctgttctgggccactggaaaccctcccagagatcgctgctggtctgctgcctgcggaacccttcatttctgcctacgggttgctctgaagaggcaactcccaatacgtgtcccttgctcccctgtctgctgtggcttgtgggaggatgtccctgtcctctctcaagctcagtgttcccacagcactgagacccggggtgtatggagcccccaaagtccctcctgcctggtctcggcaggcctacgggctggtgcttacagccacgaggtgttcaccagtcacactctctctctggccacaggcaggagtagtggaaggcgtgggtgggacacccgggagcctaccaggggccaaagttcttctgcacccccatcggcc

SEQ ID NO: 167648 - DNA, 598 bp, Homo sapiens
cctcacatgcacagttcacagtaggattcgtgcccctgtgagaatctaatgcgaccactgatgtgacaggagatggagctcaggcagtaatgttcactcgacagtcgctcacctcctgctgtgcagcccggtttctaacaggccacaggccagtaccagtccacagtccaggggttggggactcctgatttaaactgttccttccacatagtgttctctgatctctaaaataaaacacatattgggccagatagtcactatctgaatatactcttctagaaattcttctatagtaccaattacccctttaataacaaaattttcaaactgagtaaacccattagtggatcatgaaatctacttaatgggcccaatcagtactttttcaaaaagtgaactggaatacaatatgatttatgaaagagtgttacatgtatgtgttgtttcccgaacctctttcaaggagaatacgttttatgcatgtttgtaggtttgtgaagaaagcttgaaaactctactgccttaatagatcatttgtaaaaactaacatttcaaattttttacactctaaaagtacagcatgcctgttaaatacttt

SEQ ID NO: 167649 - DNA, 279 bp, Homo sapiens
agtgattctgtcttctgagctctgacatcatttcaaatgtatgaacattggcctgaagcttaataaatttcagccatcgtatattcttagcttttgcttgggctggcgttcctctgcttaacaaaaaacagtcatgagccagatgaaagcaattttcccacatggcaccttcatcttattttccagtctctgagtaaaagaccgcacctctcaccttgcagctatcacagaacatgggaacattgccgtctgcatgcctctcacaggaaatcatgcaca

SEQ ID NO: 167650 - DNA, 110 bp, Homo sapiens
gcaacctgtgctcagtctgaagacaatggacccaagttaggtgtgacacgttcacataactgtgcagcacatgccgggagtgatcagtcagacattttaatttgaaccac

SEQ ID NO: 167651 - DNA, 636 bp, Homo sapiens
caggggatgttcagaacaccaggaagcactcaggacaccagagagcgatcagaacaccagggggcactcagatcctccagggggcactcaggacaacagggagctctcaggacaccagggtgagctcagtaaaccagtgttcgctcagaaccaccagggagcactgaggacaccaccgctcccttaggaggcagctccacatcaggtccctggatccgggcagggagggcggttccttttggatcttgccactaaccttttgggagttttcctgcttcctttgtggtttcaagaatcatttgcagattcttctcatgtacaaagctctgctttcttggattatgtaatgtttttggctttggatgctaccagaattacgttgtactgtgagaggattcattcgtggtgtgtgcaatagtgaatgaaagctccaatgttaggggtggctttgaaagctacgttaggggtggctgagggcagttagcagaaaatgatcatcactatagaaggctactcatttctttgcacatttgcataaacaattgtagtttatgccctaaaaactgcatgttttcttggccctttttcttaaatggctccactctaagtccagtaatctaattaagctgtgtttca

SEQ ID NO: 167652 - DNA, 292 bp, Homo sapiens
actgccagagcaagaattttttttaagtcccagaaatgaagacaaatggaagaattcagtttaaaggggccttgtgagttctgaagagaatgcaaataaacagattcacgtgcagacacattgtggtgacgtttcagaactccgagaataaacacacatttcttaaaatcatctagacacatgtttcttaaaatcttttagagaaacagaaaggactaatcacattacattagatttaaggatgccagatataatacaggatgttcagttaatatataagttccagataaac

SEQ ID NO: 167653 - DNA, 385 bp, Homo sapiens
cgggcatgatggtgcgcacctgtaatcccagctactcaggaggctgaggcaggagaatcgcatgaacccaggaggcagatgttgcagtgagccaagatcacgccattgcactccagcctgggcaacagagtgagactccacctcaaaaaaaaaaaaacaaaaaaaaaccaccagccatttgggaagccaaggcaggattgcttgagaccaaccagaagttcaaggttgcctgggcaacagagcaagactgtctcgagacaaaacaaaaagtcagcatcttctgcccacttttactttaacatacatttatggatctattgtctctttccctgttctaaaactttaaatttcacaagaatgaagattttgctgtcttgtttcctgc

SEQ ID NO: 167654 - DNA, 285 bp, Homo sapiens
aggtagaggttctgaggtaggaacatgcttttggtgtattcaagaaacacccaggagtctgagtaaagcaggacaaatctgggatgtgagatgagagttctgctgtggttatgttctatttcaggtacctacaagacatccaagtggaattatcaagtaagcagttagatttatgagtttggagtaaggtggcaagaattagggcttgaacaaccagaaaaacaaactgagtggggtggtcatggggataggagaaagagggtggtgtcctagaggctaaatgag

SEQ ID NO: 167655 - DNA, 521 bp, Homo sapiens
aaaagcctggggccatacttcagcctggggctgagtccaggtgctgaaagatgtcatcgggactcagtttccttctctctgtctcccggctccgggtctctctatgcctgcttcattctccatggatgccctagctgctcaccagtgtagtgccgccccctgccccaatgtagccatctcaaccaagaaagagccttgtttttccccaatatttttggcaaaagtcctagtcatcactgtttttgaccaggctggtcaagtgcctatctttgagccaatcaagacagccccctctgattggctagggctggctcacgtgcccacctaggaggaggaggtggggtcagtccatctagaccccttgggctgagagcaggcctatgtgggtctcctcctggaacaggtttaagctgtccccagaaggggcatgggtgccagcaggctagacatatggactttagtgctattcttttttttttctttttttttaagagacagggtctcactctgtcaccctggct

SEQ ID NO: 167656 - DNA, 238 bp, Homo sapiens
tgtctctcagtcagttgggtgtgagatgggaaatcctgttctgagtcaaaaaggaaccctcctcccttgccttcctgattcacttcctcattctgccgacattttacagcctggcacaggtgctggagccatgcaggcctggccttgcttctgacttggtgcctcagtcactgtctgacgtgggcaggagagccagcttcagtttccccatctgtcaggcagcacgatgacccctgat

SEQ ID NO: 167657 - DNA, 437 bp, Homo sapiens
tttttcatatgtttgctggtcatttgtatgtcttcctttaagaattatgtatttgtgtcctttgcccacattttaatgggattatttgtttcctttcttgctgatttgagtttcttgtagattgtggatattagtcctttgtcggatgcacagtttgtgaatattttctcccactctgtggggtgtctgtttactctgctgattacttcttttgctgtgcagaagctttttagttgacttaggtcccatctatttctctttatgttgcatttgctattcggttcttggtcatgacctttttgcctaagccaatgtctagaagagtttttccgaagttatcttctagaatttctcatggttgcaggtcttaggtttgtctttgttccaccttgagttgatttttgtataaggtgagaaatgaggatccagcttcattc

SEQ ID NO: 167658 - DNA, 471 bp, Homo sapiens
catatgggtggtgtcgcatgggagaagccccagctctgtctgcagtggtagattaagggggaaaagaagtctctgctctgtgcccaggctagagtgtagtggcgtgatcttggctcactgcatcctctgcctcctgggttcaagcaattctcctgcctcagcctcccgagtagctgagattacaggtgcccgctaccatgcccagctaatttttatattttcagtagagacggggtttcatcatattagccaggctggtctcgaattcctgacctcatgatctgcccaactcagcctcccaaagaggtgggattacaggcataagccactgcgcccggctagaagtctctttctttaagacccttcatgagcatgagggctgcctgacaaagtagagctacagactttctacgctaagccagcaccaccaatacagccagcaccaccaatacagggagcaccaccaataca

SEQ ID NO: 167659 - DNA, 251 bp, Homo sapiens
cagttacttgggaggctgaggtaggaggatctcctgagcctggggaggtcgaagcttcagtgagctgtgattgtgccactgtactccagcctgggtgacagggtgagactctgtctcaagaaaaaaaatatttattacatgcctaagcatgcctagcagtgtatagacacccaaggtgcagtataaactacacagatacggctttttatgttcaaatggaatctacattttaacagaaggtattagcagag

SEQ ID NO: 167660 - DNA, 835 bp, Homo sapiens
tgttttcctgcgcaggagccgcagggccgtaggcagccatggcgcccagccggaatggcatggtcttgaagccccacttccacaaggactggcagcggcgcgtggccacgtggttcaaccagccggcccggaagatccgcagacgtaaggcccggcaagccaaggcgcgccgcatcgccccgcgcccctgcgtcggggcccatccggcccatcgtgtgctgccccacggttcggtaccacacgaaggtgcgcgccggccgcggcttcaggcccttgggaaggagctcaggggggcggggggattgtgcctgggcatttatttttccccaaacaacagaaacccgcggttttggtggggtggccacctcgtgaatccccctaaaagttcccaggtcggccgaacgctgtttctacatcccctttccgggtttcggggcaggcaaacgtttcccccccagtgcgaacaaccggggcgcggcacactggcgggcccctggcatgagcacaaacctaaaacgtgggatttcccacccaagcggcgtgggcaaagtatttccacctttgaccccaacgtgtacgcgtgacccccgaaagccgagcgttgtgcccaaatcgtgccccggcgcgggcccacccttttggtgcaaaccaccgcgccgggaccaacgccgcggcccattttaagatcaccctcacccccatgagcgggcgccctcccgcgtaatattcaccccgccgccaccgcaccacttcgcggaaccaccacccaaacacccccgcgtcttttttccccacgccaaaaactcttttttcccccccccccatattcccgctt

SEQ ID NO: 167661 - DNA, 981 bp, Homo sapiens
  misc_feature (860)..(860): n is a, c, g, or t
  misc_feature (904)..(904): n is a, c, g, or t
  misc_feature (943)..(943): n is a, c, g, or t
tgttttcctgcgcaggagccgcagggccgtaggcagccatggcgcccagccggaatggcatggtcttgaagccccacttccacaaggactggcagcggcgcgtggccacgtggttcaaccagccggcccggaagatccgcagacgtaaggcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggcttttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggnaaggttgggctggtgctcacagctgtaatcccagcactttgagnttggctgggagttcaagaccagcctggccaacatgtcanaactactaaaaataaagaaatcagccatgaaaaaaaaa

SEQ ID NO: 167662 - DNA, 596 bp, Homo sapiens
tgttttcctgcgcaggagccgcagggccgtaggcagccatggcgcccagccggaatggcatggtcttgaagccccacttccacaaggactggcagcggcgcgtggccacgtggttcaaccagccggcccggaagatccgcagacgtaaggcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagtaccgctccaaactcatcctcttccccaggaagccctcggcccccaagaagggagacagttctgctgaagaactgaaactggccacccagctgaccggaccggtcatgcccgtccggaacgtctataagaaggagaaagctcgagtcatcactgaggaagagaagaatttcaaagccttcgctagtctccgtatggcccgtgccaacgcccggcttttcggcatacgggcaaaaagagccaaggaagccgcagaacaggatgttgaaaagaaaaaataaagccctcctggggacttggaat

SEQ ID NO: 167663 - DNA, 916 bp, Homo sapiens
tgttttcctgcgcaggagccgcagggccgtaggcagccatggcgcccagccggaatggcatggtcttgaagccccacttccacaaggactggcagcggcgcgtggccacgtggttcaaccagccggcccggaagatccgcagacgtaagccctgcgctcaggggcttgccccatggtggctcgtgccctgctgtgacttgccgccttgtgcctttgctgggttggcctgatttgccacgtggcgggggtgtgctgcttgtcttgcaacctgtcgctgggacgccgtgcttggctctgggcgtggccttacgggccaatggtgttgacctgcctgcttgcgcttctcgtcacacacagggactgtacatgtgccctgtgctaattgctcaattggcttgcagcctgctctttctgcttccctgatagccccctgctgttcggagtgttccacaattcccctgggcccaagttccgttagctggcttgctcccccagcactggtttcttgggtacttcccatgcatctggaggtgggttgcctgctgtactggtgttctggtattgctgctttacaaggcccttggtgtactggcgaactgcttcctagagttggttggttgctacagggacgaatttccacgcaacactgaacagggttggtgcgcccgagaaaaaccaactccgcgacaattattacgttggtggcggatgtccccggaatggtgcaatgcgtcatgtgcccactcccaaagcttccccacaggtgctagtataccctcctatttcaaattgtaacacaataccaggctgtcgcagccggcacgcgttgaagaggggctacgcaatcccgaaatctccaaatcccgtccacttacccttacttagcccacccagtcgtcaaatcgcgcactttcgg

SEQ ID NO: 167664 - DNA, 1127 bp, Homo sapiens
  misc_feature (414)..(414): n is a, c, g, or t
  misc_feature (1006)..(1006): n is a, c, g, or t
  misc_feature (1050)..(1050): n is a, c, g, or t
  misc_feature (1089)..(1089): n is a, c, g, or t
tgttttcctgcgcaggagccgcagggccgtaggcagccatggcgcccagccggaatggcatggtcttgaagccccacttccacaaggactggcagcggcgcgtggccacgtggttcaaccagccggcccggaagatccgcagacgtaaggcccggcaagccaaggcgcgccgcatcgccccgcgcccctgcgtcggggcccatccggcccatcgtgtgctgccccacggttcggtaccacacgaaggtgcgcgccggccgcggcttcagcctggaggagctcagggtggccggcattcacaagaaggtggcccggaccatcggcatttctgtggatccgaggaggcggaacaagtccacggagtccctgcaggccaacgtgcagcggctgaaggagagtacgcgcatccaaaancgtctagtcacgtcttgtctcgccaagagtagagccccgtcgagagctcgctcgataggaatgtggagacctagattcgtgttgatatgaagcgtgaaatcgtggacattccgagaactgaccggaccggtcatgcccgtccggaacgtctataagaaggagaaagctcgagtcatcactgaggaagagaagaatttcaaagccttcgctagtctccgtatggcccgtgccaacgcccggcttttcggcatacgggcaaaaagagccaaggaagccgcagaacaggatgttgaaaagaaaaaataaagccctcctggggacttggaatcagtcggcagtcatgctgggtctccacgtggtgtgtttcgtgggaacaactgggcctgggatggggcttcactgctgtgacttcctcctgccaggggatttggggctttcttgaaagacagtccaagccctggataatgctttactttctgtgttgaagcactgttggttgtttggttagtgactgatgtaaaacggttttcttgtggggaggttacagaggctgacttcagagtggacttgtgttttttctttttaaagaggnaaggttgggctggtgctcacagctgtaatcccagcactttgagnttggctgggagttcaagaccagcctggccaacatgtcanaactactaaaaataaagaaatcagccatgaaaaaaaaa

SEQ ID NO: 167665 - DNA, 746 bp, Homo sapiens
gcctccccggtagctgggattacaggcatgcaccaccatgcctcgctaatatcttgtgtttttaatagagacagggaccatgttgccaagactgatcttgaactcctgagctcaggcaatctgcctgccttggcctcccagagtgctaggattacaggtgtgagccaccgcgcctggcctatttgcttcttttttatgatattttccctcattgggaggtaagctccctgtcggctgctatttcaccagagcccagaatggtgcctggcacatagctgacgctcactaatttttgttcagtggatagtgagtacccattgtgtatggactccacacctcttaagggagacaggtgcatttttacaagcttgaggagcacagccagagtgcaggctgtgaccgtgttcatcctcatgcagctcagtgcagagggccatcagcagtgagtggctctgtcaagtttatctggaggcggggagttgtaaagggcagaggcatcacagcctggaggctgaggtcagcgggctggccaggagaggggctggagtcttccccagtgcgggcattaccccttccaatactgccatggtccaagtgaagcagaggctgtgggacccgaggctgtgggaccctcaacactgatctttgagagtccactggatgttggctgtgaggtttcctttgactcgctggagaggagggacaggagctacagtgcaggcaggcaggtgcacggctatgcacag

SEQ ID NO: 167666 - DNA, 230 bp, Homo sapiens
attcttctcctataatttctttcacttctgggcagagggcagcctgtgggcaagtgttctttttgctgacagtccaagagtgttgggttcaaccaactgctaactcctgagacaattttaaggcagggcaataaggagaaccttacagatctataaggccagctggagctatccccagggccatgttgtagcagacccaaatcttcaaatcttccagtgtctgtgtggag

SEQ ID NO: 167667 - DNA, 494 bp, Homo sapiens
aaaatgagagtgtcaagctcatatatgtttcctgcatgtgtacacagaagctagcagtaatgcatcatggggcaaaaggagctcgttgagagctccattcttgtatccaggattttcttccaagatgatggcaggcacccactctttggatactgataccagcacttccttgacctaaccaggtctcaacggaaggttttcaaaccaccaccagcattcatatttcttccttaagtggtctgtggactgaaatactgaggagctacagttgtccaaagagtaaaagagaagtaacctcatgtccgtttcatgactgctgcctggtggatagcaactataagatacatatccatttcactaatgttcaaaggtggaaggaaaaatattatgtcttacaaagagaaaaaggtaaggcataatgtcgttaggatactagaagatgtgaaagattctattttcatctctgtcacaaccttatttagtgatgtagaaac

SEQ ID NO: 167668 - DNA, 511 bp, Homo sapiens
gggagaagtggagtgtcttacaggtggcaatgaactgacagcagtgtgtaatgtaaaagcgctttgtcattcacataatgtctggggtaatgaaatgaattcactttctggcttcctctagtctgcgatgccaaagaacactgtgttatcagcacagatggagcatgcatggttctggaggagagcctggtgtgaactacaaacaagccactgtgaataccaatgaatccctgagaatcagacccttgctgtcaaatgacagttttggaagctccataaaaatgagcgagtcccagtggtcttgtccaaccaaatgtactgtcacaattctggacaggctatttggaagccacgcaaatcatagaggcctgactgccacttccctgtgagaagcaagcacaggaagatagtcaaccagcgggtgcattcttttttcatttcttaataagaggtaatagacaatctatgctgatgcaaatactaatctacttctgtgggtcaattgtctctg

SEQ ID NO: 167669 - DNA, 372 bp, Homo sapiens
tgacaaagactcctccctgaccaaagcgcagctcacgcctctgaccctccaactaggcttgactaggccccatcatgtcttcagcctaagccagttgtagaaagaattcccagcctttgtatctgaccatattcctcatctcccacctttgaggttgaacaaagcctctcacccacccccagcaaggatcctgttacgagggtttctccagaatccctgaccttgatgtctcctcttagctattttccagccacccatcaccacactgctcctctgctaccaatcccctgtggtctctgctgcatttggagttaaactcattctctctcgcttattgccacagtcctgaataaagtcttcccgaccactgta

SEQ ID NO: 167670 - DNA, 174 bp, Homo sapiens
tctagaggcttttgtgccacaaggccagggcaagaaggggctaattcccctgcaccctggtcccttcacattcccattgggtttttctacctgaacctaccatacatttccttctctcccaccttccactccctgctaactccccatctacactgggatcttcctgcacctaaa

SEQ ID NO: 167671 - DNA, 497 bp, Homo sapiens
agaaagcccagtctatccacatgttgaaatcctggagtctgccttcaatgtggatccctcggccaagaatacgcttctcatttttattttcttccagagtccagaaaaccttggaaagctgccttaaggggtgatggaatgaaaaaccagaccaaaccaggcagacatgggttcttccctaaatgaacattccataagcccaacacagagcatcttccatttcagtgctcagcccccaaatgcctcctggttataattaagtacttcaaagttttccaaacacccttttagaaatccggtcccaaataaaaaataatgttcaatcagatgtaaatcatcgcacagcagggcaggagaggcatgggaagtggtcatctgcacttggactaatcagcaagtctagtcccttgatgaggattttcattttctcatttgtcattctagccactgaattctcaagtggccaatttgttccctattggtaatcagctagttat

SEQ ID NO: 167672 - DNA, 557 bp, Homo sapiens
ctctctgagggttcttggggaagttatgtagaaggtgcctctgctgaagtcctggagctgaccactcccaccggcttggctctgggctcagctctgtcatggttgaactgtatgaccctgggcaagtcatgggctcttctgggcctcagtttactgtctataaatagggacatttggacttgatgtacctgaagttcccttcttgcttttaaacagcttctcagctccttttgttttaccactagctttgcagagacttgttaggaatttacagcttgtgattgcttcacttttttggaaatggctctatggtttcaaacaacattaactttaaaaaaattaacaatgctgagcgtggtggttcacacctgtaatcccagcactttgggaagctgaggcaggtggatcaccggaggctggtcttgaattccggacctcaggtgatccactagcctcggcctccaaagtgctgggattacaggcgtgagccaccgcgccagccggtttttcaagtataaaacataacattgggtcaagccagtgggctggaccatcca

SEQ ID NO: 167673 - DNA, 510 bp, Homo sapiens
tatcaactaatgaagggataaataaatgtggtatattggaataatgtactaataattccgctggtacaatggaatattaatctggcaacaaaaggaaatactacaacatgaatgacccttgaaacagatttagtgaaaggatccagtcacaaaagacaaagcattgcatgattccatttaggtgaaatatctagaatagacaaatccacagagatggaaatcagtggttgcctagggctgggagagttggggaaaatggggagtggctgctaatgggtatggagtttcttttaggggatgctagttctacaactatgtgaatatactcaaaaccattaaattgtacactttacactggtgaattgtatggtatgtgtattatatcacaataaagctattatgagaaagaaaaagaaaccactggtgtctggctcactgttaaattcctagtggtgaacacatagcctagcacatgttatacccaataaatacttgttgaatttaaaagtg

SEQ ID NO: 167674 - DNA, 177 bp, Homo sapiens
agatataatgtgctgggctgctttttatacagatggagccatgctgaatgtgctgttctatgctttgctttttcccacctaaaaatgtattgcatacattttcctataatgatgggcataaatcagcctttgaaaaacttgactggagagtatttctttggcttttttttttttttt

SEQ ID NO: 167675 - DNA, 424 bp, Homo sapiens
gtccctagtaactctgagtatgagctcatgtgcatgtgtgtatatgtttatatatggatgccttcattgtatgcacagatacccatgattatccatgtgtgtgcataggaatggcaccctctgtctgattggaaatgagactccagagttaccccagcatgatgttcactgccttttttttttttttttttttttttttttgagacagtgtctccctatgttgcctaggctgaagtgcaaccacccaggctcaattgatcctcccacctcagcctcctgagtagctgggtcttcaggtgcaggccaccacacctagctaatttttgtatttttaatagagacaggattttgccatgttggccaggctggtatcgaactcctgggcttaagcaatcctcctgccttggcctcccaaagtgctatg

SEQ ID NO: 167676 - DNA, 588 bp, Homo sapiens
tggatgtagttctcaagtaatgggctactatataattttattacataaaactaagtgtaattccagaatcattatcatccagtatttcaaattatttataactttccaattaatttatagagaaaaagtgagtcacaaatatacacaataaattgtcatctaaaagcaaaacacggccttgaataaaagactgcactattaaacataaaaatcacctttttgaagaaaagataaaacagatataacttggataaactatcatagtatcatatttgacaagtgtgtactcacatttttatagatatgttgtactttagagtttataaaacatagtaattatgccacttaattcttacatcaatcctgacagaatgtcatcattatctctttatagataagacaataagtcaacattaaatgacttgcttaactacgaagtggcagagcaagactcaaactcagggttcctgatttcaggttcagtgtcctgtacatcatattacagatatcttataccacatatactttcataaatcatagattataaatatgattttaactgtgcagtaagttactttgtccaaaata

SEQ ID NO: 167677 - DNA, 347 bp, Homo sapiens
aggccactcacatcttcccgcaaggtcagtctgtttagcttggagttgttctgctgctttatttgctactcttcaccctgggtttcagtacctgagctctgtttccatcactgcgagggtaaagctttctcctaccctcctggtaccttttcactcctcgccctggtgtacctttgcctcaactgatctggaatcagacttcaggaatttagtcatgttgggcactttttaaaaaatgataccatcctgtatttctttttgtgttcagttttttggggttctgtgtttatggtgctaatgatgttaaactaatgctcagaggaattctgaagcacagttattcacaa

SEQ ID NO: 167678 - DNA, 356 bp, Homo sapiens
gcctaataatattgtggtgggccttgagcctagggatacagtgaagaacaagatagagaacctggccaggagcagtggctcacacccataatcccagtactttgagaggccaaggcaggaggatggcttgagcccaggagtttgagaccagactgggcaacatattgagacccctatccccacagaaaattaaaaaaagacttagccaggtgtggtggtacacgcctgtggtcccagctactccagaggctgagatgggaggatcacctgagcccagaagttagaggctgcaatgagccatgatagtgccattgcactctagtctgggtgacagagcaagaccttgtctaaggaaa

SEQ ID NO: 167679 - DNA, 275 bp, Homo sapiens
ttcccccatcatccatctcataaatctcaggaaagactgcctggctctgttagggtcacacatccaccagggatgctattttggctaataaaagatattgatgttagaccagaatgggaaggatgaggagacaagccagggtatttctgtcccaacctgctctctgcctcagatcgtgccactggcagcggctgcctcccctccagggcccccttcctctaaggtcccagctcctgctcaatgaccctgccacaggtctagttctcacagaagct

SEQ ID NO: 167680 - DNA, 246 bp, Homo sapiens
gtgaaatatttttgataggacatgtatctaaatgtgaataaattcagcccttttgaaaaggaaagtggactgcactctgatattggtaaaatttccaaaaataaaggtgtttgcccattggcaatatgattatagggctctaggcacgtattttagactgggcaatgtcttctttctcacaagactgttttgctttaactccctccttcggccttctttctagaaagttttgaaggataaagccct

SEQ ID NO: 167681 - DNA, 2371 bp, Homo sapiens
ggccgtccaggccccgccccgcagcccagccggaagggccggcggacgctcgctaggtcggctcgctggccggggctccgcggctcccgtggttgccatggcggcggttgtcgcggcgacgaggtggtggcagctgttgctggtgctcagcgccgcggggatgggggcctcgggcgccccgcagccccccaacatcctgctcctgctcatggacgacatgggatggggtgacctcggggtgtatggagagccctccagagagaccccgaatttggaccggatggctgcagaagggctgcttttcccaaacttctattctgccaaccctctgtgctcgccatcgagggcggcactgctcacaggacggctacccatccgcaatggcttctacaccaccaacgcccatgccagaaacgcctacacaccgcaggagattgtgggcggcatcccagactcggagcagctcctgccggagcttctgaagaaggccggctacgtcagcaagattgtcggcaagtggcatctgggtcacaggccccagttccaccccctgaagcacggatttgatgagtggtttggatcccccaactgccactttggaccttatgacaacaaggccaggcccaacatccctgtgtacagggactgggagatggttggcagatattatgaagaatttcctattaatctgaagacgggggaagccaacctcacccagatctacctgcaggaagccctggacttcattaagagacaggcacggcaccacccctttttcctctactgggctgtcgacgccacgcacgcacccgtctatgcctccaaacccttcttgggcaccagtcagcgagggcggtatggagacgccgtccgggagattgatgacagcattgggaagatactggagctcctccaagacctgcacgtcgcggacaacaccttcgtcttcttcacgtcggacaacggcgctgccctcatttccgcccccgaacaaggtggcagcaacggcccctttctgtgtgggaagcagaccacgtttgaaggagggatgagggagcctgccctcgcatggtggccagggcacgtcactgcaggccaggtgagccaccagctgggcagcatcatggacctcttcaccaccagcctggcccttgcgggcctgacgccgcccagcgacagggccattgatggcctcaacctcctccccaccctcctgcagggccggctgatggacaggcctatcttctattaccgtggcgacacgctgatggcggccaccctcgggcagcacaaggctcacttctggacctggaccaactcctgggagaacttcagacagggcattgatttctgccctgggcagaacgtttcaggggtcacaactcacaatctggaagaccacacgaagctgcccctgatcttccacctgggacgggacccaggggagaggttccccctcagctttgccagcgccgagtaccaggaggccctcagcaggatcacctcggtcgtccagcagcaccaggaggccttggtccccgcgcagccccagctcaacgtgtgcaactgggcggtcatgaactgggcacctccgggctgtgaaaagttagggaagtgtctgacacctccagaatccattcccaagaagtgcctctggtcccactagcacctgcgcagactcaggccaggcctagaatctccggttggccctgcaagtgcctggaggaaggatggctctggcctcggtcctcccccaaccctgcccaagccagacagacagcacctgcagacgcagggggactgcacaattccacctgcccaggacctgaccctggcgtgtgcttggccctcctcctcgcccacggcgcctcagatttcaggaccctcctcctcgcccacggcgcctcagacctcaggaccctgccgtctcacgcctttgtgaaccccaaatatctgagaccagtctcagtttattttgccaaggttaaggatgcacctgtgacagcctcaggaggtcctgacaacaggtgcctgaggtggctggggatacagtttgcctttatacatcttagggagacacaagatcagtatgtgtatggcgtacattggttcagtcagccttccactgaatacacgattgagtctggcccagtgaatccgcatttttatgtaaacagtaagggaacggggcaatcatataagcgtttgtctcaggggagccccagagggatgacttccagttccgtctgtcctttgtccacaaggaatttccctggacgctaattatgagggaggcgtgtagcttcttatcattgtaactatgttatttagaaataaaacgggaggcaggtttgcctaattcccagcttga

SEQ ID NO: 167682 - DNA, 707 bp, Homo sapiens
ggccgtccaggccccgccccgcagcccagccggaagggccggcggacgctcgctaggtcggctcgctggccggggctccgcggctcccgtggttgccatggcggcggttgtcgcggcgacgaggtggtggcagctgttgctggtgctcagcgccgcggggatgggggcctcgggcgccccgcagccccccaacatcctgctcctgctcatggacgacgaatcactcccgccacctcgggccgccgggtccccccgctgggctccagtcttacctgacggctgtctctgtcctctggagaatgctgagcgaagtgactgctttccagagcacgctctccagcgcccaggggtccgtgtcctgacagcagtagccgggcctttctctgcactgagtggcatctccctcctaaagatactttgcttcagaatttcatcctttcacttttgaagttcctctgggccagtgtagatactttgtttcagaatttcttcttttcattgtgtaactccttctgggccagcatagcttcgctggatgagctgggctctgcaggtgaagcctccctgttaagtttctgcttttcctgactttctcagaggacagaggggtgaggcggggcagctcatgaataattttttatgttgaagacttgtcgaaataatattttggttatgttgggttaaataaaatataaagttagtctgta

SEQ ID NO: 167683 - DNA, 258 bp, Homo sapiens
  misc_feature (212)..(212): n is a, c, g, or t
ggtctcctcggggctcacccagcgctgctcttccagcctacacaccgcaggagattgtgggcggcatcccagactcggagcagctcctgccggagcttctgaagaaggccggctacgtcagcaagattgtcggcaagtggcatcatagggtcacaatggcccccaagttccaggcaccgcatggcaaagcaacgggacttctgactggacgntgtggtatttggaattcccgcacgaagcttggacccacatatttgg

SEQ ID NO: 167684 - DNA, 2283 bp, Homo sapiens
atattttctgccctggaaaacccagaggagacacacttgggttcgaggcatgacccgcaaaactctcctgggagttcagaaaacgtggaaggaaggagccggggccacgaggggcatgtcaggcgggttccaggcggctgggaggctcctcacgatgcaccacccttcaccgtgcagggaaccccggccgccgccatgcctgccgccctcggttgtgcccagacgctctgcagggtaggcgggcagtgccagcaccctcctcgggtgaggccttggtcttttgtccctgccgtgcccaggcatagcccatactcagtgctggagggtgctcgtcttaccaagaattttgtgaaggtggtatctgttgctgctcagaacttccgagtgtccccacgtggggtccctgaagtgtcctgggttcctgtttccaggcatctgggtcacaggccccagttccaccccctgaagcacggatttgatgagtggtttggatcccccaactgccactttggaccttatgacaacaaggccaggcccaacatccctgtgtacagggactgggagatggttggcagatattatgaagaatttcctattaatctgaagacgggggaagccaacctcacccagatctacctgcaggaagccctggacttcattaagagacaggcacggcaccacccctttttcctctactgggctgtcgacgccacgcacgcacccgtctatgcctccaaacccttcttgggcaccagtcagcgagggcggtatggagacgccgtccgggagattgatgacagcattgggaagatactggagctcctccaagacctgcacgtcgcggacaacaccttcgtcttcttcacgtcggacaacggcgctgccctcatttccgcccccgaacaaggtggcagcaacggcccctttctgtgtgggaagcagaccacgtttgaaggagggatgagggagcctgccctcgcatggtggccagggcacgtcactgcaggccaggtgagccaccagctgggcagcatcatggacctcttcaccaccagcctggcccttgcgggcctgacgccgcccagcgacagggccattgatggcctcaacctcctccccaccctcctgcagggccggctgatggacaggcctatcttctattaccgtggcgacacgctgatggcggccaccctcgggcagcacaaggctcacttctggacctggaccaactcctgggagaacttcagacagggcattgatttctgccctgggcagaacgtttcaggggtcacaactcacaatctggaagaccacacgaagctgcccctgatcttccacctgggacgggacccaggggagaggttccccctcagctttgccagcgccgagtaccaggaggccctcagcaggatcacctcggtcgtccagcagcaccaggaggccttggtccccgcgcagccccagctcaacgtgtgcaactgggcggtcatgaactgggcacctccgggctgtgaaaagttagggaagtgtctgacacctccagaatccattcccaagaagtgcctctggtcccactagcacctgcgcagactcaggccaggcctagaatctccggttggccctgcaagtgcctggaggaaggatggctctggcctcggtcctcccccaaccctgcccaagccagacagacagcacctgcagacgcagggggactgcacaattccacctgcccaggacctgaccctggcgtgtgcttggccctcctcctcgcccacggcgcctcagatttcaggaccctcctcctcgcccacggcgcctcagacctcaggaccctgccgtctcacgcctttgtgaaccccaaatatctgagaccagtctcagtttattttgccaaggttaaggatgcacctgtgacagcctcaggaggtcctgacaacaggtgcctgaggtggctggggatacagtttgcctttatacatcttagggagacacaagatcagtatgtgtatggcgtacattggttcagtcagccttccactgaatacacgattgagtctggcccagtgaatccgcatttttatgtaaacagtaagggaacggggcaatcatataagcgtttgtctcaggggagccccagagggatgacttccagttccgtctgtcctttgtccacaaggaatttccctggacgctaattatgagggaggcgtgtagcttcttatcattgtaactatgttatttagaaataaaacgggaggcaggtttgcctaattcccagcttga

SEQ ID NO: 167685 - DNA, 2317 bp, Homo sapiens
ggccgtccaggccccgccccgcagcccagccggaagggccggcggacgctcgctaggtcggctcgctggccggggctccgcggctcccgtggttgccatggcggcggttgtcgcggcgacgaggtggtggcagctgttgctggtgctcagcgccgcggggatgggggcctcgggcgccccgcagccccccaacatcctgctcctgctcatggacgacatgggatggggtgacctcggggtgtatggagagccctccagagagaccccgaatttggaccggatggctgcagaagggctgcttttcccaaacttctattctgccaaccctctgtgctcgccatcgagggcggcactgctcacaggacggctacccatccgcaatggcttctacaccaccaacgcccatgccagaaacgcctacacaccgcaggagattgtgggcggcatcccagactcggagcagctcctgccggagcttctgaagaaggccggctacgtcagcaagattgtcggcaagtggcatctgggtcacaggccccagttccaccccctgaagcacggatttgatgagtggtttggatcccccaactgccactttggaccttatgacaacaaggccaggcccaacatccctgtgtacagggactgggagatggttggcagatattatgaagaatttcctattaatctgaagacgggggaagccaacctcacccagatctacctgcaggaagccctggacttcattaagagacaggcacggcaccacccctttttcctctactgggctgtcgacgccacgcacgcacccgtctatgcctccaaacccttcttgggcaccagtcagcgagggcggtatggagacgccgtccgggagattgatgacagcattgggaagatactggagctcctccaagacctgcacgtcgcggacaacaccttcgtcttcttcacgtcggacaacggcgctgccctcatttccgcccccgaacaaggtggcagcaacggcccctttctgtgtgggaagcagaccacgtttgaaggagggatgagggagcctgccctcgcatggtggccagggcacgtcactgcaggccaggtgagccaccagctgggcagcatcatggacctcttcaccaccagcctggcccttgcgggcctgacgccgcccagcgacagggccattgatggcctcaacctcctccccaccctcctgcagggccggctgatggacaggcctatcttctattaccgtggcgacacgctgatggcggccaccctcgggcagcacaaggctcacttctggacctggaccaactcctgggagaacttcagacagggcattgatttctgccctgggcagaacgtttcaggggtcacaactcacaatctggaagaccacacgaagctgcccctgatcttccacctgggacgggacccaggggagaggttccccctcagctttgccagcgccgagtaccaggaggccctcagcaggatcacctcggtcgtccagcagcaccaggaggccttggtccccgcgcagccccagctcaacgtgtgcaactgggcggtcatgaactgggcacctccgggctgtgggtcccactagcacctgcgcagactcaggccaggcctagaatctccggttggccctgcaagtgcctggaggaaggatggctctggcctcggtcctcccccaaccctgcccaagccagacagacagcacctgcagacgcagggggactgcacaattccacctgcccaggacctgaccctggcgtgtgcttggccctcctcctcgcccacggcgcctcagatttcaggaccctcctcctcgcccacggcgcctcagacctcaggaccctgccgtctcacgcctttgtgaaccccaaatatctgagaccagtctcagtttattttgccaaggttaaggatgcacctgtgacagcctcaggaggtcctgacaacaggtgcctgaggtggctggggatacagtttgcctttatacatcttagggagacacaagatcagtatgtgtatggcgtacattggttcagtcagccttccactgaatacacgattgagtctggcccagtgaatccgcatttttatgtaaacagtaagggaacggggcaatcatataagcgtttgtctcaggggagccccagagggatgacttccagttccgtctgtcctttgtccacaaggaatttccctggacgctaattatgagggaggcgtgtagcttcttatcattgtaactatgttatttagaaataaaacgggaggcaggtttgcctaattcccagcttga

SEQ ID NO: 167686 - DNA, 879 bp, Homo sapiens
ggccgtccaggccccgccccgcagcccagccggaagggccggcggacgctcgctaggtcggctcgctggccggggctccgcggctcccgtggttgccatggcggcggttgtcgcggcgacgaggtggtggcagctgttgctggtgctcagcgccgcggggatgggggcctcgggcgccccgcagccccccaacatcctgctcctgctcatggacgacatgggatggggtgacctcggggtgtatggagagccctccagagagaccccgaatttggaccggatggctgcagaagggctgcttttcccaaacttctattctgccaaccctctgtgctcgccatcgagggcggcactgctcacaggacggctacccatccgcaatggcttctacaccaccaacgcccatgccagaaacgcctacacaccgcaggagattgtgggcggcatcccagactcggagcagctcctgccggagcttctgaagaaggccggctacgtcagcaagattgtcggcaagtggcatctgggtcacaggccccagttccaccccctgaagcacggatttgatgagtggtttggatcccccaactgccactttggaccttatgacaacaaggccaggcccaacatccctgtgtacagggactgggagatggttggcagatattatgaagaatttcctattaatctgaagacgggggaagccaacctcacccagatctacctgcaggaagccctggacttcattaagagacaggcacggcaccacccctttttcctctactgggctgtcgacgccacgcatgggccatggccatcgggccggggctggccatcgagacggggggtccgagctcgattcgtatctggctacgtgcc

SEQ ID NO: 167687 - DNA, 899 bp, Homo sapiens
ggccgtccaggccccgccccgcagcccagccggaagggccggcggacgctcgctaggtcggctcgctggccggggctccgcggctcccgtggttgccatggcggcggttgtcgcggcgacgaggtggtggcagctgttgctggtgctcagcgccgcggggatgggggcctcgggcgccccgcagccccccaacatcctgctcctgctcatggacgaccgagggcggcactgctcacaggacggctacccatccgcaatggcttctacaccaccaacgcccatgccagaaacgcctacacaccgcaggagattgtgggcggcatcccagactcggagcagctcctgccggagcttctgaagaaggccggctacgtcagcaagattgtcggcaagtggcatctgggtcacaggccccagttccaccccctgaagcacggatttgatgagtggtttggatcccccaactgccactttggaccttatgacaacaaggccaggcccaacatccctgtgtacagggactgggagatggttggcagatattatgaagaatttcctattaatctgaagacgggggaagccaacctcacccagatctacctgcaggaagccctggacttcattaagagacaggcacggcaccacccctttttcctctactgggctgtcgacgccacgcacgcacccgtctatgcctccaaacccttcttgggcaccagtcagcgagggcggtatggagacgccgtccgggagattgatgacttccagttccgtctgtcctttgtccacaaggaatttccctggacgctaattatgagggaggcgtgtagcttcttatcattgtaactatgttatttagaaataaaacgggaggcaggtttgcctaattcccagcttga

SEQ ID NO: 167688 - DNA, 435 bp, Homo sapiens
gatgggggcgtgtggacctgcacgcccagtgggtgtcccaggagcctgcgaaaggaggcggggtcttggggacaacgctgagctgcagggcccaagggccacgcgtctttcagtggaatgggtgccgtgccccacccaggtggtggagacgctaacggggattgacaggcgtggcagccccttgtaaacctgcgcgtgcctcgtctgtcacgcgtctgtctactcgttggggctcttgttgacgcccggggtctgagccacacccttcttatccagtttctgtttctgtcacctccacatagcgagggcggcactgctcacaggacggctacccatccgcaatggcttctacaccaccaacgcccatgccagaaacggtaggctgcccaccgcctccagggacacccttggggtgcagggttgggcaggtgggct

SEQ ID NO: 167689 - DNA, 443 bp, Homo sapiens
cagcctgggtgacagagtgagactgtctcagaacagcaacaacaaaatgcccgctgctgctgggtccagaagagcttgaataactgcatgttctttttctcaattttcatttcccagaactgggcacctccgggctgtgaaaagttagggaagtgtctgacacctccagaatccattcccaagaagtgcctctggtcccactagcacctgcgcagactcaggccaggcctagaatctccggttggccctgcaagtgcctggaggaaggatggctctggcctcggtcctcccccaaccctgcccaagccagacagacagcacctgcagacgcagggggactgcacaattccacctgcccaggacctgaccctggcgtgtgcttggccctcctcctcgcccacggcgcctcagatttcaggaccctcctcctcgcccacggcgcc

SEQ ID NO: 167690 - DNA, 551 bp, Homo sapiens
  misc_feature (500)..(500): n is a, c, g, or t
  misc_feature (502)..(502): n is a, c, g, or t
  misc_feature (536)..(536): n is a, c, g, or t
atattttctgccctggaaaacccagaggagacacacttgggttcgaggcatgacccgcaaaactctcctgggagttcagaaaacgtggaaggaaggagccggggccacgaggggcatgtcaggcgggttccaggcggctgggaggctcctcacgatgcaccacccttcaccgtgcagggaaccccggccgccgccatgcctgccgccctcggttgtgcccagacgctctgcagggtaggcgggcagtgccagcaccctcctcgggtgaggccttggtcttttgtccctgccgtgcccaggcatagcccatactcagtgctggagggtgctcgtcttaccaagaattttgtgaaggtggtatctgttgctgctcagaacttccgagtgtccccacgtggggtccctgaagtgtcctgggttcctgtttccaggcatctgggtcacaggccccagttccaccccctgaagcacggatttgatgagtggtttggatccggccntnagggcctgatccgtttagggggcccccgaaaccngcttttgttcccttt

SEQ ID NO: 167691 - DNA, 2156 bp, Homo sapiens
cgtgcggggagggggaggccccctcggggagtggccgcggtgtccaggcgtggggtctcggcggtcaccgatcaccacacgcgctgccactgtgctgcatgaccgggacagcgtcctccctggcagcgagggcggcactgctcacaggacggctacccatccgcaatggcttctacaccaccaacgcccatgccagaaacgcctacacaccgcaggagattgtgggcggcatcccagactcggagcagctcctgccggagcttctgaagaaggccggctacgtcagcaagattgtcggcaagtggcatctgggtcacaggccccagttccaccccctgaagcacggatttgatgagtggtttggatcccccaactgccactttggaccttatgacaacaaggccaggcccaacatccctgtgtacagggactgggagatggttggcagatattatgaagaatttcctattaatctgaagacgggggaagccaacctcacccagatctacctgcaggaagccctggacttcattaagagacaggcacggcaccacccctttttcctctactgggctgtcgacgccacgcacgcacccgtctatgcctccaaacccttcttgggcaccagtcagcgagggcggtatggagacgccgtccgggagattgatgacagcattgggaagatactggagctcctccaagacctgcacgtcgcggacaacaccttcgtcttcttcacgtcggacaacggcgctgccctcatttccgcccccgaacaaggtggcagcaacggcccctttctgtgtgggaagcagaccacgtttgaaggagggatgagggagcctgccctcgcatggtggccagggcacgtcactgcaggccaggtgagccaccagctgggcagcatcatggacctcttcaccaccagcctggcccttgcgggcctgacgccgcccagcgacagggccattgatggcctcaacctcctccccaccctcctgcagggccggctgatggacaggcctatcttctattaccgtggcgacacgctgatggcggccaccctcgggcagcacaaggctcacttctggacctggaccaactcctgggagaacttcagacagggcattgatttctgccctgggcagaacgtttcaggggtcacaactcacaatctggaagaccacacgaagctgcccctgatcttccacctgggacgggacccaggggagaggttccccctcagctttgccagcgccgagtaccaggaggccctcagcaggatcacctcggtcgtccagcagcaccaggaggccttggtccccgcgcagccccagctcaacgtgtgcaactgggcggtcatgaactgggcacctccgggctgtgaaaagttagggaagtgtctgacacctccagaatccattcccaagaagtgcctctggtcccactagcacctgcgcagactcaggccaggcctagaatctccggttggccctgcaagtgcctggaggaaggatggctctggcctcggtcctcccccaaccctgcccaagccagacagacagcacctgcagacgcagggggactgcacaattccacctgcccaggacctgaccctggcgtgtgcttggccctcctcctcgcccacggcgcctcagatttcaggaccctcctcctcgcccacggcgcctcagacctcaggaccctgccgtctcacgcctttgtgaaccccaaatatctgagaccagtctcagtttattttgccaaggttaaggatgcacctgtgacagcctcaggaggtcctgacaacaggtgcctgaggtggctggggatacagtttgcctttatacatcttagggagacacaagatcagtatgtgtatggcgtacattggttcagtcagccttccactgaatacacgattgagtctggcccagtgaatccgcatttttatgtaaacagtaagggaacggggcaatcatataagcgtttgtctcaggggagccccagagggatgacttccagttccgtctgtcctttgtccacaaggaatttccctggacgctaattatgagggaggcgtgtagcttcttatcattgtaactatgttatttagaaataaaacgggaggcaggtttgcctaattcccagcttga

SEQ ID NO: 167692 - DNA, 2660 bp, Homo sapiens
ggccgtccaggccccgccccgcagcccagccggaagggccggcggacgctcgctaggtcggctcgctggccggggctccgcggctcccgtggttgccatggcggcggttgtcgcggcgacgaggtggtggcagctgttgctggtgctcagcgccgcggggatgggggcctcgggcgccccgcagccccccaacatcctgctcctgctcatggacgacatgggatggggtgacctcggggtgtatggagagccctccagagagaccccgaatttggaccggatggctgcagaagggctgcttttcccaaacttctattctgccaaccctctgtgctcgccatcgagggcggcactgctcacaggacggctacccatccgcaatggcttctacaccaccaacgcccatgccagaaacgcctacacaccgcaggagattgtgggcggcatcccagactcggagcagctcctgccggagcttctgaagaaggccggctacgtcagcaagattgtcggcaagtggcatctgggtcacaggccccagttccaccccctgaagcacggatttgatgagtggtttggatcccccaactgccactttggaccttatgacaacaaggccaggcccaacatccctgtgtacagggactgggagatggttggcagatattatgaagaatttcctattaatctgaagacgggggaagccaacctcacccagatctacctgcaggaagccctggacttcattaagagacaggcacggcaccacccctttttcctctactgggctgtcgacgccacgcacgcacccgtctatgcctccaaacccttcttgggcaccagtcagcgagggcggtatggagacgccgtccgggagattgatgacagcattgggaagatactggagctcctccaagacctgcacgtcgcggacaacaccttcgtcttcttcacgtcggacaacggcgctgccctcatttccgcccccgaacaaggtggcagcaacggcccctttctgtgtgggaagcagaccacgtttgaaggagggatgagggagcctgccctcgcatggtggccagggcacgtcactgcaggccaggtgagccaccagctgggcagcatcatggacctcttcaccaccagcctggcccttgcgggcctgacgccgcccagcgacagggccattgatggcctcaacctcctccccaccctcctgcagggccggctgatggacaggcctatcttctattaccgtggcgacacgctgatggcggccaccctcgggcagcacaaggctcacttctggacctggaccaactcctgggagaacttcagacagggcattgatttctgccctgggcagaacgtttcaggggtcacaactcacaatctggaagaccacacgaagctgcccctgatcttccacctgggacgggacccaggggagaggttccccctcagctttgccagcgccgagtaccaggaggccctcagcaggatcacctcggtcgtccagcagcaccaggaggccttggtccccgcgcagccccagctcaacgtgtgcaactgggcggtcatgaactgggcacctccgggctgtgaaaagttagggaagtgtctgacacctccagaatccattcccaagaagtgcctctggtcccactagcacctgcgcagactcaggccaggcctagaatctccggttggccctgcaagtgcctggaggaaggatggctctggcctcggtcctcccccaaccctgcccaagccagacagacagcacctgcagacgcagggggactgcacaattccacctgcccaggacctgaccctggcgtgtgcttggccctcctcctcgcccacggcgcctcagatttcaggaccctcctcctcgcccacggcgcctcagacctcaggaccctgccgtctcacgcctttgtgaaccccaaatatctgagaccagtctcagtttattttgccaaggttaaggatgcacctgtgacagcctcaggaggtcctgacaacaggtgcctgaggtggctggggatacagtttgcctttatacatcttagggagacacaagatcagtatgtgtatggcgtacattggttcagtcagccttccactgaatacacgattgagtctggcccagtgaatccgcatttttatgtaaacagtaagggaacggggcaatcatataagcgtttgtctcaggggagccccagagggatgacttccagttccgtctgtcctttgtccacaaggaatttccctggacgctaattatgagggaggcgtgtagcttcttatcattgtaactatgttatttagaaataaaacgggaggcaggtttgcctaattcccagcttgaaaaaaccaaaacacacacaaacaaaccacacccaagacacaaagagcacacagcgagagagcaagaaccgacacacgcggcagcgcaagccgcgcagcacaccgggccccactggacccacaccaaggaaaccacacgaagaccaccgccaacacggaacacgaacgcgaccaagcaccccacggcacacaccaacagaccaacagcccacaacacaccgcccacacggaggacacaacgacacacaacagcggcggccacgcaagacgacacaaccgcgccaacacac

SEQ ID NO: 167693 - DNA, 1023 bp, Homo sapiens
ggccgtccaggccccgccccgcagcccagccggaagggccggcggacgctcgctaggtcggctcgctggccggggctccgcggctcccgtggttgccatggcggcggttgtcgcggcgacgaggtggtggcagctgttgctggtgctcagcgccgcggggatgggggcctcgggcgccccgcagccccccaacatcctgctcctgctcatggacgacatgggatggggtgacctcggggtgtatggagagccctccagagagaccccgaatttggaccggatggctgcagaagggctgcttttcccaaacttctattctgccaaccctctgtgctcgccatcgagggcggcactgctcacaggacggctacccatccgcaatggcttctacaccaccaacgcccatgccagaaacgcctacacaccgcaggagattgtgggcggcatcccagactcggagcagctcctgccggagcttctgaagaaggccggctacgtcagcaagattgtcggcaagtggcatctgggtcacaggccccagttccaccccctgaagcacggatttgatgagtggtttggatcccccaactgccactttggaccttatgacaacaaggccaggcccaacatccctgtgtacagggactgggagatggttggcagatattatgaagaatttcctattaatctgaagacgggggaagccaacctcacccagatctacctgcaggaagccctggacttcattaagagacaggcacggcaccacccctttttcctctactgggctgtcgacgccacgcacgcacccgtctatgcctccaaacccttcttgggcaccagtcagcgagggcggtatggagacgccgtccgggagattgatgacttccagttccgtctgtcctttgtccacaaggaatttccctggacgctaattatgagggaggcgtgtagcttcttatcattgtaactatgttatttagaaataaaacgggaggcaggtttgcctaattcccagcttga

SEQ ID NO: 167694 - DNA, 757 bp, Homo sapiens
caaacatctctttagcaagagtgattgcagatattgaactgaagtccaatatttcaataggccttttatttttgcctactggttaatatgagggatgtctgggactagacacgaatgggaggaagaggaatattgatgtaagaaaggaaaacaataagcaatgccctggtcagtagcagaaagtccgtgtgtacttaaatgctaactcctgagaaattgagagattacagtctgtacaagtctggaaaacatcttcctgaagttagaatgtatgtcaaataactgcattccaaggtactctcatgctgtctcctcaaactctgaagggtgaaaaaacatatcacatcccttatctcatatttaaattttaattggaattaagttcttatcaataatacctggaacaaactgaggttaaaaattttcacagtggaaaacaaccattcaaacatattctctaatgaaaaaaaaggtattatctttagagatctttccagcacctgacacactgctgggcccatagtttgttgaatgcaaataactctggcttggatagggagtataatactagagaattgacgagagactataattcagaccatatttttggttgggtacagttggaaccaagaaaagtctttcactcacttttttttttcttttttttcccactcactttgatcatgcatttcccggtcccttccttttttatataatgctgcagcactaaaacgcattgatgtcttctgaaggattt

SEQ ID NO: 167695 - DNA, 236 bp, Homo sapiens
cagcacgccctggcctcgcggcttcccgctggcgggggtcgccgcgtctgtgaatggggaccacagttctcttgcctcgggcgggtctcgtgggcgtaaattgacttcaggcccgggctgtccgcgagggcaggtgtctttattctctctgggcacgctcggacgggaggtctggggcgccggggcagcaccgtggctgagcggaggccaggactgccgggaggatgccccactgc

SEQ ID NO: 167696 - DNA, 670 bp, Homo sapiens
gctgaggcaggagaactgcgtgaacccgggaggcggagcttgcagtgagccgagattgcgccactgcactccagactgggcaacagagcgagaccccatctcaaaaaaaaaaaggctgtctcctaaaggaagggcagcatgactttttgcaggtgcagcttatcacagtgaagcagacacggtcggccatgttagttgtgttaaccggcatgtgatgtgaagtgccctggctaccttgtctgtctggggaactctgttctcaaaggcttttgcttttcacaccaggcctactttgacagatctccggctgaatccatcttttcatcttttggccaatgtattttcctcactttccgttttgtgacgagcagtttagttgctggtttgacataatctttgacattcaagttcagaaaatgatgaaagctagaaaatggggaagctgagagagaatgcctgattccttttagtatgtccttctaccaaaataatttctgttttaaaacatgtaggcttaatatttccttatgatattaaagacttttttcatgctgagtttatttctttgaaatagaaatcagtaagtgttcattttagctgtttaaatgagcctatctttttttttttttcggggggtggtaagttagagtctcactctgtcacccaggct

SEQ ID NO: 167697 - DNA, 678 bp, Homo sapiens
  misc_feature (103)..(103): n is a, c, g, or t
  misc_feature (117)..(117): n is a, c, g, or t
tgttgcatgacatcgaggtttagggcacagatggtcctgtcacccaggcagtgagcatagtacatgataggtagtgtttcagcccttcctcttccctctctcnccatctagtagtcnccatctttatgtctgtgtgtacccagtgtttagctcctgcttatagacgacaacatgcggtatttggttttctgtattaattcacttaggataatggcctccagctgcatccatgttgctgcagagaacatgatttcattcttttttatggctacatagtattctatggtatataagtaccatattttctttatccagtcctcctaggttgataccgtgtctttgctattgtgaatagtgctgtgatgaacatatgagtgcatgtgtctttatggtagaataatttattttcctttgggtgatatacctagtcagtatgaattgctattccacatgaggctggctcaaaaatcccactttgaggccttatcaaaataaataggtcatttagacatctgtgtcacttagacacagagcctgtgggagaaatgaaatagaaaaaggtcccaggttcagcagggagcctcacgtggccatggcaaggctgtgcccagagaatgtgccacttcactctccacgcttttcatatttaaaagtcagctatttcttccaagccttttc

SEQ ID NO: 167698 - DNA, 454 bp, Homo sapiens
tcggagcagggcagagggcgttgcgtataaactgcctctcatttatcctcaagcctgattacctaagtgaactgttatgttttcttctttctacctggaatcctcttaaaccagaggcagatttgacctaagaagtatgcaatttagttgcgtctacatgacccaatatggaaggaagttttggcaaacacccagttaatctagtcagtatgaattgctattccacatgaggctggctcaaaaatcccactttgaggccttatcaaaataaataggtcatttagacatctgtgtcacttagacacagagcctgtgggagaaatgaaatagaaaaaggtcccaggttcagcagggagcctcacgtggccatggcaaggctgtgcccagagaatgtgccacttcactctccacgcttttcatatttaaaagtcagctatttcttccaagccttttc

SEQ ID NO: 167699 - DNA, 226 bp, Homo sapiens
atctaattggttggcatacaattcttctcaatattatgttataaccctctctcgtttctgtgagtttggcagtaacatctcttttattcctgatttcagtaatttgagccttctctcttttttttccccttggtcagcctttattgtattcatctcaaagtaattttctaatttctcttttgattcctctttgactgattatttaggaatgtgctatttaattttc

SEQ ID NO: 167700 - DNA, 350 bp, Homo sapiens
cttgatctttctagtgaccagcctctatcctgaagttatcaaggggcccacaaagagtcacatcattagaacaaaagatgctcctctacctaggaaattccaagggatttagcagctgtgtgccaggaacctgggacaaagatcaaatatatatcacaataggactgttgttgttttcattttgtcttcagcatccattagattgtgtgggacataataagtgcatttaatgtttgttgaataaatgaatcgagctggccttgatacttattcttctgaatgttaaatgctgcatctatggagatttgaaggaaagggttctgactcaagacttctggacctttattagt

SEQ ID NO: 167701 - DNA, 293 bp, Homo sapiens
aagatgtcaaaagtttctagaaggatcccacagtgttatctctgtgaaatggaaatgggggtgggagatgaaagggaagtgttttataacattttaaacaacaaatatatattatgttcattagtttgaaaaactaattttaaacatgtttaagaatagaacctgacaaatatctaagaatcacaggtattgtaacccacccaggagactccaaatagggctgctttacacatctaacagggcagcatcaatttggtctctgaggaattcagcatctgaattgtcttatttaa

SEQ ID NO: 167702 - DNA, 368 bp, Homo sapiens
gtgcaatgagtgtggcaagaccttcagtcatatgtcatcctttgtatgccatcatagacttcatactggagaaaatccttataagtgcaatgagtgtggcaaagcctttagtgggcagtcatcacttattcatcatcaagcaatccatggtatagggaaactttacaaatgtaatgattctcacaaagtcctcagtaatgctacaagcattgcaaatcattagagaatccataatgaagagagatcttacaagtgtagtaaatgtggcagatatttcagacattgttcatagcttgcagttcatcagtgaactcatactggaaagaaacgttacaaatgtcatgattgcagcaaggtcttcagtcaag

SEQ ID NO: 167703 - DNA, 102 bp, Homo sapiens
catgaactactgtgcccagtctagaatttttatttcatcatttaacttcaggggtgacactgttcagtaagacacacacacatacacacacacacacacaca

SEQ ID NO: 167704 - DNA, 327 bp, Homo sapiens
ctgaaagccccgccaacactgatgacaaatgaaatggatgttgaatgtactggtatttgaccagtatgagttgctgagccccagtttggctggttatgcctgctataaaatactgaattgcagtgtgtcaatcacattagttgtaggagaattagatgtgtacaccatatagaagtagcttagagctataagaaaaatcaggcgtttgttgagataaggcattttaaaaagatttccgacgcttttcaagataaggttgtgtagaggtgaaattgagtttagagtgttgggaggaaaagtgaggagattctgtggggctttgttatt

SEQ ID NO: 167705 - DNA, 480 bp, Homo sapiens
acatatcttttttggggtacccagttcaacccataacagactctgaatagcccctcaaaaattgaaaaataaagaataaagttagaggaatcacatttctcaatttaaaaatttacatcaatccagacggtgtggcgcttggatatagattcatggagtatgatcattagtttaaaaataagcccctacctttatggtcaattggttttgacaaggataccaagataattaaatggtgaaataattttttatcccccacaaatggtctcagacagctggatatttgcatgcaaatgaatgaagtttaactcctacctcataccatctacaaaaattatgtcaaaatggattaaagacctaaatgctagagctaaaacaagtaggagctaaaactcctaggagaaaacataggagtaagtttttctgaccttgggtaggcagtggcttcttagatgtggtaccaagcacacaagcaacaaa

SEQ ID NO: 167706 - DNA, 156 bp, Homo sapiens
gggattagaggctacagtgaggtaggattgtgccactgcactccagcctgagtgacagagcaaaacctcatctctaaggaactcttgagttctgctctaaagaattgattttctcccagtctaagtaaataactctatcatacacccagtttctta

SEQ ID NO: 167707 - DNA, 150 bp, Homo sapiens
ccaagttgtttatgagctgggtgcagaatagaattagccaagaacgattctggatcgcttaatacgaagaagccaggggaaagaaacacacaggtcggggagcgaatagggtgagatgaggtggcctgaggagatgagagctgggagccc

SEQ ID NO: 167708 - DNA, 315 bp, Homo sapiens
ctatttcacattatatggatactgtcttagaagatgtggacattatagttgatttaggtaagctatcaatattagattgctaagaggacaatctgattcctttttaaaaattaattacttaattatttttaaatagagatgaggtgtcgccgtgttgccaagactgttctcaaactcctggggtcaagcaatcctccctcctcagcctccctaagtgctgggattacaggcatgagccacaacgtctagcctttgttcttttttaaagctttattttcacaactattttatgaaagagaatagagacactactcc

SEQ ID NO: 167709 - DNA, 367 bp, Homo sapiens
agagcactgatcaacagtcatttattctgtgctgcaaaatattgctgaaacctgcttaattataggagagtggtgaaatctttgcatctccacatggtgggatactatccagtcttaaaattcatattttaaaagaaaagctgggtgtggtggcacacgtctctagtcccagctactcgggggctaagatgggaggattgcttgagcctaggggtttgagaccagccggcaacatagtgaggccctgtctctttagaattaaaaaatgtttaataatttaaaaaaaaagtacacgggaaaatgctcctaatattaaatgataaaatcaagttatgcaactacatattcaatatgctgtcaattttgt

SEQ ID NO: 167710 - DNA, 659 bp, Homo sapiens
aggattcccctcacccatcagtgtgaagggttggatggcttatttatgtccaaattcctgcggcaggtgttcagtgtcgtctggggtgaggttggagggaacctgcctggtgtgggagctggggtcatgatgggagagggggctgactacaggggccacacacagacagcacatttgtcctggcaggttggctggtctgccaaatgcatgtaccatctccaaaggaggtctcagggggacaaaatcttctcagaggacactactgggggtctgtgaggtggtctggggaatagcatcctttttttgagatggggtcttgctctgtggcccagactggagtgcagtggcacgatcatagatcactgcaacctcaacatccagggcccaagtgatcctcctgccttggcctcccaaagtgttgagataacaggtggcacctggcctgagaggagtatttttatgtccccaaaccacaaatttgcccacatggatgcatccgtcccacgtgctccatttccacattgcctgtagggcagctcatgtctgcagattgagtagcagtcctgggtccagacaagccaagcacccactccagggaccgactcgggtagcacatgaggtatactgacctcctgacaagccctgagcaattctgtgac

SEQ ID NO: 167711 - DNA, 615 bp, Homo sapiens
cttggaatgggtaccttattcatggcctccttacatagagggagcagattcaggacagaggctctgcacgctcctgggtccctcctaagcgagcactcccctccactgctcctcctgttcggcatgctagattttctgtgcacttgcagtcatacggaaactggcttccttcttagctgtgcgtgtgaaagtcaccccagtgtttcacctgcagtgtgagtgtaatttggggtcccatgacatgatcatcttccttttgatttctaaagctagggtcagggaaggggactcgttttgagccaaagggcattttaagggcatcatttcatatgttcactgtctgcagccaacactgcactctagacaaatgggtacctttatgtcccatttattaagacatcctgcaaaaggggctcctggcccctgtgggaagcttgaaaggaacagaccatatcctgtttctttttgctcatacctctgtggtgagatcttattctgaccccatagtctggtgccatacctgtgggtccctgtatctcctagaattccccctatgctagtgtttagcccgtgtaatgacagttatctgtccacagggctgtatcccccgccagc

SEQ ID NO: 167712 - DNA, 604 bp, Homo sapiens
cactcccgccctctgacatcagattgtgggcactagatcccgcttggtggtgaaccgggtgcgtcagaacccagggattaaatagctttcgaaatccatcggcttgtccttgaccagccagagggccagggcacgtgcccagacctcctgccagctcagggataggggaaaacaccatccatgcacacattcgaggcagctgcagagagccgcccacagtgggtcacagcccaggcccaagactgatggtcctggcccaaagtgctctggagacctgagctcccgagacgggggttggttggaggctgggggctgtcagaacctctctccaggcacccagctaggggctgaggaatctgctctgccagctgttttcacagtgggaagcaggtggcttgcacaggcctttgggggaccccatatgttgaggtaggaaacgctgtggtgtggcgggggagggagcaaggggtatccttcctctgcacccaggggccatctgctttcaaatccagccacttgtcctccttcctggtagcaatatggagccacccagactctgctagacatatgagtgctaaagataaaaatactcaaaggacatatg

SEQ ID NO: 167713 - DNA, 1028 bp, Homo sapiens
taacccacatttatggaaatagaagtttgtcttgcagaaacatcagctcattttgtaaggtgtatgtgatatttaaatttgtgatgcttgtgaataagggaatggggctttaggtctgaggaaaggggagcattcattcaaactggagggtattttgcatttttaaggctgctataaggtcacgaccttggtgagacttaacctgttttcgtatgtattgtgtactttctgttctaagccattgtgtgtgtctgtaactttctccaagattctctccaaatcttgcttctcttaatttctccagattgtgccaacctatttcccactcctgatctttagtgttatatcaccactaggagactggggaatgtggtttgtgttcttagactcaacagatacctaccatatgccaagcattcttctaacagctagtgagagatctatcagtgaacaaaacagacaaaactccatcttttttcctctgctgctcatattctagtgttaaccatttgcatatttctcagactcttcaatacatttattatttctttttaatcagtttattctgaccctcagtagatgacatatttcatgggtgtagggacagtgccatctatctcccttggggtgttcttacattcaagaaatgggttttcacacaagtcctgtcaaatacttaattccttacacaatataaagggattgagtttttcaaagataggctgactacttggaatgaaaagcatttaaatactgaagagagaaaaaggattctcttttcaacccttcatattctcggaaggaaaactgaaataccgagttagtatgtcctcaaccctggttaatttcccttgcaaacaaagagggacaggccttggtgtcagaagctttgccataagatgttacctagctaggatttttaaactggttttcattgtattttattaccttcaattaagaatagtttaaaacaagtagttttccatttatagcagtaaaataaatttgttcaagtatagcactgaatg

SEQ ID NO: 167714 - DNA, 245 bp, Homo sapiens
aatatacttaaccctccatttgcagatattatgtaatttgcctgataccacaggactaactaatgatagatccagaatataaactcaggcttttctaatccaaaggtcacaatttaagcactaattgcatatagtttttcttgacttggcattcaagggatgggaaaactcaatagaagactcttgcaatagcccagataacgtgtagatagttagcagagggaatgaacagtagtgaacaaaac

SEQ ID NO: 167715 - DNA, 181 bp, Homo sapiens
tgacccagcttgggttacatgcctgcttctgggactaatcattgtggctagagggattggcacttgactggccaagctggggtcatgtgtgcaccctagtttggcagttggacaagaaccatgtgtgatggggaaggaacatttctccaacagagaggtgctgggtatacgagaatgttgg

SEQ ID NO: 167716 - DNA, 640 bp, Homo sapiens
tctacagaggtgtaatttgacataaattgcacccatttaaaatgtataatttggtacattttgatgtttgtacctgtgaacctttaccacagtcaaggtgagtatactgattacccccaaaaggttcctcgtgcccttccctgcccctgggcaaccattcattggtgttgtcactgtagattagtttgcatcttgtggaatttaatataaatagaatcatgtggtatgtcttctgtctgcttctctcatgaaggggtgggttgcccctccacacctgtgggtgtttctcgttaggtagaacgagagacttggaaaagaaaaagacacagagacaaagtatagagaaagaaatcaggggacccagggaactagcgttcagcatatggaggatcccgccagcctctgagttcccttagtatttattgatcattcgtgggtgtttctccgagagggggatgtgtcagggtcacaagacaatagtggggagagggtcagcagacaaacatgtgaacaaaggtctttgcatcatagacaaggtaaagaatcaagtgctgtgcttttagatatgcatacacataaacatctcaatgctttacaaagcagtattgctgcccgcatgtcccacctccagcccaaggcg

SEQ ID NO: 167717 - DNA, 521 bp, Homo sapiens
tgacaagataaagaaaatatggatgacagtaataagtaggtgggtagtaaataggatttaacatattccccagctttcctttaaagggaaggtaaactaagaacaatgtgatttcctgtctggacagaagtggcatctcaggttaatacatcttaatacaaagacaagattgagctgttttaaatagaatcccttggcttcctgaaatcctcctattagtagagcagggttgggaataatctttcactgacagaccagctcatggctggaggcacttaagaaatggtttccatctctaggagatgatcagggtagtggatgtttttgctggctaaaagccagcatcggaaaaacaatgtaagttgctaattctatacaataagagctaaatttcttttcaactgctggtacattacagctatgtggctgtggttttctgggtatctattctgccctttgaagttttgagttacccaagacaagaagccaattgcttcttggccttctggctaagatcaaat

SEQ ID NO: 167718 - DNA, 343 bp, Homo sapiens
tattgtggcacatgcctgaaatcccagctactcgtgaggctgaggcatgagaattgcttgaatccaggaggcagaggttacagtgaggctgagatcacaccactgcactccagcctgggctaccgagtgagtctgtcttaaaaaatatatacaaactaaaagtcattagtccttgattttggtctcaactctgccaaccccaagctatgggacaatttaaagccactcaaattcacttacttcagtgtactcatctgatctacagaattactaagccttttctcctctaaaagtctaggattccattccagcctaccaagtgttctatggcactcatttgctg

SEQ ID NO: 167719 - DNA, 227 bp, Homo sapiens
ctgacaacacgtgtccaaggtggtcagggtacagcttgcttgtatatattttaaggagacatgagagttgtctgtattttggcaactaccaagtatattcctctcccttgagcctcaaactgataagcccagatgtataatccaaatgttcacttggatgtctcataggtgctgtgaacctcaaacacacaaaatagagctcctggtctccactttcctcaaaacct

SEQ ID NO: 167720 - DNA, 173 bp, Homo sapiens
gccaacatcagacatgagtggttcctctggtgtttctttcataataaaaacccatacctggattcaacgtctaaagacatgggtactaaatctcacctctgtaacatagagctgatcatttaacctttgaagttccctatggacgctgaagtacccaacctcatgaaataata

SEQ ID NO: 167721 - DNA, 231 bp, Homo sapiens
tggttaaccttgtattgctttggctttcttctttatttttatgttgattattgattatgaaatattttagaaagtaggaagaaaaagtgtgttgcatattctgtttattaaagagatgatcattgcttatatgttgaacatttatctctaattaattatggattttcattattaaaacacaaaaagtgaaatttttttacaaataatttcaatttgcttgagaaaaagagg

SEQ ID NO: 167722 - DNA, 266 bp, Homo sapiens
tcttgatggtcatgtgccaatcaaaagacctgacaaactcaaaaattagagattaatgttcttaaacaacaaactaaaataggttttggaaaaataaatggaaaaatttctagcctctgcaggtggactgttgtcaattgcaaacaagcttaaatttagaaatttgacatagttttggagaaatgtgatgaagtagattaaacagaaaattcagaatagcctgaatttggatctccattttacatagctgattggttaatattctt

SEQ ID NO: 167723 - DNA, 386 bp, Homo sapiens
  misc_feature (28)..(28): n is a, c, g, or t
  misc_feature (95)..(95): n is a, c, g, or t
gggtctgtgggtcctttcaggtttcctnatttattcctgaagtcattctggagaataaataatgatgtgagcttccacatgctgctttgtctgtngagtcaaagttgcagtctagtcctgcctctcatcctccatgatctgatgcccaaatttttggaaatgggagagggagatcatccgcccctgaacacatgcccccactggggaaactgaaggtctagattatgggagaagattccaaccttacctggagctgactctatttagagctgagcaaaatataggcgtagaggaaacaggggaaaagccctgtgagctcattgggccttctagcaaaccatttctgcctggcctcacaggggtcctttggcagggcagctagaggc

SEQ ID NO: 167724 - DNA, 423 bp, Homo sapiens
ttttgtgaaatagaatatagaataaggccatttaacatgagctgtcattgtacagccagagatggaattcatgggtgcatcgtatcactgtgcaaattttctgattggcagtctcaggtctcccctgaaagtgttggcctctccttccgcctcggggctcctactgcctccccgacctttgcctagagcgtcctccccctccaaatgtctctgttttgggaaaatatagcctcttttggctgcaaccctcatctggcattggattgtcctttttagctttctgcaagcatcttccctctccagctagattttaatctttcagaggaaaaaagaaaaacttctgtgggatccccaaagctcccggcatttgactcacaaggtggagctcagcaaatagaaagtgaccagaggaacaaaagcctt

SEQ ID NO: 167725 - DNA, 282 bp, Homo sapiens
ggagcaggggcagcagagcaggatgagcaggaatgcaataatcaagatgatccagaatgagaaggaagcggaagacaaggctcagtgtgagaccagggtcagagctcagcaaacttccacgactggctttgaatcagaatcattttgcttctcagccacggcccctgggttacacagccttaaatggccctgccaatgctggtcacagcattcccgagtcctgaacactccggaactaaaacaatcaattcccctgagcaataaaattatggacagtgaaca

SEQ ID NO: 167726 - DNA, 318 bp, Homo sapiens
tcaagatgttatccctttcccaaggtttcctcattcatgccttttatagctggaagatggttaaggaaaagcaccccccatggcagagacactgcacatgattgtgcatacagcagaatgcatgtttggattttagtagtgcagatttcaatatgtaattgttgtcccctagcgggatggtgagcgggacaattttcttttaggagaccgaggctttttaggagatcttgtgccactcctgcttcttcctcactcactcctctttgctcatttttctgccaacgattcgtcatgtatttctaggactatctgctcact

SEQ ID NO: 167727 - DNA, 755 bp, Homo sapiens
tctcagaacagaaacaaaaacaaaaaaccactactgataaagtatatacctgtgaatttaaataactgttgaagagaaatagtaatttataacacgaacatataaggcaatagagtagttgatgccaatagataaatgaaaccacagggtaggaaatctagtaggtagggaagtaagtagaaataaaagaatggaatccaattgaattcaggaaggaataacatgaaagaagaaatggtgaccatttaagtaaatctgactgtataagacaacgatagtaataattcaaaatgaagttaaaaagactggagaaaataatatgttaagatgagaagggcttgattgaagttaaaacattctaagatttttatattgtttaggagaaggatatagataacaattaactttatgttttgttaagtcaggtatgattgttaaaaattatacgggtaactaaaacagtgaatagaatgtgtaacttcaaaacaaatagatggaataaagggagaataattcagtataatagaggaagagaagtcgataggtgtaaagtaaatgaattaggtggtagaaataaatccaaatatatcaataattacaaaaaatataagtagagtaatattagcagctaataggttaggttgcattttttaaaatacagttatgtgctattttagactgtattgggagaaaatttaaaataccaagacacagcaaaattgaaaggaaaagggtaggggaagatacctggcaaa

SEQ ID NO: 167728 - DNA, 496 bp, Homo sapiens
cgcaagcctgtagtcccagcaactcagaaggctgaggtaggaggatcacttgagcctaggaggtcaaggctgcagtgaaccatgattgtgccactgcactccagcagcctaggcaacaagtgagaccctgtttcaaaaaaaaaaaatccccaagtcccttttccagacagtctgtagtcttagctatgtagtcatagctctggagtcttcagcctgtgtgaatcctgcttctgttcatcttactcccccacccagtgttgactttccgtagtccttcaagaccagttcagagtgcttctatagcaaccccaatttcagttatattgttcccttttctcctgatcccaattttagaaacctggtctaaagtggctagtaaagacaagacctctgttgggagaaaatccattgcagttggtcataacactttgaaattctgcactaatcagaccagtcttgatcccgttgagtgtagttggtatgcgcacatgtatta

SEQ ID NO: 167729 - DNA, 363 bp, Homo sapiens
aaaggaatttctagtctttcattcttctgctccagtgatggacacaaacttaccaaagaatacatttaagtagctcagcacagtttataatacattctctgtgccctggaaattgtccagtggctcccatctattttccagatagcttcagaattgattaggatttgagcaggagcggcacatcacccatctgctcctgtatcagcttggtttcctgtttcttgacattagcattgccacccatactccaaccctgaagcttctcatggtctcatactagttcagtttcatgcctacttggatggttcttgtggaagtaagacagagtacacataaaacattaatgtaatgcccaccacataa

SEQ ID NO: 167730 - DNA, 250 bp, Homo sapiens
cactgtttataacattgtgcagggtccagctcatcccctgttattggccatttatgttgttccaactgattctctgttgttggcccctgaagtcccaccgtctaattccttttgaacattcaagtagcttttcatgattaaggctcagagtatagaaagaacagctgaataggaattgaacattttaaaatagggagaaaggactcataattctaaaagccagactaaagggctgcaaaacagcccttcg

SEQ ID NO: 167731 - DNA, 420 bp, Homo sapiens
cacgaatgcgatatggcacagcagccgctcatagacctcaggcttgttgccatgcatagaagatgcacaccgcagagtggaggccgcaggcagggaagtaactggcatgaattattgactgtgtgtgaggccctgtgcggggagattcacttgttccttcctttattcattcattcactcactcattcctttcatgcagctcatgttcagtgagtgcctgctgtgtctcagatacatttaaccctcactaactctgtagaaactgaggctcagaaggtgaatgcagggcgaggtagcttgcccaccatctcagcttggacatggcagggcaaggggcttccgatcacgcctctcagacccagagtctgcttgtctccattctgcctgctctggagcccccagttcttccagctgcatctc

SEQ ID NO: 167732 - DNA, 415 bp, Homo sapiens
cagaatcaaatgtgattttatcatggcaatggaaagctggttcaatatttgaaaatcaaccactgtaatccaacatattgacagcctaaaaaagaaaaatcatagatcctgtcaattaatacagaaaaagcatctaacaaaactcaacacccattcatgataaaatttctcagtgaattaggagtagaagggactgtcctcaacctggaaaggacatttacaaaaacctacagctcatgtcatacttaatggtgacagatcaaacactttctcaataagatgaagaaaaagaggccagacgaggtggctcacacctgtaatcccagcactttgagaggccaacacaggaagattgcttaagcccaggagttcaagatcagcttggacaacatagcaaggcaccaattctacaaaa

SEQ ID NO: 167733 - DNA, 295 bp, Homo sapiens
caccccgcacccgccaggaactgatcaggaaggaacaagaaggacatggttctgtcctcagggaacttggggataaataacatatgcaattaagatgtaagacaaaatatattcgtataaagtgcaaaaacacaggcacatcactctctgccttcagaagtgagggtgccagagcttggtgcctgggagtggcccgcagagggttcagggctgctgtgtgttcaggttgttcatctggctctgctgatgaggctgagtgcaggctgtgaaaattcatcaagctgatactttaagt

SEQ ID NO: 167734 - DNA, 107 bp, Homo sapiens
gatctttgctggtgcctttatatctttcaagtctcagtttaaatatcacctcttccaagagacatcctttgactaccatatatcaaatatcccctaagctcattatt

SEQ ID NO: 167735 - DNA, 269 bp, Homo sapiens
cttcccccttttaaggagaagtataaataccaggcctcctgaaaacctcttcaaagacaacacaagccacagatggtttctatgacttatgtttttccagggtgcaccctcaagctctggctcagtaaacctcaatggactgacacttgcttgcctcagtcaatcattttggttaacattttggtgaccatgaagggatcctctgagtggagcttagccccttaggcctgcagcgattctcctgtttatgctcagtaccaactatcgag

SEQ ID NO: 167736 - DNA, 380 bp, Homo sapiens
gaacacaggacagggaaccattcaggacaagaggccaagaggccagggttggggcagagtaagacggggcaatagcttcctggattagtttttagagttttctgctggcttagggttggagagctggggcagcagcttaaagaggggaccctccaatggcataggggactctgcaagaacctccggcagcagcactctgggtcagagggcgaggaattgggggaaatttaagaaggagatattaggaaaacttcttaataaaggcaccaaactgatagggcaacaggggaaagccaaatggggaccttgggccgtgtcggagagcagacagggctaggggagcagcttatcgtgcttatctcaccgtagagatgatacat

SEQ ID NO: 167737 - DNA, 588 bp, Homo sapiens
agagtaggaacaaaatcaacacacagaaattagtagtatttctatgcactgttaacaatgaactatgcaaaaaaagaagccaagagaacaatcccatttacaatagctacaaaaaaccaatcaaatttaaccaaggaagtaaaagacctacatactgaaaaacatacaatgttgaaagaaattgaagatacaattaaatggaaagctattctgtgctcatggattggaagaattaatattgtttaaatggccatactactcaaagcaatctccagattcagtgcaatccctatcaaaattccaatgttatttttcatagaaaaaaatactaaaattcatatgaccacataaatccctgaatagccaaggcaattatgagcagaaagaacaaaaaagaagctaccacactagcttatttcaaactatactaccaagctatagtaattaaaacagcatggtattggaaatagacatcagccaatgaaacggaatagagaacttagaaatgaacccgttatgcctgtcgtggggtggggggagtggggaggaatagcattaggagatatacctaatgtaaatgatgagtta

SEQ ID NO: 167738 - DNA, 224 bp, Homo sapiens
tttgagcaaatgagaaactggtaatgccatttcttagagtagtcattatttatccaaaagtatctctgagaaaagctacaattcttgcaagtttagtgtattccagggagctcaagaaaggggtaagttttagatttttcgatattctgtacaatggttaattgaagcatataaaaatgatttgagagaccatataggataatgctaaaaaatacacacaattc

SEQ ID NO: 167739 - DNA, 323 bp, Homo sapiens
ctgtagcctgaattgcaattgtaccctgctcattggggcctaaacctctggaaaacctcttccttcccagagccatgccattgctgcaccctaacacccaggatgagtcagcaacatgcctgatcctgggcctgagatactgggaagtgcctcagaatcacagtacttggccttgtgggagagctgcatcacccatacctaaaagaataaacctggacctacaccacaggtgtcctggcagttcaacaagacactgagccccagaccccagctccacagccactctgagcacctgttccctgtaacacagcactgcttggctg

SEQ ID NO: 167740 - DNA, 231 bp, Homo sapiens
tctgctggctcccttccccagcaattaggggtgggtctaggggtaagaatttgccctagactgagctgctactggttgggaatggtggagctttgagagggaaggactttggccagactggcataggaaggggctccctgcaggaggagagcagtactgtgtgcctggcatgctggcccagaacctgcgtaactatagcttagtaaaatctggagctatcaaacacacaca

SEQ ID NO: 167741 - DNA, 533 bp, Homo sapiens
ccggtcaggagagtaatggactttctgtgagtcacaatgagcacaactgttgcattagggtgacagtatctcctactgcagccaacttccctgaatagaaaaccactggatcctgtctttcaggaagcctctggatccagtcttatctcttagagtggtctatcttcccaggcacaaatagcaaactcgtcggtttataatctatagcaaaaaattcatattctcacattttaaatgtagtgttacctgtactataaacaatgttgtattagccagacttcagctattttggggtgcagtatgttaaacaaaagaaacaagtctcacttgaaaggatttcatttgaggaggggggactttggtctctagaggaaactggtgtaatatttctatattaatacaaggactgtagctcaagaaaataataatggctacagataaagatctggaaatatatacaattaattggagccataggaaagatggaataaagtggggctggaagaaaagggggctgatagtataattctaag

SEQ ID NO: 167742 - DNA, 328 bp, Homo sapiens
gaaaaactacgttgatacagccaggctttctctgaggctctctcttgtccatatctaggaaaaactgagagtctgatacctttaaaggtctgaaagaaacatttactatctattctgtctgagagcggctacctctgagatttctcctatgtaacaagaacgcctttgccagccaggcctcctcttctccccatgccataatctctttgccaagatccaagcctccagtctttctgtaacctcaaggcttctgtaccccactgcggggattggtaatcactctatggttctcctccatgtgcacaataaatttgtatgctttttctcc

SEQ ID NO: 167743 - DNA, 363 bp, Homo sapiens
taatgatgctctagggggaaaggcaaacatttgttgtcctggcatatatcctgttatatatatgaccacaaaggtggggagggggaggtgaacaatcctacaacctaggttcacaacctagtgatatttgcagtgaaacatttgtagtgatatttcccctttcattgccaaggggaagaaaacactaccattttggcaacaactttctatttagaaccttacactactcaggtcctcacttctacttctgcaccattgtttcttcccatcccatacaaaaatccctcattaccaaaatgtatggatccaactattttaacttttatcatttgtggccatggttatagttaatgtcccagattc

SEQ ID NO: 167744 - DNA, 386 bp, Homo sapiens
ggccagcggagcgcagggcgcaggggctggacccggcgcggagctggctgagtcggagcgcagcgtcctttgtgcccggcggccgccccgggatgcgtccgagctaggagccaggtgggggatccgtgagggggccgtgttgcgggagaagacttcgggattagagacagagctcaggattagggagaggacctgagaccagggagaagtccccagaatggggagggggctgaagcgggggaggggagccctaggttgaggagggagcgcgaactgggagggggcttgggaatgctaggtgaacagacatttggggaggaaggttgtccgcggaatccggagactaccccccggtggggagggggccgggctgggggtgggtctca

SEQ ID NO: 167745 - DNA, 117 bp, Homo sapiens
atcactgactgcacatggttatggcaacttctaaaaagaaatttagagaacaagatttttaaaattcttctcaaaggtctaacccaaacctagatggctgaaatcaactccaatttc

SEQ ID NO: 167746 - DNA, 218 bp, Homo sapiens
taaccacacccaactgatgtactcctagttgctttgctactatatttaaaatgatcaaacacctaagtcaattactttaatattctttggagaccagcttactgaaagaacctcaacacagttaatatatttgaagcaaaactccagcacagtgaagtaacagtaataacagctgaaattcctaaatgggccaaagaggaaagtaaagtaatgcagca

SEQ ID NO: 167747 - DNA, 295 bp, Homo sapiens
gcagtaagccaagaacatgccactgcattccagcctggatgacagaatgagactgtttcataaaaagcacggcaaagaaaaatacccctgaattagagacaatgttagaagcaatcacatcctcaaggaatgacctggaagcattttcctacataaaggggagttttttctcttaggatgacctgaaataattgccaaacacagcccatcacaactattcactgaacaaaagaaccagtgggttacattaaggaattgtttcccatttatgatttggattgccaattgatccaaa

SEQ ID NO: 167748 - DNA, 315 bp, Homo sapiens
cctctgtgggtaggtgcttctgtggtagctggggttcaggctgagtcattcccagccccagctgcctgctgcccttgactgcctatatagcccagagtgagcagaaatggaaaacaggcttcttcactcaaacctgattagtctcagggaccctctcacctccttaaaaaggcaggtggagcctcgtgtctggaaagggaacatgggaaatttagcttcttgggcttagctgcttcgtgccttcctagagacctgggagaactggttcagggagctccagagcgtgtggaaaggggagaattgggctgaggcaga

SEQ ID NO: 167749 - DNA, 484 bp, Homo sapiens
ggtaattatgaaggaaagaggtttaacggactcacagtttcacatagctgagaggtctcacaatcatggtggaagacgaagaaagagcaaagggacttcttacatggcggtgggcaggaggacacatgcagggaaactcccgtttatgaaaccaccagatctcatgagacttattcactatcacgagaacagcatgggagaaacctgcccccacaattctattaccttccaccaggtccctcccatgacacatgggaattctgagagctacaattcaagatgagatttgagtggggacatagccaaaccatatcagttactttgaatgctatgaaccagtgataagatcttactgagtccctcacaaattaaacaagctgttcggcaggtattcattttatatttgtgtgtgagctgtgactgtactgtcttttaagacatcatttcacataacaactcaccaattctcccaaagttgatccaa

SEQ ID NO: 167750 - DNA, 408 bp, Homo sapiens
agtgactatcctagaatgtatcactgatttaagagaatctaccttaaattagcacctttaccattttccagataatgcaaggacctcacaactctttgaccctttccaacattttgtgctattattgtcatgtcctttatttcgatatttatttgagctctcacaagatattattattattattgtcactgaaaatatatttatgcaatttacccacattctccttgtgttcaagccattcattctatcctgccttagcttgctgccatctgagatcatttctcttcctcccgataagctccttttagtatttcttttggtagaattctgccacaatgaaaaagtttcatatcttgacgcaggtgatatatgggcaaagtcactctttaaatatccatggagatatac

SEQ ID NO: 167751 - DNA, 220 bp, Homo sapiens
tgtaagatgaacaagtgggtgtttttagtgaaacacactgagattttggggcagcatctcatatgaactagaagttcttgtctgatccatcaacagctttgaaaatggatgttagaactgatttttttaaaaagtcacccagcatacgtttttgttaatatttaaatcaggtgctatctcctagtctttggaagcccagtatgttaaggcttagggatct

SEQ ID NO: 167752 - DNA, 369 bp, Homo sapiens
gaactgggttccaggacctcacatctccatttcccatagttggggggcagggaggagacccctggttctggagcgtcagatctgcaaggcctcggacctctggctcaacacccccttgagaggcttctggcctcctggctctgctggagaaggcatggcctgtggacctcctgcattcccgaggcaggctgcgtggctagcatttggaggctggcagagactggctgattcctaaccaaagatgctgttggtgtcttctgatggaatgtgactttctttgcctagtaggtgttattcacagggatcctttagttaagcaaatttgcctaggccccctgttgggtcgtatttttcttttttctttttttt

SEQ ID NO: 167753 - DNA, 547 bp, Homo sapiens
gcctactactactaaattcgcggccgcgtcgacaattctagcgctgcctctcccggctcttcactgcacgcagcctgagggcgtcgttgtctgtgctgcaccctggtgctcagtgggtctccagctggcacagtcaccaccactcccagatgggctctgccagggacagggatggagcagactgcatgggcctggcgtgcaggtgaccaggtagaggcagctcagctgtgtctgaacagcttttcccatcgctttcccggtcgacattcatggcagccgctgcgtccaatgacaggcacagtcaattctttgagacagaaagggaaggacaacactaatgtccccatgaaccccagaaacatgaaggaggggcacacgcccacagtagaacatgtggaagctgagtgtggcagtgtaaagggcgatggagcccccgggcccagcatgtttcgcgctgcctgcttgtgttctgatgggcggtaactgaaggtccaccaggaagtgcctggcaccccccctctcgctcgtgaaagatgcagatcagagc

SEQ ID NO: 167754 - DNA, 494 bp, Homo sapiens
cttaggggaaggggtgagacgggggtgagggataaatgactacacgttgggtacacattggtaagtgtacactgcttgggtgatggacacaccaacatctcagaaatcaccactaaagaacttattcttgtaaccaaacaccacctgtcctcccaaaacctattgaaataaaaaataaattaaaaataaaaacaaaaacacgtgtctaggtagcatacatgataggtgtactcaccctaagtaagttaatgtgttttacttgtgtcattgcaaaaatgaagcaaggtagagctataaaggctgtctgaacttttctcaagacccggtggtggggtgaggagtcagttacaactggttatttcctctttgcagggaacgtatatgtggcctgaatagttgagcagacagacttgggcttgctgctattaaatatgtggaatgtgtgttaatattcaggacatattttttctatttgatttcactactatacttca

SEQ ID NO: 167755 - DNA, 467 bp, Homo sapiens
ttagcgcgggctacagaattagtagtgtgttttcagttctggaaggataaactgaatcagaatgttttcacaaggaggtgaccagaatgtggaagaagcctggaattaaaacacgagaggaagctctgaatggaacagacaaaatttcatctggagaagagaaaagttaagattaccacagttgcaaatattggaaaagccatcatgtaaaagtgccattctagagtagcagaactagctttaataatggaatatccacaatagagctttcaatttcatgaacagaaaaagcttctaacaattaacactggatataagtggaattcactgactcacagtgtagtgaactcctcgtagttggaagtggcaagcagagggctgaatgaccatctgtcagggatgctgtacccgaaattaattcctacacagggtgagaggggaggacctatccacagctcagatttcaa

SEQ ID NO: 167756 - DNA, 224 bp, Homo sapiens
ctatccctgtaacacccgcccccagcgatgccccttggagaggacacagtgtctatccctctaacaccacccgccagcaatgccccttgaagaggacacaggatctgtccctctaacacccccccagcagtgccccttggagaggacacagcatctatccctgtaacacccccccagcagtgccccttggagaggacacgttgatgcggccgcgaatttagtag

SEQ ID NO: 167757 - DNA, 194 bp, Homo sapiens
agcccatcagccgctcatccccacactgggagtaagcattcactgtgctccaggcaccgtgttggacgtgggcgtgagtataatagaatagtctttctcttctgagcactcacattgtagggaaaaccataaaacattagactctctcatgaaggaggcccgatttggtggctaagacaaggctgactaatggc

SEQ ID NO: 167758 - DNA, 347 bp, Homo sapiens
attgcaccttttgccatttttaaggtgggcagtgaaatgatccagaaaatattaccttcaacaacattttcatagagtgactttgctaacagagtcttcagaccacgaggaaaatttttagaccataaagcagaagttgagggaaaggtagtggtgagaaatggggaaagaggatactggggagaataataatagtggtttaaaatagtggtagttcactcagtttctatttggtgactgaaatattgaaaaatttacttagatttcagtcacagaacaggtggtattatgatactggcaacagaatgtagtgattaaaagcacatgcttttgagtcacgcatactg

SEQ ID NO: 167759 - DNA, 177 bp, Homo sapiens
ccaaagtgctgggattacagatgtgtgaaccaccgcaccgagtcccatctctgtcttcgttttatggaattgacattcttgtattgtgctatatattttgttaccagtatttagtgacatacctcccccatattctcttcactgctgacactacagttgcctactggtcagtgtgtt

SEQ ID NO: 167760 - DNA, 219 bp, Homo sapiens
gtgccctgggataccagagtggtgtgttctggaggacaggtgcaagtgttggctttcaggagtggcctgggggctgttgatccagagtcacctgtgtggtccttgaaactggatgtggtcacacaggaagaggatgaggagtgagcagaagcggcactggtctcctgagtggggacgctgctgggcaggggcagggggagcccaggaaggaaggaaacc

SEQ ID NO: 167761 - DNA, 256 bp, Homo sapiens
cccacctcggcctcccaaagtgctggttttgtttgtaggtggttacatcattgcacagaagagtttgattcgggaattttaccaagagtggtggcctgcttcattgtgacattttcagttatacattgttaggttctcaaagactgttgggcaaggtgtcctggggaaatcaaaacctattaatgtcgttatgaaattctgaaattaagaccaagaccaccttacaaaacagttcaattataaacacgatgtgttg

SEQ ID NO: 167762 - DNA, 642 bp, Homo sapiens
ccaggagatagtatttcaccttcacaactcaagagaaagatgccaaaagcatgtgctccagggattttggttttcaatgaaaaaagaatcattttctgtttttccccttcagagagaaagcattataaaatgcaggagaaaggaaaagcgagggcaaacaagcctccctcatccaaatagtgccaatggaaggtcctggattaggtgttccatgaaactgaagtacagtagcaaagctgtcatgaaatacttttggccagtcccttaaaaatgagtctccaaaagaatagtgggtaagagtgcttcctcagggcagatttcttgaaatgattatatttcttctaaacaaaacattttaaacatttgaggagaatacttaacagaaatttgggaacagaaaaataaagttatttcatcccagtgttaaactcttaattccttatgcaagtaaaggccagtggtaaagacaattcaaatatttgaaatctgatttcagaatgtaatctatatgattcggcccttcaagtgtatcatatacttttctgggatcattaaaatgagtctgtatcccctgagcaaatagttgcccaaaacagaggggaccagaattcatctgtcacccgaatcccccttggggtacca

SEQ ID NO: 167763 - DNA, 393 bp, Homo sapiens
caaagactccatggcattatcccaaacactttactgttctgttgtgtctacaacttagtttattctggactaggaaagggaaaacttccttatttgtcaagcttagtttttttctggactgggaaaagaaacacacttgactgtgatcaaatctgttacaatatttccaccactcttcctaccccgttgatcatttatttccctcattttcaggaaaacatgtcgtttttctaattctacaagataaatggcatgtgtattgtgagcttgggtatatgcacatacacacacattatcataagccaaatcctaccacttacagtaattttcttgaccctcgatgtggccattcccctgtaaaagcccagtatcttggggctgggcacggtggct

SEQ ID NO: 167764 - DNA, 485 bp, Homo sapiens
gggacacagtctctgacttggaacagtgtaattcctgtgtctcagttttttcatctgtcacatgggattggtacttagttcacatgactgtgaggattaaataagtttaataagaggcacttagaatggtgcctgggtcaaagtgagagctcagtaaagattagccattagtcttattactacaatctagatgagcccagacaagagtagcagagtcttgagggctatgaaaggtaagaaaagagtggaatcatttctatcaagaggatccagaaagccttcagagtagaggtgaggtctgcagtgtgttgagaagaatcctgatggccttactaggagaacctatgctgtgattgactggtgatgtctgctgtgggtgaggaatgcacagtggtggtgtgtgtgcctctgtagcctatattctgtttgttttaggatccagacatgtcacggcacatttggaattttggcaacacaggcttgat

SEQ ID NO: 167765 - DNA, 442 bp, Homo sapiens
atgaccctgctaccttccgttagagttgagcacaaagttggaaaattagtttctcaaagtatgacttggttttacattagaaatccaaagtaataagagataccaaaacaatctatccattgcctattcaaagattctaccttttccataggaagggactggcaagaaaagatattttattttcaatatcagtcaattttgcctgatgtgttattccttggttttataaacagcatcaataggatatcatttaaagctaccctgaaatgttccttctctgaggcatcagggccctgtgtctggacagtgaatacctgtcaagtgaagagtcccatgcattgaaggaaattggcagtcctcatgaatgaacgctgaaaggaagtctgatgtgtgccaatctatcataaccactggcctccaggtggctcacctcctactcagg

SEQ ID NO: 167766 - DNA, 223 bp, Homo sapiens
ttcccgtccccatttcatagacggggaaactgaggtccggtgcgggtggaggctttggtccaggctggctcttcctgccactctagcggctgaaagaagcttgctcctcgcgcccagcaggggctggcggcgcgcggcagagctgggtctcccgccaggtggccgggggtgtgccctcagggtaccctacccgctacccccgcgcctccagtcccggcggccg

SEQ ID NO: 167767 - DNA, 304 bp, Homo sapiens
tccaagtccatatttctcacagtccacgttatatactcagcagacgctgttgacaggctctctgaatccaggaggcagctctgagcctcaggaagtaagttgctagaatcccagttagggtcctaatattctaagagatacagacctaacagagaagtgtgctgtgcctgtggctttgtggcagggtttgtctacaataaataaacacatgttgtgttcacagggcttaactcagtgctgtaacaggagcttcagaactgacagggcaaacagtcctcttcagttaagtatcactggccatgtc

SEQ ID NO: 167768 - DNA, 233 bp, Homo sapiens
ccagaacaagcactatgaatcagcaatgtcccttggagtgtgggagaaagactcccaagacagcagcttaaggctggccaaggtctcaggaaatctatttatgccctgggtcagccaaggcagggttggaatgagaaaactgggatagctaagcccttcgggggcaagttattttagtaagaaacccattttgtagaatttaataaattctaggttttgtcacatgctttttt

SEQ ID NO: 167769 - DNA, 492 bp, Homo sapiens
tgctaggattacaggtgtgagccaccatgcccagccacgtcacttggttttatagtaaattggtttaagtggctatttgagctgcttgttaattttaataagctaaacatttcaactaaatattatatttatttacttttcatcaaatctgatttactttacagatgaggaaactgaaatttaaagatgctcagtagtaacttcccaagttcagacagctggttacaaggcagagctgagggtcagcctcattctctctgaccccagtgctctgtgctatgtacatattccctagttgccctcagaaatactgtgatgatgattatttataacagaatagttttgtccattgcttcacatccttgcacaaactgggtgtcttttggggttgaccattttaactgaaagaaaatattctttcatttttaacatctacatttatttcatgcttttaaacatttaaaaatctgtgctagctgtttgtatttctta

SEQ ID NO: 167770 - DNA, 367 bp, Homo sapiens
aaaaaaaaaaaacgatattgaaagaagccagcgatgagaaaaaaacccttacttatagagaagcaaagataaaaagtacatctaccggccaggcgcggtggctcatgcctgtaatcccagcactttgggaggctgaggcgggtggattgcctgagatcaggagttcaagaccagcctgaccaatatggtgaaaccccatctctactaaaaatacaaaaattagccatgcttggtggcgtgcgcctgtagtcccagctactcgggaggctgaggcgggagaatcgtttgaacccgagaagcggaggttgcagtgaacagagatcgtgccactgcactctagcctgggcaacagagagacgatccgttt

SEQ ID NO: 167771 - DNA, 157 bp, Homo sapiens
caacactggcaatgaaacaaaatacaattgcatatgacataatttttataaaattatttttaatgctaggtcaaatgaattgttcattcatcctctctctgaccaaccaatatttatagaccatttcctttgtgcaaaaagctgtactgagaatcca

SEQ ID NO: 167772 - DNA, 488 bp, Homo sapiens
aaaacataaaaaaaaatgttttcagtagttttatgggtgtgtgtgcacaggtgcatctacggggggctccttgatctcctctgtacactttcacatcttccaaagtttctacaataagcatgatttttaaacattgtaaatgaccttaatgaattgtaatattcttttataatcctcaagtaaacttcattttgtgtagtcacactcaagagttttcatcttgggattattggcaccccctatttccagttctctctccatagatgccctggagagcctctggcctcgcgtccagcttgctcacccggccaccctgggctgcatccatagtaccaggatcctcactgttgaaacgctctcttatttccctgcgccgctgcagacagctccagggtaaagttgtcaagcgttcaaaggccacaggaacggagtcttcggaccctcccaggtttcggccccatatggcctcgcagattcctagcggccgc

SEQ ID NO: 167773 - DNA, 468 bp, Homo sapiens
gcagtatcttttaatatgaaaaatgtatttatccttgactaagtaattcccattctagaaatgtatattatgaaaatacttgcacagtatgcaaatgtatacaagtataagggtgtccattgcagtattatttgtgttaatgaaaaatgggactaaggcaaatgtctattataagagataggataaaaaatttagtgcatattcatatattgaaataatattgtcaattaaaaaataaaactgatccacatgtgtggaaataaaattatttcccaatttaatttgttgaaatttttaaaagactcacaatggtgtgcaggtgaatgcccttttttaataaggaaagatgcatatatgtacatatgtttgtatgtgcagaagtagactggcttttttatatccttttgtactctgaagctttctgtatgaattgcatgtattactttttcaataaaaaacctaatctat

SEQ ID NO: 167774 - DNA, 441 bp, Homo sapiens
gctggttgttgtagcgcacacctatagtcctagctacatgggaggctgaggtgggaagatgaggatcacttgagcccaagagttcaaggctgcagtgagctatgatagcgccgctgcactacagcctgggtgacagagcgaaatcttaaccccccaaaaaaaagaaaagaaaagaaatttaagaatcacattttaaataatagtttatctgaagaaaaaataataaagtttaaaaagccttcccattaaaagtatttccccaaggaaaaataaacatggaaaatgactttctagtcaactaagtcctaacaattgcaaaatagaagtaattttaataagtgattttttaacagcaaaaaaataagatccattttattatttccattatcttgaattttcaccttctcatccttaagtttatatttcagcctgaacttcaga

SEQ ID NO: 167775 - DNA, 535 bp, Homo sapiens
agtagagacggggtttcaccttgttagccaggatggtctcgatctcctgacctcatgatccacccgcctcggcctcccaaagtgctgggattacaggcgtgagccaccgcgcccggccccatctttgctttaaatattgtcaggatatgttattagatacatgaaatttgaattgttttgttttctagccaaagtgtttgttatgtgaaatttgcctctctatctctagcactgtatcttgtctcaaaaatctatttttactttatgtttaaaatgcgttttgtgggcttcatataacttttaatttttgtatttttatcccatgaaagtctttatcttttatctggaattgtctgttcggatttatcatctttactatatttggtagtttacacttgatcttagccaaaagaccgagaagagatatattttgtagtttaaatctgccaactagtcatgttctatttatccagtttctctatatttctgtgtttctatttctttttgcctcctttcaaattaagtacttttcact

SEQ ID NO: 167776 - DNA, 646 bp, Homo sapiens
aaagaaagaagattactttcaaatttctaatgctgtggtctaggaaaatctaattcctgtgtcctgaggtgtacctggatcttgaacatttttctaccagagttaataagagaatttggtgaggttattaggtatgagatagttatgcaaaaaattaatagcttttctttgacagtcagtaaccagctaagaatggaaatcagaaatacagtgtattcataaatatgacaaaaacaatgttttgggccaaattctgcaagaaaagtacacatgctctttggaatgaagctacaaaattttattaaagcaaataagataaaatataaactaattccatgctggatagtctgtcttggggtcttgaggtgtgtgtgtgtgtgtgtgagagagagagagagagagagagacagaatcagtcttttgttttgaaataatttgaggctttcaggaaagttgtaagaataaagcaggaactcctattcactgttctcccagatcttgtgattgttaaatttttacgacatttattctctttctctttatgctttgtttttctgaattttgagagtaagttaaagtcaggattcccttctacctcaaaatacttcagtggaaatttcctaagcacattctctgtcttaatctg

SEQ ID NO: 167777 - DNA, 461 bp, Homo sapiens
ccgatgcttatagaagagtgtgccagtgtattcataaatatgacaaaaacaatgttttgggccaaattctgcaagaaaagtacacatgctctttggaatgaagctacaaaattttattaaagcaaataagataaaatataaactaattccatgctggatagtctgtcttggggtcttgaggtgtgtgtgtgtgtgtgtgagagagagagagagagagagagacagaatcagtcttttgttttgaaataatttgaggctttcaggaaagttgtaagaataaagcaggaactcctattcactgttctcccagatcttgtgattgttaaatttttacgacatttattctctttctctttatgctttgtttttctgaattttgagagtaagttaaagtcaggattcccttctacctcaaaatacttcagtggaaatttcctaagcacattctctgtcttaatctg

SEQ ID NO: 167778 - DNA, 498 bp, Homo sapiens
gtctaacccaacctttcctccactgccacatttccactggggaaaccaatgcatataccacacacacacccagacttgctggggtcatcatttgtgtcatttccaggtctcttccctccgggctcctggcaagcacacaggccaatgcaacgagctgatgtcatgctgaagtgacccgtggcccgcgcgtgggagcccctgagaacccgtgcaccgcttggcacactcccttcccccactggcccatggtggacacacagcacaagttagaaacaatgccgtgccgcttccagccacctagaatgcgtggtcgctggtgactgtggcagcacctggcctgccctgctctcagactggcttccatgcagcgtgtactcccccaccaggaacattctgctgtcacccccttctctccgctgcccgctggactcctacttacacttcaggtccctcctgaaatgccacttctccagaatgactgtctttgatggtggcttc

SEQ ID NO: 167779 - DNA, 461 bp, Homo sapiens
acagaaaccttcttttttttcccttcttgtaaattcctggttgctgctgctgctgatttcttcttacccatacctggtttcctccataatggagagaggtgagattcagggtataaaacagagacccctggagcctaattaattgggaaaatacacacagggagaaatgaaatgatagagactaacagcagttcatgtcaaaaaagaaacccaggagttttagtgagccaactacaacacttgatttggtcaacaaatggtcagtaattgtctaccctgtgacaaaaaattgtcccagaaaatgaagtacaaaattgatgatatttggccctgctcttgaggaggtcacaatcacattagggaacaggtttatatcagatgaccaaagtgtactgtgatacctggagtggggtgagagaagacactcaggcatccaatccagtctggggcaagcccaggaa

SEQ ID NO: 167780 - DNA, 210 bp, Homo sapiens
agaatggattcagagaccctcctatgtgcacttccatgggaagagacccagtctgctcaataaacaggcacccgctctgtctcgatgagaaccaacccaatgatagacacagtcctacgtcctttcagggacacaaaacccgtcatacgtcataaaatcccaggatcggagagctagaagtgcacttattcttatcaatgtgaggttgct

SEQ ID NO: 167781 - DNA, 356 bp, Homo sapiens
tttgaaaagaaatcctcaatatgagcatttctccctgactgaaactcaagttaacagtcaaagggttaaggctttaagtgggaagggagttcttgctaaccatggctcctgaggtgtgcactgtttctcaagatgtccataccaagtacagcttttgttacaggacacggaagggctctaattgtttcactcttcccttgctcttctggaaagccaacccagccccccaccttaatgtccactcagggcaggtagccactggggccagtgtgcatctggagatcatgtcctgactctcctcctaagagttcaaagcactctcatcaaatcattctttcttcattcacacgatccca

SEQ ID NO: 167782 - DNA, 352 bp, Homo sapiens
aatgagcatagatctgttgacggtggatttgttatacaaaagtccttgttggtacataagttgaaaaaacagacatttatgaaatagaatatactgcagcattgagaagcactatgtatatgtccaccattacaaaggatgtgtaagtcaccatagttccatttctcctttttttctagtattaattatggcaacttatggactgggattaaaataacattttttaaagtttttattaaaaattaaaaagaaatttcccctagcttcccaagcttatgataaaataacattgtacacacgagaaatatgcgagactaaatgagcctataggttatgtttacacatttgactc

SEQ ID NO: 167783 - DNA, 409 bp, Homo sapiens
tttgcacattctctcctctccccattgacctaaatcatattctttctctgaggcccagttaaagctgcatctccttcatgaagcttccatgaaccctgtctgccttctttcctgggttcttcaagccttgctcttcactcaataactgttttccattgccagctgtttaagatttttctgggtcaaagtgcgagattgttctggctcaacttggtcaaactggggagctgcaccattccttgaatccccttccccaggttagacttggctaacagagatctatgtgaaatttggaaggcagggctaaagtggtgaccattactctcagaaatccattgtgaccatgtctggtgagagatgcagagctgcccgggcctcccaggtatgctagctttcattcccttcttcc

SEQ ID NO: 167784 - DNA, 463 bp, Homo sapiens
agctactgaggaggctaaggcaggaggatggcttgagcccacggggttgaggctgcagtgagcagattgccccactgcactccagcctgggtgacagcgcaagactctgtctcaaaaaataaaattatatatatagagagagggagagagagagagagaaagagagcaccaaaaggactgggaaacaccggcagatgcacagacaatgcatccctgattttaccaatagacttgactcccaacaatgcatactcttgaaggcaatccacaggttgaataaaccaagtccatgagcgctgggtctggaatctttctacaatcagggtcagaaggagggtgactgaaattaaaatattagcttggatctttgaaatcagagtcaggctgaaaaagtcccaatcttagttcaaaacctgtcctgcatgactgaagccctcctagggctgcacaaagtataatggaa

SEQ ID NO: 167785 - DNA, 160 bp, Homo sapiens
acccgccttggcctcccaaagtgctgggattacaggtgtgaggcaccgtgcccggcctatttcttaagttacttaaaaagttcagggtcattcgtatgtcgttacaaaacagtcagtgtaagattttgtctagatttgtctcagctgtccacctctatta

SEQ ID NO: 167786 - DNA, 358 bp, Homo sapiens
cagatcacctgaggtcaggagttcgagaccagcctacccaacatggtgaaaccccatctctaccaaaaatacaaaaaattagccgggcgtggtggtgagcgcctatgagcccagctacttgggaggctgaggcattagaattgcttgaacccaggaggtagaggttgcagtgagccaagactgtgccactgcactccagcctgggtgacaagagcgaaactccatctcaaaccaacaacagcaacaaaaacagaggcatggtggtgcacgtctgtggtcccatctactttgggaagttggggtgggaggattgcttaaccctgaggttgcggaggttgcagtgagctgagatcgcacc

SEQ ID NO: 167787 - DNA, 285 bp, Homo sapiens
atgcctgttccgtgcagtaaactaagtgctcctcctaaatcacaagttagagcatgacattcctctgcccaaaaagaccctatatattttgttgtttgttacttttccgacctcttcccttcctattatcacctttgtttgctctgctctagtccactggcccccttggtctttctaggacgtgccacatacatgtcacaggaccttagcctttgttgttcctccagcatgggtagccacaaggataacactcccccttcaccattcaggtgcccacatgacacc

SEQ ID NO: 167788 - DNA, 404 bp, Homo sapiens
taaaaactaagtttccaaggcagtatgctgtggtccttgaaaagtcctttagaagaattttctggaataaatttagagaaaacctaagtgtttcctaggggatgcttaccaactcctcgcccctcccccgcccgccctcttttattttaattgtgactcagggttaaatacaaactactagcagctgttggtggaaaagagcccaatcccaaactctggggttttcctttgttcccaagggaggccttgggaggaatgaatgatcctaaaggaatgagcagacctggggaatcctccaagtgccacctctgactaatattggctgttgccaggaaaacccaacttggatttcagctattactttccgtgcaaccctggtgctgactattcaaggggacagctct

SEQ ID NO: 167789 - DNA, 129 bp, Homo sapiens
tcagggataccttccttgttctcttcactgcacctactccccccattttatgccatggtagcatcaagtatctctccctgtggcacttcacatggcaagattttgtatttacttatgtattttttgatg

SEQ ID NO: 167790 - DNA, 277 bp, Homo sapiens
atagcggtccgactttcagagtagcacttttctgagtagctgggaccacagacatgcaccaccacacctggctaattatttttattgtcttgtacagacgaggtttcactgtgttgcccagtctggacttgaactcctgagctcatgtgacttttctgccttggtctcccagggtgttggaattataaatgtgagccactgtgcctggtttaaagtgtttttttttttttttaaattaatttctgactctttattaacattctctactcgtgaaggg

SEQ ID NO: 167791 - DNA, 441 bp, Homo sapiens
taagaataaagaagcagtattactgagaacacacatggagaactgacaagataaactgctgagttgaacaaaggaagctgtataattatgtgtagaggtggaccctgtttatatatcaacacacgtgcaggaacacacgcataaagcaatactatattttctccttccgtgtacatctatgtcaagcctaagaaaatgcccgataagtatttcctctgaggaaggtagagggagttaggtgagtatctcaaaggagattttagccttatctatattatattgcttttaaacagaatatatagatatgtcatttgtatattcaccctccaaaacaaatgtatttatggtgcaaaaagatacagaatgggctaactgaaaagtcaatgatataattcctttcacacttcagggaagtgatcattgttaacactaataacttgg

SEQ ID NO: 167792 - DNA, 182 bp, Homo sapiens
ttggattggtttattacgaagcaatagtaattcaaacagaggtggggagtttggttaacataaaaggattgaagtaaaaggagcaaggaaggcaaatagttggtagagaagaaacaggctggtacacaaagcattttgctttgctgctgatgaggggctttttgatcccagagacttcagag

SEQ ID NO: 167793 - DNA, 189 bp, Homo sapiens
ctaacttgatcatcaagtggggatgggggtggtgggagaattgtctttaaaggaaaggcagtgtggctcactgagtgaatgagaagggtgaggtgtgagtaatgagagaggtcgggactcatgtgtttgccaactgtccttcaagaacagttttgtctgctctgtgaaaagttttagactttttcctag

SEQ ID NO: 167794 - DNA, 225 bp, Homo sapiens
cctaggcaccatctgtggaagactattagttctcccattgattgtcttgacattctttttgaaaatatcaattaaccataaatgtaagggcttatttgtggattctcaagtctatttcattgatctataagtctatccttatgccataccacattgccttgattattgaagctttacaataagttttgctatggaaaagtgtgagtcctccaacttttttctttt

SEQ ID NO: 167795 - DNA, 477 bp, Homo sapiens
cccgggctcaggtgatcctcccatctcggcctcccaaagtgctgggatcacaggcgtgaaccactgtgcccgaccctattcttattttcagtggatcagagctctcctgtacattgctgctcattatggaaacaagaaagagaaaacagaaaaacattttcccaagtgaagttagtgttctacctaaaaatgaattaacaagttcataacgttgtgtgtgtgtgtgtgggtgtgtgtgcactaaattcatggtcgtcttttctctcacatgttttaacagttaacttcaaacatctggcacttcagaaagttaattcttttagtaataagtacactttctgtctgtttacttcaatagagcatattttttgttgctttaaaaattatagccctggaggctctactctgtccaaaaaatacattacattctggaggagggagggaaggaggcacaccatatgtctatggcaagagaag

SEQ ID NO: 167796 - DNA, 395 bp, Homo sapiens
cgcctgccaccacacctggctaattttttgtatttttagtagagacagggtttcaccgtgttagccaggatggtctcaatctcctgaccttgtgatctgcccgcctcggccttgcaaagtgctgggattacaggcgtgagcccacgtgtccggcaggtactgtttttatccctattgtgtcgataaggaaactgaggcttaaagagagacattgagtcatttgcccaaggtcgcacctctagcaggtgtggggctgggattcattccattgtcccttacaacaaataattattgaacatctactgggccacacactgcactagaaacagagaaggcaacaatgagtaaataggtaggacaagctttctgtcctaatggcacttacattccagtgg

SEQ ID NO: 167797 - DNA, 298 bp, Homo sapiens
ataagttgccattttaaagacataggggagaaaatgggtttgatgttttaatggagcaattgggcttcactgagctcggtatcacaagagatgaggggttgagaaaatacctggatttgtctctttaccatttagcacagcccagagatgggttcaaggattattgactttcccgcaggcactcgggctgaacttgcctcatgggaatgcttggagctatggatgatgtaggtttgtctgggtcttctggagctgcccagatccacaaggaacaacctcccagaaccaggccagagag

SEQ ID NO: 167798 - DNA, 646 bp, Homo sapiens
tgtgtgtgtgtgtgtgtgtgtttgggatgaggtggggggaggtgaagggaaagcagtggacaaaggcattgcattgattgttaggttaacaaagcaccaggcaacaagcttcctaacagagcactctgtaaacaaaaaatataaagttagttatgtgcagtctaagctcacacagctaatcaatggaagagccaggattaaatatgcatccaaagacccccagccagggaggagatagctttcttcttatcatttacttaagcagacattccattacccagtcagacttgacaacatattgctttttacagggagtacctcataggaccagtgttccaaatggtaaaatacacccagtgaatggagaggtgtgtagcaaggataccctctcccttcacaggcagatagctttgtatctacacttagcatcagcaggcttctctccaccctgccaagcttgctgaggacagggatgggttttattgctcttcgttctccctccacaccagaataattcctggtgttctataggtgctcaggaaaacacacatttcattaacctgaattagtccctgaagccagctgtgcagaatccatatctgtgggagccctgtggctgagcaccccatctcttcgctccccttct

SEQ ID NO: 167799 - DNA, 203 bp, Homo sapiens
aagggtgatgggatcggtggtccaagccctccctccaggactccagctctcttgtaagtaagcagttgcccaagtcttgaagccattaccaaagccacttttccattatcagctgtgtggggttgggcatgtgttttgttgaagacattgttttacctatatagtgcatgaaccagagacagcatagagcaaatgtgcactaa

SEQ ID NO: 167800 - DNA, 598 bp, Homo sapiens
tatgttccaatcatatctgcccctgtccaagtccataaagttgaatacttccttttttgttcaaatatatatatatgcatctatcattacattttaccaaatggtactgcaaatatttaaatttgtcgcttataatacactgagagttctatgaggatagaaaatcatgttttccatgccttggatgtggcctccactctgtaaacactcaatgtattttatagatgagtgaatgagggaatgcatgaataaatgaatgaatcaataaagtaacatttagaggctaaaagcataaagaatttgatgggcatgggggcaaactactgaaagtaaagcaaaaaaatgtagaaagaagccttgaaatcccaattaacatttcctgattgcttcagaatagaatgctgtaaaatgagaggctttcagcctgtctgcatttcagttctgtgcagcttacaaaggaacctgggaaaaagctgacattgccactgtagctttgaggctttcaagataagcatcagtttgggttcagaagaaatgaacagtgatgaatattgtcttcagcttcacaatggtccttttaattcctgtcattctcaaa

SEQ ID NO: 167801 - DNA, 435 bp, Homo sapiens
aagccaaaccagggagtgaaacaagatcaaagattctccaaattagtggagacatacttccactccccagtgtgactcatggcaagtttatctgataagagtccagcttcacaaaacaaggagcgcaaaacaaggcacactgtggcgaacatggcaataaacaaacaaagatgcggaatgtgccaatgggaaagaactacatcaattctgagctggccctaacacattaggaaatatcctctacactggaataaaagtgaaaaaaaaccaagcaagtagagggcaaagggtaactaatactctttttagatataaaggtcagataaactctgaaggacactatcacatctgaaaggtggtggttatattgaacctgttaaggtaaagcaggtagggctctgagtcatgagaacaaatctatctccttcattgcct

SEQ ID NO: 167802 - DNA, 339 bp, Homo sapiens
caacagggagcaggcttgataacagaggctagtagcacagagctgacttcacccagagtgatgggcaggcacctctgtggactggggcactcccctccagccaccagtcaccatcactgcagagactcatgcggtggcaaaggctgcttccccctccttcttactgacccccaccatccttcctttatgtgtctttaaaaaaatcccaacagcacacaatgcttcttattcctttttcttctctccatccctccatcactgccctagttcaagctcctccccttcctgcctgggctgttgcagggctttctctcccagtctttctgcttctggccctat

SEQ ID NO: 167803 - DNA, 395 bp, Homo sapiens
accttgagtaagtcacctaaccatttttagtcccaatttcatcttttgaaaaactgtcaagatttaatgagataacaagtgtaatgaaaattattggcacaaaactggctccgactaaatgacatccagtctagcctctattcctttgctattctctccaatcctgaagaattgcagctttttcaggtactttgcctttgagagatacattttctcctaatggctcatagcactcagaaaggacagatagcatcctaatcctttactgctgtggctgctaccactgctactacttctcctaataccgtgttcccacagccaccattggggctattatcagctactgttaataagtgcttactaggtccaggtatttcatgaaacattttatatac

SEQ ID NO: 167804 - DNA, 397 bp, Homo sapiens
ggcaggagaatctcttgaacccgggaggcagaggttgcagtgaggcaagattgcgccattgcactccagcctgggcaacgagcaaaaccctgtctcaaaaaaaaaaaaaaaaaaaaaaaaaaaaaaaaaaacctctggtcaagagaattctttgtttctttctctattatttatttatttttaagagaactctttataaggtcaaagagcagatgatttagaagcagaaatgattaacctggaagttcaaaacattgtagcaagaatataaaattttagattggagccaggtggtggctcatgcctgtaatcccagcactttgggaggggaagatggcttgtgcccaggagttcgagaccaccctgggcaacaaaatgagacccccatctctacaaa

SEQ ID NO: 167805 - DNA, 569 bp, Homo sapiens
catgtccttcccattgatcaaaccagaagccttgcagacccctcaccttttccactcttccctcctatcccacatgcaaaccatcattaagccctggcagctcaacttcagaatatatcccaaatctgccactcctcacggtctcctctccaaatacccaacccaagcaccatcagttcaagcctgggttattagagtagccttcaaactgatcgttctgcttccactttcaccctatcctatttcccaccccgattgatctacttaaaatataaatcagatcatgacacccgcccaaaaccttcctgtggtagacaaatagattgacaaaacaggatagagtccagaaatagatctacatacacagagttcattgatttttgccaaagacccccaaggcggttcaatcaggaaagagaagttctcttaaaaaatgaccctgaaacaaatgaataggcataaggaaaaattaaacctggacccctgcctcgcacacacacaaaaattaatttgaaatgaatcatagatttaaaagtagaagtcagcatcatgaagcctctagaacaaaa

SEQ ID NO: 167806 - DNA, 267 bp, Homo sapiens
cagcacaactcactttaggtaacacaggtatgtttgaaaagtccataacttctccagattggaatggaccttgggaatcacccacttctgcctcctatcccagctgaacttccgcaaaatgactgaggatcaccctagcctcagcttcatcactcttagtgtcaggataatggtgacatttggagtgaagcatccaaaaccctcatgggatgccaacatctgctttcccataactgtccctggtcttggtccctctgagaaacacat

SEQ ID NO: 167807 - DNA, 268 bp, Homo sapiens
gtctctgtgactgtatcccatttcgtgccccctatttgtggtaacaggggtcatgcgatggcatgactatcttatgtgtctgtatgtatctctgtgccaccacaatcaccatggaagaagtgtggctgtgtgacaaaacaagccctggtgtgcaaaactgtgtccctccctgttcctgttttttttttttcttttgagacggggtctcctgtgtcgcccaggctggagtgcagtggcacaatcgctgctcagtgcagccttgaattcc

SEQ ID NO: 167808 - DNA, 686 bp, Homo sapiens
cacgctgatttcctagaacgatcttcatatttattttggaacaatcagttaaaaaaaaataaaaaagaatctgtttgggccacatatgccagaggctaaaggaattgctgtcctctgttctgttcctgtccacctcagcacttttgatctctggggcatgctgttggtcttaaccataaattgaaaatgagaggcagaataattaaagagcaaactgtaattatgaccaagatctaaagagagaaaaactaacattgagtatcggccttcaatttcctattagtgcatttaagattagctataaacagccttgttaaactcaattaaatagttcatcagaaggatttttcttattagtacaggctgagtgatgtgacttttagaaccatgttgctggttatgcatgagcatttttcaacattgattttgtactctaagattttattattgttattgttattattattattttatttattacagtgccatttaagaggctttcttgaaagatactgtttggcatgcaaaagctttgatgctcttcttagaaatgtcctctgctccaatgataagcagacataatttaaaaacattttaaaacatgggaaagaggagtttcccaaatatcatcatatagtttggttgaaagtgtaacaaaatacagagatgctcaacagaaatataat

SEQ ID NO: 167809 - DNA, 173 bp, Homo sapiens
ccgagatcgtgccactgcactccagcctgggcgactccgtctcaaaacaaacaaacaaacaaaaaaaacaaacttgacaccacatgctctttcactggtcactccattctttttcctttaaagacttgtatcatatatacttgtcttttaattcttccagtctctcttgtatt

SEQ ID NO: 167810 - DNA, 505 bp, Homo sapiens
ccaaaaaatcttgactgcaacctcatgagagaccccaagccagaaccactcagttagagcactcctgaatttctgacctgtttattcttattttaagcaactaagttttagggtaatgtgttatgcagcaatagacaactaatataatattttaattcgtatcaataaatgtttcataattttgtgcacagaaaacttgtacttttaaaattaattagatttttattagatttatttctaggtatttgatgttctttgatgcatctataaattgtatactttaaattttattaatattttgtgtcttgtatacagtaaaacaattgatttttatataatgacttttatccaacaacattaacgaattcttataacttttattaatttatgtgtagataaaagagttgttttaagacactagataagtttgttaattttagtaatttatctgtagattttcttgggttttctatgaatgcaataatgtcatctgcaaataatgaca

SEQ ID NO: 167811 - DNA, 586 bp, Homo sapiens
acgctagggaaatgttctaattataattcagtgaagacagggttgctattttaatatacattttttgagacttctttaaactttagcttcctattttgttattggtgtctttttcctcatagtagtagctgatgattttttcacaatgattggcacatttaaagcccttaaaatcaaaataatgaagttgggggaacattaaaacttaggaaacttcttattgcaaaggttgttctgaaatgaaggaaacccaaggtatgaggcaggaatcttagtggcaggaaatgaattttgtcttacataaacaaaaatatatttttggaaaaatactagatcagatcttggaatggatagaaggaaaaggaaaaagctaagtaaacaaacttcagaaaggcaaaacaagggcagctctggagggcctttctactagtgcattaccatgctattaaagtgaccaagctccagtgaattttgagcttctgtctttccttgaatttaaatttcccagaagtagactaccagagtgaatgtaatagtgtgaggcaaaattttcccctctaatactgtttttttataaaagcaacaa

SEQ ID NO: 167812 - DNA, 311 bp, Homo sapiens
cttctcaccctgtttaaattgttacgaagttcgactagagaattcttctccctgtggagttttatcccttgctcctctggccaccctcccgatggatccctgtggtgccaggcaggaatgggccttctggggacccagcgagctcccacggcctttctgctgcttcctctacccctgtagttcgctctgctgagtctgacttagctccaggtaaagttggaaatttctcctgcaaacagaccttcagcctctccagtgggggggtgtgtgttcgggagaggaggatctccctttcccacttccacagttgg

SEQ ID NO: 167813 - DNA, 191 bp, Homo sapiens
ttgtcctctacaccccagttcctcctttctgggttttctttcctcttggtggatctcacttcatcccctttctggagctcaatcctcctctcagaaagatctaatgtaaaacatgtacacttctgtgtgagtttataatcattcttccctttcttccttcctttcttttcatttttttttttttttttttt

SEQ ID NO: 167814 - DNA, 372 bp, Homo sapiens
cgtggcaaattgtagtgttcaataaatgtttgtagaatgagaaatttaacaccttattagtaagtctaaaaatataaattgcttttctgatatttgttctgaatttgctcaacttagaggagtttagactgtggcagtaacattatttgtagctacttctatagttgactgtgacggccttgggagagcagtttatgccacattaacaagggtaaacacaggtcatgaatcattgcatgggaagatggtggctatactgaacatagatacgtactcaggtgactttcatattcccacacacaagatagcatatcctaggggttaaaaccgcagccttgacatcatgttcccttgattcgaattatgtctcca

SEQ ID NO: 167815 - DNA, 225 bp, Homo sapiens
ttttggctgccatgaggagggctctcctgaaaagattttccttaaatagaaaaattcctgtggaaaaccacagatagaggcactaactagttttcaagttcttattgtctagattgagtttacagtgccaatgaaggtgacctgctagatcaggagtcagcaaacatttttgaaagggcaataaagtaaatattttaggtttttagactaatagcttcccttaca

SEQ ID NO: 167816 - DNA, 511 bp, Homo sapiens
aacaaatgtactggttaagattaatttaactttaataaacagagtcatattcctattctctcatttattctcaaataaattgtcagctgtggcaataatctaatattattctttcaaatagaaaatgctttagtagttgaggaccataagaagtgaaattaggctgggcacagtggctcatgcctataatcccaacactttaggagccggaggtgggcagatcacttaaggtcaggagttcaagaccagcctggccaacatgacaaaaccctatctctactaaaaatataaaaattagcccggcatagtggcggcgcctgtagtcccagctacttaggaggctaaggtaggagaactgattgaacacaggggggcggaggttacagtaagccgagatcggaacaagactccatctcaaaaaacaaacaaacaaacaaacaaaaaacagaaaatgttttcttctatggagactcatcctctaagttgtaattactcagtatcttaacagcca

SEQ ID NO: 167817 - DNA, 517 bp, Homo sapiens
aagagacgccctgcaaagactgaagaaacgatgtgaatttcctcatggctctaaactgggaattgtggagtctgaggaaagctggaaaagatgggagatggaacaggccttcctttggtggtgactgagcaacgggtctcctgttagccaagtgcaccgaggctaatttcccatccgtacgctctccaacgcctttgctccaatctcagccaaaactgcagcgtgaacggggcccagagcaggactcttggggctgactgttgcctcttgagggagggtcttcctgagttgtcttcccatcagaaccagcctttcaagagtggactatgaatggaagtcttgaggggaggatcttgcagaaatgggcgattacagggcttccagggtctatgctcgtgccaggggggatgaagcttgtttgtggctggggctgcaaatccctttcttccccccatcctagtccaaccagctctacagttaaagctcacggtgtggcatttgctaaaccctcaggcaa

SEQ ID NO: 167818 - DNA, 449 bp, Homo sapiens
agtttatctactactataggtggtgtatgaactatgggataccgagtcatcgaattcagtgattcatcgtcagtattcttgttaccatgttgttaaatgttctggaggccccagggcctggctttgtttagggacaaagggaactggtaaccagaagccgagagtttaaacacccactgcccttcttccctgctcctgctgctgcaacccagcttaaccagccaggagtgctaggaacccaagcagggcccccgagcacacagcaggcagctcacgaattctcttttcctgttctcccttgggagctgggaggatcttaatcaggcaataagagatggcactgagcagccagctaattttttaaatcactttattgtttaaccatatgactcacccacttaaaaaagggtacagttcagtgggttttagtgtattcacagatgtgtgca

SEQ ID NO: 167819 - DNA, 459 bp, Homo sapiens
ccgtgcctggcctggggtattgtcttcttatggcacctgactgtggtgggccctgggaaggaagtagcagaagagggttcttcttggtttcctggacagtaactgagtgttctggaggccccagggcctggctttgtttagggacaaagggaactggtaaccagaagccgagagtttaaacacccactgcccttcttccctgctcctgctgctgcaacccagcttaaccagccaggagtgctaggaacccaagcagggcccccgagcacacagcaggcagctcacgaattctcttttcctgttctcccttgggagctgggaggatcttaatcaggcaataagagatggcactgagcagccagctaattttttaaatcactttattgtttaaccatatgactcacccacttaaaaaagggtacagttcagtgggttttagtgtattcacagatgtgtgca

SEQ ID NO: 167820 - DNA, 198 bp, Homo sapiens
gtctagccatgctggaagctcagtgtactgagagaccgggttgcactggcaccgtagatgatgttggctacagatgtcaattatgtttagttgattgaggatgctgttgagttcaactatgtctttaatgattttctgtctgcagtctttgtcctgtctgcaggatctgtccatttctgacacagtggtcttgaagtc

SEQ ID NO: 167821 - DNA, 188 bp, Homo sapiens
ttgagaaaggaactggggcctcagaactacctctccagaccccattccccaacccaaccttggaggacagcagttcagtcctccaagcggagtgcttggctcattgcaacctccgctttctggactcaagtgatcctccacctcggccccccaggtagctgggactacaggcgcgcaccaccacaccc

SEQ ID NO: 167822 - DNA, 349 bp, Homo sapiens
gaagggggaaagcccttataaaaccatcacatcttgtgagtactcactcactatcatgagaacagtctggtggaaactgcctttatgattcaattatctcccaccaggttcctctcatgacacatggggattatgggaactacaattcaagatgagatttgggtgcggacacagagccaaaccatatcaaagtggtttttttattttattttctgtgggagacaacatatttaaaagccaactagaaggaatcagttcagaagttgttaaatatacaagagaggaggaggaagaaataacaaagttttctgagaaggtgaaggagataagatccaaagtacacatagag

SEQ ID NO: 167823 - DNA, 456 bp, Homo sapiens
ccatttgctttttatgaaggaatatcgctagcatgttgacactggttccatcaacttaagctggagaatttgtaactgttgcctaaatcaggctagtttgttccatttctattgaatgaggtaggtattcagccctgatagtgcattttccagtctatcatgattgtaacacacataaaattagactattggtgtgaagcatcacaaacccccaaagtcagtgtgttgtgttccttagaaatactcaaaaaatatatacagttgccaagaattctcaagataaggattgtgatcaatatctgcttattgttataagatcttatctttctcttcttcctttccctagccccattataagagactctctccaataaaaatgatacgtgaacaaagggaaaacatttaacatctactaactgaatcatgatcttcaaacacttgctcatgtaaccccta

SEQ ID NO: 167824 - DNA, 341 bp, Homo sapiens
  misc_feature (27)..(27): n is a, c, g, or t
ggtgtgcatgaggagatgatccaaggncagtgggcctcccagtgagaaccaaacaggagtggccaggctccactcctggggccagagtgaaaccggggtttaatcactgggctatgtggtctctgtgtctctggcctgaatgagatctcttcaatgtcgggggacagggatccctggatgagaattcacaagcgactcattgacttgcacagtccttctgagattgttaagcagattacttccatcagtattgagccaggagttgaggtggaagttaccattgcagatgcttaagtcaactattttaataaattgattaccagttgttaaaaaaaaaacaa

SEQ ID NO: 167825 - DNA, 224 bp, Homo sapiens
tacctgtaattaccactcccgacccggggaggtagtgacgaaaaataacaatacatccagatgagaattcacaagcgactcattgacttgcacagtccttctgagattgttaagcagattacttccatcagtattgagccaggagttgaggtggaagttaccattgcagatgcttaagtcaactattttaataaattgattaccagttgttaaaaaaaaaacaa

SEQ ID NO: 167826 - DNA, 193 bp, Homo sapiens
aagattctaagacctgggatcatttccagatgagaattcacaagcgactcattgacttgcacagtccttctgagattgttaagcagattacttccatcagtattgagccaggagttgaggtggaagttaccattgcagatgcttaagtcaactattttaataaattgattaccagttgttaaaaaaaaaacaa

SEQ ID NO: 167827 - DNA, 355 bp, Homo sapiens
cctcttacagtgaaggctttagcaatttcgttcagtgttccttcttgcatctgattctccatctgagatcattttccttccacctcaaggacatccttttgtaagtggaaactctgcttttgtcggaaaatgtttttagtagctttttaaaaagtgtcacctcaggtaagctttcataataagttcctttttctcttaacatgatgaagataaatttcactgtttcctggctttcattgttgacacagaagtcaccatctggctggttttctacaggtagtctgtattttctctccagatgcccacaatcttttctttggttttctgcatctcaccctgatgtacaggaaggttg

SEQ ID NO: 167828 - DNA, 355 bp, Homo sapiens
cttttctaccttcaccaccatatatcgttagcgcgccttccttcttgcatctgattctccatctgagatcattttccttccacctcaaggacatccttttgtaagtggaaactctgcttttgtcggaaaatgtttttagtagctttttaaaaagtgtcacctcaggtaagctttcataataagttcctttttctcttaacatgatgaagataaatttcactgtttcctggctttcattgttgacacagaagtcaccatctggctggttttctacaggtagtctgtattttctctccagatgcccacaatcttttctttggttttctgcatctcaccctgatgtacaggaaggttg

SEQ ID NO: 167829 - DNA, 351 bp, Homo sapiens
tcttttgggcaaatacagacagctttaataaacaacaattattaaatttctcatgagactgagtgagatgattcctgctgagcttaggaattgattcctatgtgtacttgagacattgaagtctagattgagttggaccatgttctgtatgtttatgctgtgatgttctttacttcaagaaactctcacactatccaacatcagtctcgtaagaggctaaattctcactatttgcagggcactgatcctttctgctaggaaggacaaggtagaatgaggagaggtggaacttcttcagggcaacaggagtgaccatttgcctaatagagctttatgtccatagttgttcat

SEQ ID NO: 167830 - DNA, 317 bp, Homo sapiens
gggcagaaggaagagaaaggagggagagctgtgtatattctatacatagctgcatatacttctccccaccacccccagatatctgtgacattataatgctgagaagttaggttacacagcacgtattaatgcacagacttaaccattccgtattttttaaagttagccacaaagtattgtacaagccaaaatggtacatgatttttcatctacagactatatagtacaggttgttgtacagttggtatgaagttatttatcagcaggtttttcaaacttggcagctctttcttatccctctcttggttaagacaagt

SEQ ID NO: 167831 - DNA, 354 bp, Homo sapiens
caggctaacatgaagtaaccaactagttcttgacaatgtgacaatacaattcaatggggaaagaataatccttttaaaaaacggtgctgaaagaaccagacaactgtaggaaaatttttcaaaaaagaattaacccttcctggcaccatatataaaaattagcccaaagtataccccacacctaaaggtaaagatcttaaactatacaacttctagaagaaaacaaagtgtcaaatcttggtggtcggcaaacattacttaaatacaacacagaaaccatgaattatcaaggaaccaactgttcttcattaaaatttaaaatgtttcatttccaaaaggaaaactagtaagagg

SEQ ID NO: 167832 - DNA, 260 bp, Homo sapiens
tatagatctaaaatgtaagactttattatatgaaatttattattcataatagatctaagcccaggaggtcaaggctgaagtgagtgctactatattccagcctgggtgaaagagagagactctgccaaaaaataaaaaataaaaaataaaaaataaaaaaaaatttaaaaaaaatttttttttccttttggccaaccccggaaaattggggtttggaaaaaattttaaaaaaaaaaccttattttttagagaaaaagcct

SEQ ID NO: 167833 - DNA, 696 bp, Homo sapiens
caaaatgaaaattgatgagctgattccagaatggaaatggaaatgcacagcaggacctaaaacagccaagaccctcgtcaagaacatggtggaggatctcaaggctcacagccgtgcagacagcgtcacatgggaggaaagggaagaaaaacaggtccacggaacagaagagtccagacggacccactcacatgtggccaactgcctttccacagaggagccaagccaaccggaaggagggctcctcggcgcatcgtgccgcagcgacctgccatcccgggaaagggtgggccaccaccccagcctcacaccacgtgtgagtggcagcccaggagaccctggacctagaggtagaagcttccagaagaaaacacagagaacctgttacccggatgaccctggggtaaacagattcctcaggacacaaaaggtattcacctaaaaaacgggtgatacgctgggcttcataaaaactgaaaacgtgttctcgtcacagagagaggtcaagaaagtgaaaagtcaagccacggcctgagatattcgtaaacaagaaaaaacaaaaattttgaaattatgaaaatatccacaatgcatgtcgatctgacaagaacctgacgcagaccacgtgagggcttcgtaaccaacacgaaaaagacggccggaggtgctccgagtggccaagggcacaaagaggtg

SEQ ID NO: 167834 - DNA, 444 bp, Homo sapiens
agaagagtcagaaccagcaagaccagacgcaggttgctcacacctggaatcccagcactttgggaggccgaggcggaaggatcctttgagcccaggagtttgagaccagcctgggcaacacagtgagccctcatcttacaaaaataaattcaaaaaatcaggcaggcatccctgagtgaaggaagtggggcaccctctaaacttctaaagccaagaaaacggattcttagctgctgacatcttgaatttagctgtgagacctgttttggacttccgacctccaaaactgtaagataataaatgtgtgctgtttaaagccactacatttgtagtacatttttacagcagcaatgggaaactggtatagtgcctacaacatacatattggtagctaaataaacattttatttcttaacacaacctgctaaccttaacccttgtctg

SEQ ID NO: 167835 - DNA, 902 bp, Homo sapiens
gtatactttattatttgggtgacatcatagctaaaaaaactgtgatgaattcagtaattcttttaaattaatatatattttagggatgacactatttgttcccaagtttaggaatcaaagaatgagtctagaatgtatatacattttaaaaataaacaaaggtaaatgggcaaacactgattccatctacaggtgggactggtggtagtaatgagtcccagactcttaccacaactaccacttaaatagcagtctggcttccagactgagaaccactagcctagaatgaacattttaaataagggtttttttgtttttgtttttgtttttgtttttgtttgaaacagagtctgcactccagcctgggcaacagagcaagaccctatatgaagaaccaacaaaaacaaagagatctttccgaaatttctaaggaccccaccttcctttttcccatttggcaaagtttgcgccacgtgattgtgtgtgtcacccagcgctgtggcacccatcaaagccctttggagtgacgggtgggaggtccaacaccctccacgagaacgaagcagaaccaatattcgtgtcgcggcgacgcccttacttaaaggccttcacagaaaaggccttcgggaagtgtgggtaagaaggcaacacagggggggcacacaccggagaaaaggagcggattgggacgcacaggggcgggcacagaaatcacggggaccattatttagaggccagtcagaaacggacactgggcacccaagcacggggatccacattacgttcacaataagggccgcaaatcgagaagggcaggaacgcaataactagcggtaccaggtcacaggcccgggtccaatccagaggggcaaacccggcaagcgtggcggaggacgaaggaa

SEQ ID NO: 167836 - DNA, 110 bp, Homo sapiens
agatagctcaaatcataaatcagcggggcttcagaatctgagagagaattgagcagtaatccccagttgtgagacagcaatggacacagtgggcaggcgagtactgaact

SEQ ID NO: 167837 - DNA, 575 bp, Homo sapiens
agtcccagcagagtcccagagactcaacgtttctttcctcagttaacaaggtttgtccagagcagtgtgttttctacagaaactcagatgttgctctaaatggagtttcctggagttccatgctggccataagcctcctgtgaataatgcagagaaaaaggagatcgcagttcgagccgattccctctgcccgccgactctggaaacaacctcttccctccttctcacgaatcaagattccacgccacaggttagcattgcatatggccaagtcagcagcctctgaactaaatttttgatgaattcaactgtaaaatattcacaacctggaaattcataacgtgattcatgtttttatcattttttttctatgtgatctcataaatgcaacagaaaatattagtcatgaggcaacatgaggttgggacccacatgaagaaacagctcccccgaggaaaataaaatgaacctcctcccaggacccagacctccctagaggagccacggtgttttcgttttaaaagatagtcaaaataaataaagatatgtggatgcagagccagcagtggcggccg

SEQ ID NO: 167838 - DNA, 393 bp, Homo sapiens
aacccttaggaactgtgcatacaatttattaagtagtcaagtaactttaacccatttacgcaggaggttgcaattttttgaatttgtgcatgagtgaaaaatcagaccctggtgatgatcttgagcagtagaatataaataactcctacacgcttagtgttccaataatggaacaccaggcataagtgcaacatatgtttgaactgcatggccacttatatgcagattttttttcaataaacatcacactgagtgtgcctgcctctcctgcctccccttttacctcctctacctcttttacctctaccactcttgaaagaacaagaccaacccttcctcttcctcctcagcctactcaatgtgaaggtgaggatgaagacctttacaatgatc

SEQ ID NO: 167839 - DNA, 190 bp, Homo sapiens
ctgggatgtggacattttggtctaggaaaactactcaaagatgtggatgttgctaaggagagatgtcacccctgaaaatgggaaatacgtttagggttaagcaaataatgtaggatataataagcaaagagaaaaaggaaattagaattgagctaatttgagaacaacaaaatgtctgtgacaggaattt

SEQ ID NO: 167840 - DNA, 176 bp, Homo sapiens
acaatgcctcccaaatgatcactgagggggtctaaccaggtagaacactgcataacaatagatattggggattatcagttgagacaactgcctggttacaatgggaaaaatctagctgcctcctgtataaactgccatagcatggcctgcccaaataaccaccagccccgtgcttg

SEQ ID NO: 167841 - DNA, 434 bp, Homo sapiens
ttttttttttaatctatcaaagagctcatccagcatgcaagtgtcctgctttctgatccagcagcctttctagcaccccggccttgattgtcagaatagcatctgcttataaggtttttaaattattaatacagtatactaaatcccaggagtagaataagccttgttattacggctagtaagtcagcccagagcaatctgatattcctgtaaaactgaatggattttgaagtaaagcatccttgggctcactggcctcagaggaggccatcatctcatttacctatttaagaaaaaccccataaaagagtgttctatatggacattcattatgtcttaagctttattgattctgttatgttgccgttaattataggaaccacgaaagccttcaattagattaaagccataataaataagattagtaacactta

SEQ ID NO: 167842 - DNA, 311 bp, Homo sapiens
agaactatgtcattgcaggattatgtgtgtgtgcccgtgtgtgtgctcacaggctttgaagagttttatgagtatccattatccaaaatgcttggaaacagaagtgttttggattttagattttgaaatatttgcattatacttaacaagttcagttcagcatccaaaacccaaaatgctccagtgagcatttcctttgagcatgtcagtacgcaaaaagtttcagattttggagcacttaagatttaggatttgggatattcagcctgcataatcaaacctccttcattcaggaatgtaaaaggaggtat

SEQ ID NO: 167843 - DNA, 515 bp, Homo sapiens
ttgaacttctgacctcgtgatccacctgcctcggcctcccaaagtgctgggcagattcatgtgtttctcctgcctcagcctcccgtgtagccgggattacaggaatgcaccaccacacccagctaattttgtatttttaatagagacagggtctctccatgttggtcaggctggtcttgaactcctgaccttgggtgatctgcccacctcagcctcccaaagtgccgggtttacaggcgtgagccactgcacctgccccccttttttttttaatttactttttatttcaaaataattttatacttagaaaaaaatgtggcaaaaatagtatgcagagttctcctgtgttcttcacccagctcctaatgttaatggtttacgtaactataatgatcagaatcagcaagttaatgttgatatcatatagttaattaatctgttgtcacaatgacgtcttttttctgatctgtgatccagttcaggttcctaaattgcatctaattgttaagtcttct

SEQ ID NO: 167844 - DNA, 258 bp, Homo sapiens
gaattgaaacaagacaaagatgcccactctcaccactcctcttcaacatcgtactgaaagtcctagccagagcaatcagacaagagaaagaaataaagggcatccaaatcagtaaagaggaagtcaaactgtcactgtttgctgatcatataattgtttacctataaaaccctaaagactcctccagaaagttcctagaactgatgaaagaattcagcaaagtctccagatacaaaattaatgtacacaaatcagtag

SEQ ID NO: 167845 - DNA, 802 bp, Homo sapiens
  misc_feature (444)..(444): n is a, c, g, or t
  misc_feature (575)..(575): n is a, c, g, or t
  misc_feature (626)..(626): n is a, c, g, or t
  misc_feature (690)..(691): n is a, c, g, or t
  misc_feature (702)..(702): n is a, c, g, or t
tctactcatccctgagctctcacagcccctttaggggcaggacccctgaggatgaaccctcattccgccggtctctcggatccccctttctcttttgcttgattgcccctccaaacaggaaggcgccaacaaccctaccttgagtcagacctgcggcaactaggcaagctgcagccgcgaggtagaagctctctctgacccttttaccttaatggttcgtacccgcgggaaataaagttggaaaactgcaagcgatttccgatctacggcttcttccagctcctcagatttatcttaccgtcccccccgcgaatcctctcaagatcccaccgagagatggattcgaagactctcccctccttccgctgctggattctggcccgtgccccgtctctctccaccccagcggcttcccgagtgattctccaagggcaaatgaatttngaccaggaagacagtgaagaaatttcataaaagtgaaatactaattggaagctcctatcggcattggttgatctgacaagttgtgtgtatagaaactagcctatatggagacacgaatgtcaaaagaagtnttaccgatgatagaaatatgagaggatcattatgtattcttcaagaaaaangaaatatggccaaaggatagtaaaggtaatactggcaaaaatatccagatgtattgacggaaanntgtgacaaaanggccagagtcaaattatataacataggatgtgattccaataaataaccagggaccctgatggatcataaataaatacttggaatcttacattggaaaagc

SEQ ID NO: 167846 - DNA, 446 bp, Homo sapiens
ggcagtctcactttgttgcccaggctggaatgcactggcatgatcttggctcactgcaacctctgcctcccgggttcaagcggttttcctgcctcagcctcctgagtagcggaggttacaatgagccgagatcacaccactgcactccagtctaaaaaacttatagaatgtgtaacaccaagagtacaccctaaagtatggactttggatgataatgtgttggtgtaggttcatcaactctaacaaatgcaccattctcctgagggatgttatcacagaagtgtggggacaggagtatatgggaactctcctccatattttttgctcaattttgctgggaacttttttaaaaatggtgaaaatgcaaactttatgttatgtattttcccacaattttaaaagatttggtcgacgcggccgcgaatttagtagtagtaggcggccgc

SEQ ID NO: 167847 - DNA, 352 bp, Homo sapiens
ggcagtctcactttgttgcccaggctggaatgcactggcatgatcttggctcactgcactccagtctaaaaaacttatagaatgtgtaacaccaagagtacaccctaaagtatggactttggatgataatgtgttggtgtaggttcatcaactctaacaaatgcaccattctcctgagggatgttatcacagaagtgtggggacaggagtatatgggaactctcctccatattttttgctcaattttgctgggaacttttttaaaaatggtgaaaatgcaaactttatgttatgtattttcccacaattttaaaagatttgctaaataattggtcatttatagaatttaaaa

SEQ ID NO: 167848 - DNA, 326 bp, Homo sapiens
ggaaaagcttaggacttcctgggattaaaaaaaaaatgcgctgaaattcatgatagctgaagtatccatggaatatagaagatgcacattgacatgcaccttataaagtctataatcccatgttttgttcctaatattcatgtttatttactctcactggtggaaaatacaccatatccaattcattgtctcttaattgatgaactatctttgcaaataatataatatataatacaatgtaatgtataatagagtgtaatgtgatgcaaactcagtgcttgcagatatgctcaataataaaggacattataggtatgaaaatacta

SEQ ID NO: 167849 - DNA, 176 bp, Homo sapiens
aaagaccttgctaataataaatgagagcccgcctccctttgatatgtccaagctgaggaagacttcctgatgactgtcatgtaaaacagcagaagacacccacagacacacagagagaaacagacacacacgagtaatacaaccccagggatcaccacccaggattaataaaatag

SEQ ID NO: 167850 - DNA, 178 bp, Homo sapiens
ccaaggcttctgtttgtctcaagttccgtttccctcctttagttcacatttgttcatgctacgaattgtcgtcactgatgtggtcattatgtacatgaaccacagcctattcttgcaataccctacttcaaaattctttttgtagtatttcatcaggcacaataacacctgtcatccc

SEQ ID NO: 167851 - DNA, 165 bp, Homo sapiens
gcctcagtgtctgcatctgtaaaatgagcagcagcatgacaccactcagctcccggttaccagggaaacacatgagagcgcaaataaaagagtaaagaaaaccgcctgctggaacccagtcaaaggtaaccactgtcatccgggtgtgtgttggggcggtggtgg

SEQ ID NO: 167852 - DNA, 504 bp, Homo sapiens
  misc_feature (413)..(413): n is a, c, g, or t
  misc_feature (417)..(417): n is a, c, g, or t
  misc_feature (421)..(421): n is a, c, g, or t
  misc_feature (462)..(464): n is a, c, g, or t
aaattcaatttatacacaacactgagaatggttggttttttttaaagaaagacagagagcaagaggagagaatgagagagatacacatacacacaaatcaacaaagtcttcacaataaccaacaaaagaaagagctaatgtgacacagtttaggcagctcattaaagatttactaagcagtgcatcaacaaaattaacaacagaattaaaaatgcacaacttccgggccaagtgtggtggctcacacctgtaatcccagcactttgggaggccgaggcgggtggatcgcctgaggtcaggagttcgcgaccagcctgaccaacatggtgaaaccctgtctctaccaaaaatacaaaaaatcagccgggcatggtggtaggcgcctgtaatcccagcactttgggaggccaagncggntggntcatgaggtcaggagatcgagaccacagtgaaaccccatcnnnactaaaaatacaaaaaaattagtcgtcatggtgttgtgcg

SEQ ID NO: 167853 - DNA, 398 bp, Homo sapiens
aggatccagccatggcagcaagaacagaaggtggggtgcctgatgtgctgcaggctgtggggcacagcggggtcagaagaggcagaagccagtaggcagagcaagccgagcctgttcgtccattctaaatgcagtgggaagccactggatgcttttaagcaagatggtgtacagagtggtaagatctgatttataaaatccttctggctgctgagtaaaggttgacaagaaaggctgagagtagcagcagagagaccagctgggagatattgctgtaaccccaatgagagatgctagtgacttggaccaggtgggagcaggggagttggagggaaggggacagattcagtatgtgtatttgaagtagggtcaatgctccctgacgatggatagtgcat

SEQ ID NO: 167854 - DNA, 206 bp, Homo sapiens
caaaagcccaggttttctggtgcgtccctcccccgtacaaggctgcttgcactctgccacaggtccctggcctggcaccatagtgacagtcctggtggaagcagcgttcgtggagctgcaaggtcagcagccataggagctgtgaacttttcgtttttcctcatgctgactgacacatggggataccgtggcgcctgtggtgggga

SEQ ID NO: 167855 - DNA, 329 bp, Homo sapiens
agagagaggagaaagtgagctcagcgagttggccgggtgacacactgatgaaggggtcaaaggacactctgagttagtgccctcgggacacacagcgaacagtgatcatgaaaagagtgggctcaataattttccataaacttgctcaagattccatgcagttgccatacagcctttgaggtatggtcaacctatagtaagttagtaaatgataaggggaggaagaaatggaaacctaaacatctactgcaatgaaaaccaacagcaatgacagtaggagtaattcagccttcgttgaaaacatgacatcaaacacactctggtttccc

SEQ ID NO: 167856 - DNA, 269 bp, Homo sapiens
gtctgtcctagcatcctcccccaaaaggaatgtttcctatttacccacacatcctgaccctcccctctcccactatagtcagggcgtcttcccagttcttggttcacatcccttgtgctaaggtttgggccagggctggcatacctgttccacatggtacatgaaacatacatggtatcacctgtgattgattggtgtggtctgcctggagcactgtgtggaaaaggatttaaagaacatgccaggtgccatgatcagttaacactgtt

SEQ ID NO: 167857 - DNA, 137 bp, Homo sapiens
atgggtaaattgtatgatatacaaattatatctgaataaagctgttaaaacattaggcaaacatgaaagaatcctaaactctataaatgtttaagaaacagaaattttgtttcataatttacatttttaacttaata

SEQ ID NO: 167858 - DNA, 462 bp, Homo sapiens
gaacccagaactctagctccacagctggcattcctaactactcttttgctctcttggtatggtggctacaaaagtcaactaaaacttagggtcctagggaagaagcacgcagagaaagccatggaaataagcaattcggtcttcatttaacaaatatgtattgagtgttcaccctgtttcagttgctgtgctaagtgctcagctacatattacaaatataacttatttgtaaggattcatagcttccatatttattttatgaaactaatatcttcttgaaagaaaaattaacacagggcataaatgaatatggctgcaaaaataccaaagaaaacaccagctaacaaaattcaatagaattgaaaggaattgcatgtcacagccaagcacagttgctctcacaagcataaggatggtttaataattgtgacaattattgccggccacagtggctcacgcctg

SEQ ID NO: 167859 - DNA, 334 bp, Homo sapiens
tctgtcgcccatgctggagtgcaatggcgccatcttggctcactgcaacttcgacctcctgggttcaacccattctcctacctcagcctcccaaatagctgggactacaggcgcatgccgtcacgcccagctaaatttttgtattttttagtagagacagggtttcatggtgttccccaggctggtctcaaactcctgagctcaggcaatccgcccacctcggccagagccatcttttatagtcctctgcccaatccatggccccttccacctttgttcattctgctcccactatttggaaagtcctcattctcttccctcggcctatttaaat

SEQ ID NO: 167860 - DNA, 247 bp, Homo sapiens
tctgttatagtaactaacccggactctctgtggatggtccttagtctaaactacctgcatggattattttatagtaactagcccggactcttctgatgagggctctttcaatcaaatttagtataaacctaataagcaatttcagtcaactaagttgaacatttcagttaaacttgggcaataatacaatttattcagaattgttttgtattgcatttgtcaatgcttattcttctaagccaaaaaa

SEQ ID NO: 167861 - DNA, 158 bp, Homo sapiens
atactgcaggcaaaagtaaaaattataagaattgcacaaagaaggatatggggtaaatggaatcagttatacactcttggttttctcctcactgagactgaagaggaaattaatgaattttacaatatgtgaagccagaaaattaactttcccctcag

SEQ ID NO: 167862 - DNA, 579 bp, Homo sapiens
tatatttggtcttcaaccccatttcctgacatacaactcctaaaatccttagaaacaccaaagtgtgatgtcgttttgtttattaatgagttgactgatgtctggcagcccctaggtagcttcaggatgggggctggtgaccagaaagaacaaggggaggattagagagttgggactttcagcccacctccaacttccggggaggggagaggggctgaaggttaagccgatcaccaatggccaatggtttaatcagtgattcttatgcaatggagcctccatacaaagacccaaaaggacagggcttggagagcttctggatagctgaacatgtagaggttcctgaagggcggcgcacccagtggaggtgcatggaagctccatgctccttcccccatactttaccttatgcatcttttcatctgtattttttgttataaaccagtaaacccaagtgtttctctgagtttcatgaactgctctagcaaattaatacaatgcaaaggaggaagccatgggaaccccagcttggaaatggttggtcagaagttctggaggcccagacttggaactggcatt

SEQ ID NO: 167863 - DNA, 299 bp, Homo sapiens
cacaggcctccccagtacctggtgcctgcaggacgtaggtgggaggaaacgcattctcgtccctctggaagtatcgtgccaccagctccaggtcacttggcctggcagtcagatggtccctcaatacctcccactccttctcatcgatccgcgagggaatcagacaggggccgtactgatcaccgatgagggcctggcagagaggaagtcacagattcaaatctcactttttttcttcagacaaggtcttgctctgtcgcccaggctgctctcgaactcctgacctcgggtgatccacc

SEQ ID NO: 167864 - DNA, 865 bp, Homo sapiens
tcagcctcccaaagtgcggggattacaggcatgagccactatccactgcatgtacacctccaggagaagcagggctgcactgaagtggagacaagggatggaggtgaagggagaagcattctagatggaagcacttagcatctggtgaatgagcagaagtgatgctttcagagagagttcagatttcattgtagaagcccaagcagcagccgggcacggtggctcacgcctgtaatcccaacactttgggaggctgaagcgagcggatcatctgaggtcaggagttcaacaccagcccagccaacatggtgaaaccccatctctactaaaaatacaaaaattagccggacctggtggcacgctcccgtaatcgcagctactcgggaggctgaggcaggagaatcacttgaacccaggagggggaggttgcagtgagctgagattgtaccactgcactccagcctgggagacagaggctccaactccatctcaaaaaaaagcaaagaaaaaagcacaaacagcactaagatgaccccaaggggaataaaatcacttccaacatcacttccatgggttgcctgcactgaccccacagacaagtctcccttagtccctgtgcttcttcagagcatctactacaactgtaattaattattgcttaagaattaaattcatgtctaaacctgctagacaggcagcaccatgaattgttcaccatcttgctcaccactatttggtccatatttgttgaatgaatggatggatgaacactacatacaactgttaccaaagatgacaccaaaagaaattaattcctccgatgaagtgaattaatgaaaaaaataagtgaatgaaaaagtgcgtg

SEQ ID NO: 167865 - DNA, 357 bp, Homo sapiens
ctgaggcacttgctggcagagtctggttgtgattggctaaaatatcatcccccacttccccagaacactgatgctgccctgaagtcagcactgaaagcaaatacaccgggcgccagctgcagctgcacacggcccctggcacacatcgctgcccagcagcacatggctgcacctgacaagccctccggggcaacagagacgccgtgagccaatggcccaaacgttgccaggtgggcagcagctgtcagtctactggccacacaactcactcaacgctgcccaaggctggtgggcaaaaccacagggcccaggcctgcccagcagcctgagacccagctcctgtctgtccctgcagtg

SEQ ID NO: 167866 - DNA, 514 bp, Homo sapiens
cttctttgtctcttttttgttattcttcctctttctcctcccttttatttttctcttcgccttcctcctttttgcatttcgataaagttcaaaatggattcctatagtccattctgcattgctctaaaggaatactaaaggccgggtaatttataaagaagtttatttggctcacagttttgcaggctgtacaagaggcacggtgccagcatctgcttctggtcagggcctcaggaaacttccactcatggtggaaggtggaggggggccggcatgtcacatggtgagagagaaagcaggagagtgaggggaggaagtgccagtctcttcaaataaccagctctcacatgaattaatagagtgagaactcactcatgaccatgggcagggcattaagccattcatgagagatccatgtctgtgacacaaacacctcccactggctcaatctccagcattggggtcacatttcaacatgggatttgggggggacaaacatccaaactgtatcact

SEQ ID NO: 167867 - DNA, 493 bp, Homo sapiens
acgaaccaacaaaccaacaaacaaacaaacaaaagagctatgttgtttgttcaaggacaggtataccttttatatttttttcagacaaatttgtggagtggactctaacctttgagtctgtattaaatatttacttgtgtctcctgcataacttcttcaaatttagaggcagattaagataaataacttaagcactatcattgtacatgctagcttgacactgttgattctgaagtattttattgatattgaaagaaccagttttctatttcattgatttttctcttttctgttttgttgttttcctgtctgatctttactatttcctttcttttactttgggtttaatatgctctttttctagattaatgtggaaaccaaggtcattgatttgagccctttcttaggtaggtagtcctataaatttacctccaaatactgctttagttttattctatcaattttgatatgttgtgttgtggttgtcattcaa

SEQ ID NO: 167868 - DNA, 594 bp, Homo sapiens
gttggggaaagggtcacagggctgacttctttggaaggccttggactgagagctccatgaagacagggcattcttcatctgtcttgtttccatatttctggaattttccacagagcctggtgcagagtgggtgctcagtgtaaattaggtgaacaaatgaatattgaggtggtggccagggtcggaggtaagaggtgcggctgtgttcctaggagcaggctttttctttaattttctctcaaccgtctcacggagaggccgcacattcagtggaaagtgtcgttttggagtcagcaaattgggtttaagttctggctccatggctgtgtggccttgagcaggttgcttggcctctctgtacctcagtttgctctcctgttaaatgaaagagctctggagagccaggtcagaaagcgtgtggcacattgtaggtgctcattgaatgctagtgtctccagctccaccagagcagccccctcacatggaagatagaaaaaccaaggctctggccgggcacagtggcatcgataaacaccggtgtttatcgatgccacagcatgacagctacttcctgtctggagagaactgcgtggt

SEQ ID NO: 167869 - DNA, 1201 bp, Homo sapiens
aagaagaggcgagaacgacccccggaccgaccaaagcccgcgcgccgctgcatcccgcgtccagcacctacgtccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaaggtacccaaagggaaaaagggaaaagctgatgctggcaaggaggggaataaccctgcagaaaatggagatgccaaaacagaccaggcacagaaagctgaaggtgctggagatgccaagtgaagtgtgtgcatttttgataactgtgtacttctggtgactgtacagtttgaaatactattttttatcaagttttataaaaatgcagaattttgtttacttttttttttttttttttaagctatgttgttcgcacacagaacacttcattgttgtttttgggggaaggggcatatgtcactaatagaatgtctccaaaactggattgatgtggagaaaacacctttcccttccagttttgagagacttcctcttggctcccaggaggagggattccttgactttgacacacatggccaccttggcacaaaagccttgtgctatggaaaaacaaatttgtttttatgtcctcttctccctttccacgtttcagcatagacttaactcccttaagcccagacatctgttgagacctgacccctagtcattggttaccagtgtgtcaggcaatctggactttccagtgatgccactgagatggcacctgtcaaaagagcagtggttccatttctagattgtggatcttcagataaattctgccattttcgtttcacttcctgaaagtcagggttggcttgtgaaaagttgttaaacaacatgctaaatgtgaaatgtcaaccctcactctcaactttccctgttcagagcatcagatgaagacttcattgggttttatagtggctttctgatttttggtagtccattgaagaagggagtttgaaagttgttgtatactgttaacgattgtctgcccatgtcctgcctgaaataccatgattgtttatggaaagtatctttaataaagctggatacagtttggcttggaaaaaaaaaa

SEQ ID NO: 167870 - DNA, 801 bp, Homo sapiens
aagaagaggcgagaacgacccccggaccgaccaaagcccgcgcgccgctgcatcccgcgtccagcacctacgtccgctgccgtcgccgccgccaccatgcccaagagaaaggctgaaggggatgctaagggagataaagcaaaggtgaaggacgaaccacagagaagatccgcgaggttgtctgctaaacctgctcctccaaagccagagcccaagcctaaaaaggcccctgcaaagaagggagagaagtctcacagaaagttctcctgctcccagacatgggtccctcggcttcctgcctcggaagctgcagcagcaggccatcgtgggaacgtgtgaagagcttccctaaggatgacccgtccaagcctggtccaccctcacagccttcctggtgatacaatgtgcttggcaatgactcacactcgtgctggtgaccgtctgccacggcctggcgtatccacaggtgaacccgaagtgacggtggttggagcgctcgtgcacctatgtgtaccagacacccacccatggcgcgcattgtgcggcatcagtagaggcacatacgatggcaaaaccccctccgcacgagacctaccgcgagacttccaagcactcgacataatgcctgcacaccaccaatcagatcgatgaactgcaaacgaaggcaggtaccttattcaccaccacggcataccacgactaagacacaaaggccatataccaagtactgccagaccatggcacgcaatcaggcatgccacaacgcagctcgcccccggcccaccacataagaccactgca

SEQ ID NO: 167871 - DNA, 173 bp, Homo sapiens
cagatcagtacacacagtgaaggtgtaaaacagcaatcattttgcagtggagttgccggcaatttttcattctcctttgctcacgtgtacttcctcatttctgtgcactaaacgcgtgttactcgtatttaaataagtaatcaaagtttgtgagattccatggcagctccctg

SEQ ID NO: 167872 - DNA, 524 bp, Homo sapiens
ggtgttcttcttttcaggaacattcaatggcctcccattccattgctattaagcacaaactactgacacatcaccttatggttgtgtgagatatactgagccgtccttctttgtcccctctgctcactctgttggtctccacaacactctttcttcaaacatgctcagcacactctcacccagagcctttacatcggcttcctcactgtctgggatgctcttctctcaggtaatcaagtggctcactcactcacctctttaaaatctgtgctcaaatactgctttctgttcatatggaccctaaacacccatctgtacttccaattcctttttttttttttggagacagagtcttgctctgtcacccacgctggagtgcagtggtgcaatctcagctcactgtaacctccgcctcccaggttcaagcaattctcctgccttggcctcccgagtagctgggattacaggtgcatgccactgagcccggctaatttttgtatttttagcagagaatgggtttcacc

SEQ ID NO: 167873 - DNA, 593 bp, Homo sapiens
ggtgttcttcttttcaggaacattcaatggcctcccattccattgctattaagcacaaactactgacacatcaccttatggttgtgtgagatatactgagccgtccttcttgtcctcacatctctaatcttctcaccttctgactgtcccctctgctcactctgttggtctccacaacactctttcttcaaacatgctcagcacactctcacccagagcctttacatcggcttcctcactgtctgggatgctcttctctcaggtaatcaagtggctcactcactcacctctttaaaatctgtgctcaaatactgctttctgttcatatggaccctaaacacccatctgtacttccaattcctttttttttttttggagacagagtcttgctctgtcacccacgctggagtgcagtggtgcaatctcagctcactgtaacctccgcctcccaggttcaagcaattctcctgccttggcctcccgagtagctgggattacaggcgtgagccaccatgcccggctgtgtgtctttagtttcttttgtcaatagtgtttatacgtgtttagtatataaagcagtgacttccttcatt

SEQ ID NO: 167874 - DNA, 435 bp, Homo sapiens
agtcagcccagcaacagaagaaagtgaaagtgactatagctcaattttcttgatcaaaaacacaagcgtacaccaagaattatatacaaggcaggctggcacttaattgaactacacctacaaacaaataggataacagaattaacaaattgtttgagcaaaataattgtaatgaacaatgtaatacttctgacccttcatggtactctaggctttatttggcagaagaattcatcaccagatggaagcagcaagtcctctgagtcctcctgtgaccctaccttctttagatccacctatgggtagagctggggtcacagtaacagcagtgtctcatgtgtgaggtcctcagcacttctcggagtcccagggcatgtctactgtatgctgatgaacaagctccctcctgcggggcacagtacatgcttcgcccag

SEQ ID NO: 167875 - DNA, 128 bp, Homo sapiens
taaagttgcaggtgttgtgccttagatccaccacagtcagctgaaactggcagctcaagacaagtagacaagccagcaggacccagatcatccaactcatcctgagatgagatcaacctgctgctaaa

SEQ ID NO: 167876 - DNA, 141 bp, Homo sapiens
tcaattctaacccttatgcatcatcataataaaagtttgcctacttcttccccggtgggaagtcccagtgtgttccccaaggcaagggctgtatttactcctcatcttggtgtctctaggctttagagtacttaggacaga

SEQ ID NO: 167877 - DNA, 129 bp, Homo sapiens
tcaggtgggctgtctggttgggggagggcactacgtggagtgtttgccatccttctgccttaaatgtctcatttgaaatgttagaaccaaccaggtgcggtagctcacatctgtaatctcagcactttg

SEQ ID NO: 167878 - DNA, 228 bp, Homo sapiens
tatgtctttatcagcagtgtgaaaatggactaatgtagcagttgtattaattttgaggggattttgtcaagaaatgagataggagaataaggggattgggaaattggcaagcgtgatagaaatattgttctctggaatcttaactggcttaaaaaaaacccacaaataaaagacaagaggaggctgctagctaacaagaaaggagatggttcccaagccagaaagtgt

SEQ ID NO: 167879 - DNA, 228 bp, Homo sapiens
tgctgggattacaggcatgagccaccgcgcctggctgccactactcagttttaaggtcttataagagggaacgttctggggatgcggctctaagcaagtcctcctgtgctcactgctcacctgcccctttagtgtccctcttatcctgcctcggcatggtccctgatggtgagctaacatgggagggcctgctcagagcccagcctgggctgcaggagcatagcaatg

SEQ ID NO: 167880 - DNA, 230 bp, Homo sapiens
acttcatctgctgctgtcatcttgcagatatcttcccttggccttttagcctcatctctcttctctttagtcactttggaggctttctccagctccttcccactgtgccccacctctttatttagttcctagaactggacacagtggttggcaggacttgaccaacacagggcacaagacagcagttaccttatattctttcttgtggctaatttctccattgccatttc

SEQ ID NO: 167881 - DNA, 570 bp, Homo sapiens
ctttttccctcagggtgtttccataatagttattgtaaaagagtttttagagtaattttatactaatcctagttttgttattgagttagagatatatatttaaatcagttcattctcatttgaggataccaaattccatgataacttttcttaaataaaagtgtattcggtaaaagcaaaaaacagagtctgaaagattagattcccgactaaggtaaccaccttgatttaatgcttaatagcatctgaagtggcctcagtcatgactacctggtaacagtattcacatttctcaaaatgacaactgggcctatctctaaatgagattgtgtaaatcctccaagaaatgggaagccccgtgttagtgtttgccttctccttttgccccaggatgatttggaaagaggaaccctaacctcctctcccgtcaaggcccagcccagaaatgagcatcaggctctcacctttcctccatccttccagttggtccctgtggtcacctctgactgtaaacacactgcaaaacaccggcaaaaatcaaaaagctgggccggtgatccacctagataa

SEQ ID NO: 167882 - DNA, 354 bp, Homo sapiens
tatgggagatagatacatacgcacatagattcatggataaaaaatatgggatagtatttttacttggtgaactttcaaaaccagagtaaaacaaaattaaactttgacttttaagaaaatgcaaagattatgaaaaaataaatttcacatatgataaaacggacatgaaaggcttattgaaagaaaactagtgaatattttaaagctggcatcgttgtaattagagctcaccccttgaggactctaaaataaagcttcactcaatgacccttggtaaattatgcacatccctttaaatgtaccatctggactacttcgtaagggagtatccacaatgactgcaatttcagaaaa

SEQ ID NO: 167883 - DNA, 405 bp, Homo sapiens
tgacagaatgtaattggcatgttattgaaggataatgtgctttaaaaagaattccctagtggatctccaaaatacaaaagttaggactgtagtggttacataaaataggagtatctatgttatcaggattgataaaattatttttcttgtgaaatttttgttaatggtcaaaataatgaacataccaaagcctttatgcctggtatattttaccagccattttctcatatagtcttttaaatttgattttcatagctactgtgagaatcatcatttcaagtacactgaatagttaaatgaattgggtggagttcaatagttggacttttaaaaataaataaaatactacaaaatgactccagtcatatgaatttttaaattttctttcccaaggtcacagacagt

SEQ ID NO: 167884 - DNA, 622 bp, Homo sapiens
agcaccttgactggctaatttttgtatttttagtagagatggggttttgccatattggccaggttggtctcagaactcctggccttgtgatccgcccaccttggcctcccgagtagctgggattacaggtgcctgccaccacacccgtctgttgccttttatttttaacatctatttcatcttattatcagcaattaaaatagtgccttaaaaatgaaaaattgtccttgcagacaataacaaagtagtgacctttagcaagtactactagatggtgatagtaaactaggaaggttaatgtagaaatggaactcaaatgtttaaattacagatttttttcaaaattagaattcaagccaggcggtggctctggctcacgcttgcaatcccaaagtgctaggattacaggcgtgagccaccgagcccagccaaaatcagcatattgaaagccaaactaatcatcgtccctcctctgtgttcacattctgtctcctctttatgatactgcctccacccggtcccccaaacaagcttcacacctgggaattatcatgactcttccctcagttttggccttttccaccagtcaccacattctgcgaatgtaactcttagggatgtt

SEQ ID NO: 167885 - DNA, 310 bp, Homo sapiens
cagttttctcacatggatcactgccagccacctaagtaattgttacaataggtattcagtagtggtagttggagtaatagtaatagctaaaacttacagaaaccttaccatgtactgctagctgttagagttggtttataaaaataatcttgtttaataattacagcaaattaggatagtatggtgtgaattatatacaaaccccacatttactctatagagtcaaacacataccgaggagacacgtgtctctctttccagccccccaaatggtggtattaaatttctctatcatctaccagagctctac

SEQ ID NO: 167886 - DNA, 249 bp, Homo sapiens
gtgtttatagcatccattaagctacaagtggcattaatgaaacccaaatatatgtcattttaggcaaagtacatgcaaactgacttttattctttttgatgcttttttacacatctagattgtcagtaatcctttggaatcacctgatggtgttggaaacaacccagtggaagtcatgtgtttttactttgggggtcagtaagggtctgagcacaagatgatagtcttttagtcttatggtggtatagg

SEQ ID NO: 167887 - DNA, 269 bp, Homo sapiens
ggtggcaggcgcctgtaatcccagctactcaggaggctgaggcaggagaatggtgtgaacccaggaggcggagcttgcagtgagccgagattgcaccactgcactccagcctgggcgacagagcaagactccgtctcaaaaaaaaaaaaaaaacccaacaaaaaaacactacttgtcgggtactatgttcacaacttggggggcaggaagcccaaacctcagcatcatgcagtgtacctgtgtaacaaacctgcatacccctgaatcta

SEQ ID NO: 167888 - DNA, 441 bp, Homo sapiens
tagtcacactggtctatcaatccttcattatttcagtaccctttcttggcactgatactttataatagctgttctattcttccttctctcctctttccctatttaactctttttaaactcttattcatcctttggctattagcctatcatttttgaaatgaatttttgtctgacctacatagctggattaaattttctacttttaacactataaactccttactttggaaaactttacaccaatgccatgtcttttcataattcccattgtgaaccatgcatctatcaataaggaaaactatagtcaatggtcaattaccagtcctcaccttattcaaattctttgtactatttgacactatcttcttgaaataataaccttgtaattcaagacatcacattctcctgaattcctgtctcaagagtttcttctcagactca

SEQ ID NO: 167889 - DNA, 585 bp, Homo sapiens
ggtgtgagtgtggagtgtgtacgttacctgtgtctgtgtcttttcctgtgtcatatgtgggtctgtttgtgtgtctgtgtgtggtttgtgtgtctctgtctgtgtgtgtgtagctaccaggtctgtggtctgtgtctgtagctggtggtcaccatgatatgagacagccccaggagggtggggacggggcgctcgctgctttctgcatctcctccaggtgtccttggctccaggttactccctgcccaggaagctcacgccttcttccttctgtttccaggtggaggccgtcattcatccccaattcctggaagaattgctttccccagatccacagatggatttcttggccctaagccaggacctggagcaggaggaaggactcacccttgcccaggtaccccaggggcaggagggacctggcacacaaggcccacctgattgtctaatcccccccgctggggatgctcggcttcttggggagccactctggagtgggaagatgcaggttcagagggagtaggatggacaggagccagggaggggagtcagcatgcaagctgtggtgaggcccaacgggaggcc

SEQ ID NO: 167890 - DNA, 407 bp, Homo sapiens
tgctttatttagcagtactgtcatattttgtttttcagcatgggaacaaaataagaaatcagatctcaacttctttaagaatccttagaaatgccccagggaaaataccttgaattaaactgaaaagtatgggcacagaggttagaatcctatcactagaaaaattacagtaacaatttaaaaactaatgcaggccgggcccagtggctaacccctgcaatcccagcactttgggaagctgaggcaggcaaatcacctgaggtcaggaattggagaccagcatggtcaacatggtgaaacccctgtctctactaaaaatgcaaaaaaattggccgggtgcggtggtgggcgcctgtagtcccagctactctggaggctgagtcaggagaatgatgtgaacccaggag

SEQ ID NO: 167891 - DNA, 953 bp, Homo sapiens
gaggcgcgcagaggcgccgagagcgctccccggcgggtcccccgcgcactcgccgcgcccgggcagcggcccgaccgggcgagcatgggcggcgcggagtgacgccgctgtgcccgcttggcatcaaggacattcagcccgcgggggtggggacgaaggggggcagcccggcgtcgccaccgcagcccccgagagccgccgccgctgctcgggctccggggctgggtggaggaaaggggtgttcggaatcgatccccattttccgacctttttgttggacattacgcccaccttggacgccgcaagagaagctgtcaagccccgcaggctctgattcggcgccctccgcgttcctcggctgctcccggcttccctgtgcctcggtggagtatttgcgttcggggctggggctggaggaggcagccacacgcgcgcacacgcacacgttcagaggagggcgagaggcagcggcataggctccatctgcagtgtcaatgcggcgctcccgctgaaggagggaaacgcggcgcgtccagtaggggagactgcattgctgagtcctggccctctgaggggacgactgtgcctgagtgctgctgtgccactgggacccgcctctgccatgaaagccatgccctggaactggacctgccttctctcccacctcctcatggtgggcatgggctcctccactttgctcacccggcagccagccccgctgtcccagaagcagcggtcatttgtcacattccgaggagagcccgccgagggtttcaatcacctggtggtggatgagaggacaggacacatttacttgggggccgtcaatcggatttacaagctctccagcgacctgaaggtcttggtgacgcatgagacagggccggacgaggacaaccccaagtgttacccaccccgcatcgtccagacctgcaatgagcccctgaccacca

SEQ ID NO: 167892 - DNA, 462 bp, Homo sapiens
tgagtagctggggttacaggcatgtgccaccacggccggctaattttgtatttttagtagagatggggtttcaccatgttggccaggctggtctggaactcctgacctcaggtgatctgcctgcctcggcctcccaaagtgctgggattacaggcgtgagccaccacgcccggctgtcttttgttcttaatccacgtatgactttcttcctttcaggtggaatatgccgtcttaagaaatattacagaattaagaagaatttacagcttttacagcagcctgggatgcggccactctctggataatacctttctgatgacaaagcttcacttctggagatttctaaaagattgcaaatttcatcaccacaaactaactcttgctgatatggacaggatattaagtggtgagtgttccagatccttcacatcttttggtttaaagcagaggaccaggccgggc

SEQ ID NO: 167893 - DNA, 516 bp, Homo sapiens
ctggcgctggggaggaccttccaccgagaaagggggcaagcctaggagtactctgggtacccctaacaggaacagagaggagaagacagctggagtcccctggagggctgggccaagcggttgtcagaggcatagatttgctgaggaggcaacaatcaccacactgttcttctgactgagggttgccaacaccccccataagcgacgggtatttacttctcccggctgtactgcatatgctggcaaaagaagccttcggagctcagccaggagaggaggaggacaacactcactccatcagcccacaggaacacttcgtcctgtccccgctacctgggtcagcaaaaccagccccgtgccctctgcacagaagcagaatggtgcagacatctctgtcctcctcagcacgcgctgtgaccccacgcccagggctgcaccttctctcagggactgtggagcccagagcatctgtaacaccgcgatgatgatcctagaaaccatacagggctgctgtga

SEQ ID NO: 167894 - DNA, 430 bp, Homo sapiens
agtcaccttgccaggcccagggcaataactatgcaatgtttatataatttggagcaaaaaatatttgaaatatgtgtgcattgctttttaaccttttctactgatttactttattaaatactgaatagaaacaatatatttataaaatatttattttatatatataataagcacataatgaacacctgtgtctccagtcttggtttaagaaattaagccaaaagtaatcataagtgcttatgattacttttgaagtcacctgtacaacttttgctgactacatccccttcttcaacactctaacgatggccactgtgagcactgtgtatattgaattgtgttgtattttaataccgtgtgcactactttgttttcctagctgtatgctattgcatttagtgagcataatgaattatatcagtataattca

SEQ ID NO: 167895 - DNA, 315 bp, Homo sapiens
attttttatctaggcatgattcctgtttgtcctcattctcttggtcccttcagtcttttaggtcagttcactacttgccttttccttttctaaaataagtagtatagcagaggtcaatgctccaaaacattcaaactgttaccaattactttactttggagtgagtaaaacatctataccacaatgactagataaagaatgggcttaatctttccttgccatcccttacctcagtcaacacaagttgttgaaaaatgactgatgaaaaagcaaggctgagaatgaagctaggtccttcatagaaccaagatgtag

SEQ ID NO: 167896 - DNA, 382 bp, Homo sapiens
ttatgagggtagggattatttttatctctacctcttatatgaagggaaatgaaaaatggaggttaacttgctcaggttcagtgggctgggattcaaacccaggcagtgtagtgtgattgagcccagccactatgatgtattatctagaggagcttaaagtctaaatgaagacacatattatatatatttttgtgaatacctgttcaattactgtaataagttctctaaagaaagagtacaaagggctttgagaaaattttaagagaaggagatgatatagatgaatgtggaactgaaagaagccagtgtacctagatcataatgaatgaaaatggagagcagtaggggattttggtagataggctggagagggtcttttaaa

SEQ ID NO: 167897 - DNA, 505 bp, Homo sapiens
tcagagtatcctatcgccacacaatataaattacactcatttgtggttcctctattctgtatctgtccttccctcaagagtataagcaccatatggacagagaccttgtctgtgcccagcactgaacatggcacaaaatacaaactctactaaatatttgtttaaaagaaaggagaactaaaaattgttaaatcttatgtaaaacaaacatgcagtctgacaaatatgagacaaattcctttttatcaaggaagaacagaataaattgcaaacttgactgttctcctaagaagaaagatgacaaattaaaaagcaaaattacaaaatgaggctttcaatgctaccattcactgaagtatcaggatctctgttgctgactgtatatatgattcatcatttaccaaaacgatatgaaggaggtaattagaaaaatagaaaacagagctcggaggctgggcgcagtggctcacgcctgtaatcccagcactttgggaggccgaggtag

SEQ ID NO: 167898 - DNA, 539 bp, Homo sapiens
gagagcagggctccccaacaaatagctgatctttctcccttgcctggcctagatcggcctctgtttagagaggtggtttggtggttgaagaatgagaacagggtgggagggggacaaacaggcctcttctgtgtcattgacagctgatttttgtttgtcagcgtgctaaggttgtgaagttgccaatccgtgatgattaagattctgttggggtcctttggagaggagagaggtggtggcttctgagaacataaccagaaggcttttagggaaatggaaaagtcatagtacggagcttcagcctagtcattcactgagctcagaagtgctcctcctcacccctcctctcccttccttttcctttctttactagctgggattgttctttcatttattcataaaaataaggtacaaaaacaaataatgccttgccgttgttattaagagagacatttaaaatggatcattgaaatactatgtgggaaggcttattcatagttaattattaatgacacttatcaaagcttgtcctggaccaa

SEQ ID NO: 167899 - DNA, 749 bp, Homo sapiens
gggagcgcccggatagctcagtcggtagagcatcagacttttaatctgagggtccagggttcaagtccctgttcgggcgtttgtagttttcgttactttaacctgctaaattatcccatcaagtcccaagagcggacatcgtaaacccttacatttcaagttgaattcaaatcatttttcactgggttcagaatatgctagatagacgtgttttcagggaggaaaaaaaatgactgaacaaaaaaaaaaaaaaaagaaaaaaacaaacagtgtggggcgcgagcaccgggcccttagaaaaaggtacaagaaacccaagcggagggcggccggggcccaagaagggacaaggcgacaaggggccacaaaggaggtacccacagaaacaaccaggggcacaagaacaaaggcacagggagactccacacaacaagtaaaaaaaacccccgggagaaacaacagacacgttcacggcacacaatcccaacagggaaaacaccccagcgcggccaccacatactgcggggacactacaagaaccccaaggggggcagtcaccaaagagcaacacgccccgccaaaccccacaaaaaataacgacacaaccgaacacgtggggagacacacatcgagaccacgcaggcgtagggcgacgcacagccgagacgcaaccacaacgagccaacaggacgcagagaaccaacaagacagcaacaacgacaagcccgacgtgaaccgaggacggacac

SEQ ID NO: 167900 - DNA, 295 bp, Homo sapiens
gccagctatttcctgcaggctctttggctccttctcaccagcaaacctcggcctgggacattctgtacccagacaaccctcctctcaaccagcagcagatcacacctcacctacatgcctcaaagctcacttcttccaggaagtcttctctggctgtccaactcttccgactactgactctctccttagcaaccattacctttattaatgttaaattaacacaccatcatttatgtgacactgttctagtgtaaaatctctttttcagtctgtatcccattaatcttcaagacaa

SEQ ID NO: 167901 - DNA, 205 bp, Homo sapiens
ttcccttcctaagatatatacagtgaagtctgttaagttagaaagtgaatggagagagaaagagagagagagagaatgtgaatatgacttcgtctgggaatgagttacatgcaagttactagtagtaacttcgggacctccatttccgaggaaaatgaagtgaagcataagaacgaaaccaattaggtgacatttgaacttcctg

SEQ ID NO: 167902 - DNA, 383 bp, Homo sapiens
gtttgaccaactttccttaccactggccacttggcccttgtcttgtttgaccagggttgtcaaacaaggtttgttgtttccttctttgaaggaaagagtcagtgtttcttccattccaatgcatccacttgaggaatttttaataaaatgggcaatgaatgggcagcagaagaagttacaggcctgctgatcaaatgctaagtaataaaccctggaaattctaaactcgtttgcatgaagaccttgcttattttgtaactattatgtattatcaaacgtatacttaattctttgaatgtgttagtatgtgttcaaagtacaccttaattttatatatacatatatttaaattacataaaataaataagccactaaaaattttt

SEQ ID NO: 167903 - DNA, 372 bp, Homo sapiens
ccgggaggcagaggttgcagtgagccgagatcgcaccattgtactccagcctggcaacagagcaagactccatctcaaaaaacaaaacaaaataaaacaaataaaaataaaaaaagaagaggaagagatctttctctctctctctttctgttatgtgaggtcacagtgagatggtggcatgtataagccaagaagactcctcaccagaacccagccatgctggcactctgaactcaggcttccagcctccaacactccgagaaataaatttctgctgtttaagccatccagtctgtgcaattggttatggcagctgaagcagagtaatatatatcatcttttaaattcttgctctgttatcacccccctttg

SEQ ID NO: 167904 - DNA, 352 bp, Homo sapiens
attcagctacgtaatgaaatatcagcatccttcaaagatttggggaggctgggcatgggggctcatgcctgtaatcctagtattttgggaggctaaggcaggcggatcacctgaactcatgagttcgagaccagcctgggcaacatagtaaaaccctatctctactaaaaatacaaaaagttagccagacatggtggcacgtgcctgtagtcccagctacttgggaaggccgaggcacaagaatcacttgaacccgggaggcggagaggttgcagtgagccagatcacgctactgtactccagcctgggcaacagagcaaactctgtctcaaaaaaaaaaaaaaaaaaaaaa

SEQ ID NO: 167905 - DNA, 277 bp, Homo sapiens
gctaagaggggaaagttcatagctctaaacacatacatcaaaaagactgaaagagcacaaactgacattccaaggtcacacctcaagggactagagacacaagaacaaactaaacccaaacccagcagaacaaaggaaataaccaagattagagcagaattaagtgaaattgaaacaaacaagcaagcaaacaaacaaaaaacccaaaagataaataaaacaaaaagctggttccttgaagggataaataaaattgatagaccattaacaagattaa

SEQ ID NO: 167906 - DNA, 291 bp, Homo sapiens
tggtccacaaaatctaaaatatatactgtttggctctttactgaagaaaaatttgccagcctctagttcagacattttagtgactgctattccatttattctctagttggtcagatgatgtttattattgatcatatgaagaattccaatttggagagtgttggtgttttccttttcttttacacttttctcagatttttgttataaaatgcttttgcattatatactgtagagatgataattatgataggttttattatggcatgttattaagattgttatatttgagta

SEQ ID NO: 167907 - DNA, 366 bp, Homo sapiens
aaaatattagctgagtgtggtggtgaatacctgtagtaccagctacttgggaggctgagatgggagaagagcttgagcccaggaggtcgaggctgtagtgatcaatgaccatgtcagtgcacttcagcctgggtgactaagaccctgtctcaaaaaaaaaaaaagtcaccctctaaacagtggaaattagtcttgcatgtcttggagactttgaggctgtgggccctgagaaagcacaggtggctggacagtgccacctccgttgttctctgtgattgcagaagccatcgaggccctcccgcttgccaacacgccagaagtgtttggtctccaccccaacgctgagattggctattacacgcaggc

SEQ ID NO: 167908 - DNA, 306 bp, Homo sapiens
attggctgagaaagaaagtggaaagaagagagcaaccaaaactctaaatttatagtggcctggtcacttctagctgaaaccatcccttcctactttgtagtcagagttcagttccctaacatgactatttctcacctccctctcttccttctcaaggtggataagagtatgaaaaacctgagtatcttcatggcagtgagggaaggggtggctggtctgggtggtgtcctctgctaggccttgccatggggtacctcatctggtctcacccaccttttagcatgaatgacacacattgctactgac

SEQ ID NO: 167909 - DNA, 335 bp, Homo sapiens
aagtacttccttaatttctggcaccataatatgttcaaggcttatcccaactatacgtactatttctaagacacgattctccaatctcttttgtacagcaagaaatttagaaccatattataggatgagaactattagaaactactactccaatacaggatcccggaatctctatcttagaggtgttttggaaaaaagccatcagacatggcaaaattatctatggaaaagcttgtactgaataactcctgtgaagatcacaaaacaaaaaacctcatagtgttatcaacagaagttactgagaagtttttcaacataaagattaacttaaaagc

SEQ ID NO: 167910 - DNA, 437 bp, Homo sapiens
taacatattcccctcaatgaacaagactgaatcaagaaatctcacctgcgtcagactttctaagtcatagagatttatagtaataattttaaatgagtctttgactttcagacccagcgtatgaaggaggagagtgtgagtcagtgccgttcctgggcgtccgctgggaacttccctgactgtccttctggctctcaggagtggagctcacttgctcaattcattccagtgtcccagaggtcacagtctcccctctgtgagctgggctgtcctcggtccctgggcctatctctttgctgtcctccctgggatcttgcccctggggtagccctgcttcccttgcagctttcttctctgctgctggtgccttccccagggctgtgcatgggcttagctctttcttcatttctctccctctctcctcttttcttcctgct

SEQ ID NO: 167911 - DNA, 397 bp, Homo sapiens
tagatgcagaaaaagcatttgataaaattcaatatcccttcataataaatactggcaacaaattaggcatagaaggaacatatttccacataacaaaggccatatatgacaaacccacagctaacattatactgaatggggagaagctgaatgcctttcttccaagaactggaacaaaacaaatatgctctctttcaccactcttattcaacacagtgctagaagttctgtctaaagcaatcaggcaagagaaagaaataaaggttttccgaattagaaaagaggaagtctaattgccccctctttgaagattacatgatcttatatctagaaaaatgtagagactccaccaaaaactctcagaactgatcaacacagtaaagttgcaagatacaaa

SEQ ID NO: 167912 - DNA, 128 bp, Homo sapiens
aaagaaaagaaaccgttaacgctgagtctgatatttcaaaccacttttccccctaaggcattcattgatttgaaggcagatttatggagctagggcaaaaaatacgggcattcagagacagccacaga

SEQ ID NO: 167913 - DNA, 426 bp, Homo sapiens
gcatttagggtggggttgtttttattttaactacatgtataggttgcttatatttcatttcaggatactaaacagaatatcacaaataatttggattaaaagtaggggagagggcactggaatgacacccctgtagcaataagcacacctggcactcatgaaaagaaaccaggctttcttggagaattggctgagtccagggcagggcaggaaaagtataagaaaagcctggaatgtcttgttgtggcagaagtaaaagggtgctcagaaaatgaccctgtctctactaaaaatacaaaaaaattagctgggtgtggtggcggacgcctgtaggaggctgaggcaggagaatcacttgaacccgggaggcagaggttgcagtgagccaagatcacgccgctgcactccagcctgggcaacaagagt

SEQ ID NO: 167914 - DNA, 493 bp, Homo sapiens
agatcatctgttttctattatacaaaacaagaattaatgaactcctgacataacatttatttcaatttgttttcatcttttaaaaagcactcattcccaatcttggttttccaatagtatagggaactaatgatacttaaagattacttcctacatcacctttttaaaaaataagaagtttttaggctgtgtacagtggctaatgcctgtaattctaacatgagagagatcaaagcaagcagattgttgagcctaggagtttgagaccagcctaggcaacatggcaaaaccctggctctacaaaaaatacaaaacttcagccgggcgcggtggctcatgcctgtaatcccagcgctttgggaggcagaggtgggcggatcaccagaggtcgggagtttgaggccagcctgggcaataaagcaagactcagtctaaaacaaaaaaagaaaatatgaattttgtgacaaagtaaatgtaacccaacatttaattt

SEQ ID NO: 167915 - DNA, 137 bp, Homo sapiens
tcccaatctcccatattctgtacttgaaccataccacattgcttatatggcaaactatattttccaaatgcctgctcttctagacccttgccaatattccatgaagagatggcacctgtggcatctcaccttgtcct

SEQ ID NO: 167916 - DNA, 398 bp, Homo sapiens
ttgctttgagtttgatggtattcctttccatgtggctaggaaaagtgagaccatgccttgtcatcttacaccaaagcccttgaataagaacagctcagattaagctagtctgatatattcttaagacctgaccatttggatcttgacctccatctgcagcacataataagtcttttcccagtttctaccttgaacagcctttattttagtttcataatttctgtacccaggacttcaccatttccctgtatttccattgttgcatattgaggttatgcagtctgaagctcctctgaactgtttttcagaatgcctttccttctgcttcggaccatcagagcttcctagtttcctctattcccttctctcaccttcacatttcttttgttcccctttcc

SEQ ID NO: 167917 - DNA, 331 bp, Homo sapiens
actgtggggctccctcccattaggctttgcacagtggcgaccagtggtcttactcccagaagccggggggccgagaatcagcccttgccctgcccagctatggatacagaggttttacaaatttgaatctctgtgctctaaattagagagtttaatctgaccttatgttaaggagcttgcctcgccagtagtcagctggtttttcaaataattcgatacctcattacccatgtaccaggggttaaacattacccttattaaattggctagtctactcacctggtcttcttgccttggtgcatggtggcactctagtttctcttggaacctg

SEQ ID NO: 167918 - DNA, 585 bp, Homo sapiens
gcacttggtacagtgctgggcacttacttgtcaggatttggtagatgctgaactgatttgaactctagcatcatcttgcttaaaattgtcattctttgcctacccttgccctgcccagctatggatacagaggttttacaaatttgaatctctgtgctctaaattagagagtttaatctgaccttatgttaaggagcttgcctcgccagtagtcagctggtttttcaaataattcgatacctcattacccatgtaccaggggttaaacattacccttattaaattggctagtctactcacctggtcttcttgccttggtgcatggtggcactctagtttctcttggaacctgagccaactctgaaccctcagccattttttgtcagtgcctcttttgagcttactggatcccaattccttttttgctttgagtttgatggtattcctttccatgtggctaggaaaagtgagaccatgccttgtcatcttacaccaaagcccttgaataagaacagctcagattaagctagtctgatatattcttaagacctgaccatttggatcttgacctccatctgcagcaca

SEQ ID NO: 167919 - DNA, 422 bp, Homo sapiens
aagttgtgcactactgtggttgactgtaatgcagtcctcagattggttcacttagggaaatactttcccaaccatgttctaggacagacttttgtaaagtgaattaaatgttcttttgactgccatttaaattcctatgtgtgtacataaaaatatacatatatatacacgccattttttaaagagatattgcctagactgggcctgaactcctgggttcaagcaatcttctggcctcagcctcccaagtagctgggactacaggcacatgccattgtgcctggtctatgcactttttattttggagtaattgaagactgaagactctcaagcagttgcaaaattagtacagaagaaaaaaaatagtgcagaggattttcacccagtttcccccaatggtaatgttgattgaacttcaccat

SEQ ID NO: 167920 - DNA, 587 bp, Homo sapiens
agaggtcagaggggaggataaagcatttgttcatattatagtacagaaataatatgaattgcaaatttttttaaacacttgcaaggcacaagagaaataaatcagtgcaaaacaggtcaaaacatacactacctgaaagcattttcagcagaaacaatgttttctacaagggcaaatagtgcacagaaaataaaactaaactaagagacactactattagaagcatcttatatggctggattttttttttttaaggaaaatctaaaacagtctatctaatcacttttttaacaagtccgtaaaaacgtaacagttaaattgacaggtagcaaaagtccaaaataatgaatttctattctgcattatggttggttactgtagagagcttgtaatgaaatctctcatatatgcctgctcacaatcttctgaataccttctgcacattttaatagttgcctctgttgtaagctccccattctaatcagtaaaattaaagggtttctgtttgggtcccctacacttttgtaagctgtctgtgctgtctgtgccccttaataaaacattttctgcttaagagtacctggtgt

SEQ ID NO: 167921 - DNA, 105 bp, Homo sapiens
gagaaaatccttgttcaagtactggttttgacttcacttaatcttgggcaagtcatccagtcttcctggatgtgctgaggtggttgcattattgcctttgtaatt

SEQ ID NO: 167922 - DNA, 412 bp, Homo sapiens
acaagcctgggcaacacaggaaaataaaaaaaattaaaaaattagccaggcattgtggcacatgcctgtagtcccagctacttgggagactgaggcaggaggatcacttgaccccaggagggcaacactgcagtgagctatgatggtcccactgcattccaacctgagatacagagtaagaccttgtcttaaaaaaaaaaaaaaaaaaaaaaaagcaattaaaatacacgagagtatggcattttgggggacttgaaagaaaaaggagtgtgtgtatatctgtgtgtgtgtgtcagcatttcatgaaaaaccacgtgatgaagtagcttagttgcattttggagtcttgcaatgcaaaaaaaaaacactatctttaaatagaattatgcttatattggctaatgctcaaact

SEQ ID NO: 167923 - DNA, 724 bp, Homo sapiens
gggcttgggggctgatcaaggaaatagatgcccacccagtgggagtagcacgcagtgagctttatttaggtgctgctttgaatggcaggcttgcatacaagggaagtccctcatagcataagccctttggaggctgaggttccaggagtcaccatcaagagggagaggccggcaagggaactccccgggcagagggggatcagagagggggcttacatgtctaggtgatgttgttcaacagcatgggcactcaatctctgggtcagagactccctgcagggtggtagcagcttagggtcttgaaatccacaaagttcatcttatccatggctcagagatggtgcagtttcacgagtctgcaaagcagacaggctctcagtggctaaaattttgcttacttggtctgtgtgtaaaacaaacggatgtgtaaaactttgagtttggtgctagcggtcttttaaaagagctagaccaggtgcggaggcactttgggaggccaaggtaggaggatcgcttgaggccaggagttcgagaccagcctgggcaacatggcaaaactccatcaatactaaaaatagaataattaactgggcgtaatggcacatgcctgtaattccagctacttgggaggctgaagttggaggatcacctgaacccaggaggcagaggttgcagtgagccgagatcaccccactgcactccagcctgggtgacacagtgagac

SEQ ID NO: 167924 - DNA, 456 bp, Homo sapiens
gtaaccatcctatagatcagtggaattataaagaaggaaaaataaattcacccatagtatatacaggaatcaatattatccacagtttggtactattaagcatccactaggggtcctggaacatatacactgtggataagcagggactactctacagtccctgataaacagacaagtatttactgaataagcaaaaaaaggaatgcacgttgttttcttatataaagagcagcacttctactagagataatgaacaatgatcttgttttcaaaataaaaaatgttttgacctgattctttacctattcctagttaggcaacagtggcttcaactgagttcccagacagttcctcttccttactttcccttactcataggagcccctgaatttagactgtttacagttctgtagtacatctacaactgtactgatctataggagtggttactagctt

SEQ ID NO: 167925 - DNA, 543 bp, Homo sapiens
gattacatgtgtatgtgtgctaacctataaatatgacccaaattttagttatggcttatttcatattctctcagctaattttcgatggtaattttatcttgtctgagtagtcatggagatagccttattttcaccatgtgtttaatgattaatatatatttctttttgtgagagaaacacttttgtgatttgaagttaatttccaaaaagatttataattctggattttttaaagtttttctctataaacattgttttaaaaacacataacataatatttaccatcttaaatttattgatgtgtatacttcagggccaggcatggttgtggctctcatctgtaatcccaagattttgggaggccaagacaggaggatccctggagcccaaaagtttgagaccagcctgggaaacatagggagacccctctctataaaaagaaaaaattaatgatagccgtgtatggtggtgtgaagctgtggtcccagctacatgggagattgaattgtgccactacactccagctcgggtgaccctgtctca

SEQ ID NO: 167926 - DNA, 112 bp, Homo sapiens
atgatgcatgccatgagccaaccttatttctaactcttcacagctccctgcttcaatcactttcttatcatctcactgaagcttagattcccctaatgagtaactttactca

SEQ ID NO: 167927 - DNA, 570 bp, Homo sapiens
gtaaacccatcatttcttaccttaaccccagcaccagtttctatctgagctattcctggaagcagatatgagatgataatctcattcaagcgaatatactttaagcatgatacgtacacctttgtggcattgtgccacaaaaatacggattaaaataattaccacctcccttctcacttcccaaaaccagcaaactgcccatttaacatcttttgagaaattctgagattgatttatttcctgtcttaattttagtcatgggagctcagtattttccaacatatctccttgcagaacctgctcactcttcattatcaaagtcatagatattccacgtaggcaagacttttcccctccataatatcctcattgaccaacatttggactttgaaaatgataacctatgtaaatacttagccattaaaatcatctgaactttttacaaagctaaaagttattatctttaagatccctccctaccctgagagagtacaccagaaagacagctggagattaaagcatgcagggatttaaagcagtggaggcctttgcttagtcacacaagaatta

SEQ ID NO: 167928 - DNA, 413 bp, Homo sapiens
agtattccattgaaaccaattatacctaaaaagtatattaagaagcattataaataatttgaaaaatgtaaatatttggtgatttaaaataagcctaccactaaaaagcatatttttagtttctaatgactactttccaagtttaactttttttttttttttttttttgagacggagtctcgctctgtcgccaggctggagtgcagtgtcacgatctcggctcactgcaacctccgcctcccgagttcaagcaattttcctgcctcagcctcccaagtagctgggattacaggcgcccgccactacgaagttttaactttttaagcttaccatttatgtcctcatatacctaatatgacaaggaaagacacataaagggaagtgtacaaaatatgcaatgattaatggtggtc

SEQ ID NO: 167929 - DNA, 654 bp, Homo sapiens
ggcctttgaggaatctgaccagcccaaggagaagtaccggaagatattgttctcaggaagtccttaagaattccgctggtcagagcaatggttctggttgagtggttttctgatctttagtattatcatcacctgggaccttgttaaacatgaacgttcttgccccctgctccagactgactgaatctgaaacactgagggtggcagcctgagatttagtttggcaagacccccaagtacacactgtagtttgagaaccactgctcatcagcaaagcttactatgaatgcaaagtttccttgaagtgtatgtcttacatatattgattgatgtcttatgtctccttaagttgtataaaaccaagttgtggggccaggtgctgtggctcatgcctgtaatcccagtactttgggaggccgagactggtggatcacctgaagtttggagtttgagactagcctggccaacgtggcaaaactctgcctctactaaaaatacaaaaattagccaggtgtagtggcaggcacctgtaatcccagctactcgggaggctgaggcagcagaatagcttgaacctgggaggtggaggctacagtgagctgagatcacaccattgctctccaacccaggtgacagagcaagactccatctcaa

SEQ ID NO: 167930 - DNA, 507 bp, Homo sapiens
atgaaaaagccttgagtgctggcaaaggaaacacataagtgttggttatggttagtgtcagaaggtgtccggtttagccgggaaagtgccagaagatgggtgaaggttggggttgtgagctgcgggcttgcaaggtaggagaggtgggttggtacagtcaggtaaagcaatggtatttggtgaaaggaggttctgctgcaaatccgggaggggatccgtgctctatggtaattaaatccaagtcaggagcaccagtcaagccagtcatgggcacacgatgcttgtctttcttgttctggaaatggtggaaaggcctccacgtgactcagggtagagacttacgtactcaagtgtgagatacagttactatagctgtttaaattgccccaaatccctttttagaacaaggcagagcataaataatagctggtttgtcttgctttttattattatattcatgggtttggttttgattcatggtggttgaactctgagtatgtttacata

SEQ ID NO: 167931 - DNA, 482 bp, Homo sapiens
attagtttcagctagtatgcaaactgtattctttgtgtgtggataaggcattagaggctgactgaggaaaacagctccaaacaggcaggaaacagacaaagcatctgtttgcattaacttcctcctacacatctcacctcacaggcatgaactcagaaggtggttcttctaggagctgagagtgtgtacgtggggggtgggggacactcttgtctgaattcagcttccgtcactgtgaatgaggaaattcttggtgacaacctcatgaaaggtactagaacagagtctcaggtcctgagagagctcagatggctgcggaaatttaactcagtatttcacctcaatacaacagaattctcatttgttctacttatgtgaaactaacatggatatgtaaagggcatctcaaccttaattatccacacagtctaagatgaattatttgactttatattccaacctatccctctttccttcctcta

SEQ ID NO: 167932 - DNA, 558 bp, Homo sapiens
ctgaataatccagaggctctatgaggaatcttcaggatatttttcaatagacagaagtaaaagagatgggaaaccagtattaatttataaacagttaggtgcccaacactgtgctaggtcttgccacatgtctcatctcatttaatcttctttaattaggatcaaggtccattttagcaatagtcaaagaacaggacttaggacacctagctcctgatacttaaaattacttaaagtgcattatggtgacacctcagataagtctaaacctctttctaccctgcctaatcaaatattcatttcaaaacactgtatgctgaaatgagccacgtgggagttgaagagaatcaactattcaggtggtgaaaatgtgtgaatgcagctggcagatgaagttccagtgtgatgaattcccagcttgtccttattgctttaggcaacaactgacaggcctgactggtcattggctttccattcctggcattgatatgactgaaaattcttaatgtcacagatccttaaaagctgtctctgttatcatagatgtaaatggtgctg

SEQ ID NO: 167933 - DNA, 1106 bp, Homo sapiens
ttcttaatagaaagccattcccactcagaccaaagttctaagacttctctaatgagtgagatgagaaacgcccagtctattggccgcagatgggagaaaccatctcctagtaatgtgactgaaaggaagaagcgtgggtcatcttgggaatcaaataatctttctgcagacactccctgtgcaacagttttagataaacaacacatttcaagtccagaattaaattgcaataatgagataaatggtcatactaatgaaacaaatactgaaatgcaaagaaataaacaggatcttcctggcttatcttctgagtctgccagagaacctaatgcagagtgcatgaatcaaattgaggataatgatgactttcaattgcagaaaactgtgtatgatgctgacatggatttaactgctagtgaagtcagcaaaattgtcacagtctcaacaggcattaaaaagaaaagtaataaaaaaacaaatgaacatggaatgaaaactttcagaaaagtgaaagattccagctctgaaaaaaagagagaaagatcaaagagacagtttaaaaatagttcagatgtcgatattggggaaaagattgaaaacaggacagaaagatctgatgtcctggatggcaaaaggggtgcagaagatcccggttttattttcaataatgaacagctggctcagatgaatgaacagctggctcaggtgaatgaactaaagaaaatgacccttcaaactggctttgaacaaggtgacagagaaaatgtactgtgtaataaaaaggagaaaagaataacaaatgagcaagaggaaacatactctttatcccaaagttcaggtaaatttcaccaggagagtaaatttgataagggtcagaattccctaacttgtaataaaagtaaagcttctagacagacatttgtgattcacaaattagaaaaagataacttactcccaaaccaaaaggataaagtaaccatttatgaaaacctagacgtcacaaatgaatttcacacagccaatctttccaccaaagataatggaaatttatgtgattatgggacccacaatatattggatttgaaaaagtatgtcactgatattca

SEQ ID NO: 167934 - DNA, 443 bp, Homo sapiens
aatagagtaagattgaccccaactgaccaagaaaatcaaatttctacagctcagtggagcaattcttttttccatataaagaaagcagctcaacattaaaatgggcaaatacttaaggaagaagaaggaggattgaaaaactccaatgctccttttaaaaagctccctagaagaatgtgtattgcaagctgctcacttgaaaactgacaaggttccgctgtttctcttttgtgtgggtggatagacaatagacaggcagagtcaggaaatttcaagtcggggctctggaattaatttattctcacatcaaagtcagtgtggttggggctcaaaatgaaacacttgaataaaaactgacagaaggcattgttccccctcctgcagtgacacagaggtttctaatccccatgagccttagaaattcctcccagcttctggcagcc

SEQ ID NO: 167935 - DNA, 205 bp, Homo sapiens
ttggctggatgaactacagaggctacaaaaaatattttgttatcctaccatgttctttgttccaacctcttaggtcttcctagaaacaaaggcatcagagtcaagaccataaaggagtgcatcttaagacaatgcatggtaccattttaccttcacaaaagtttgctctgtgctcaagaggcaatttatcatttagaaaaaaaca

SEQ ID NO: 167936 - DNA, 249 bp, Homo sapiens
tatttaaagagttcatcacatcagattcaaaccgacaacatctgcgctgcaagggctgctggaagagccaggcagaaccaaatggaaacctggatggaactgtggattctgcctcctgcaagactctgagaccagacctctatgaaggacagtaacaggttgctgctgccactgtgcccgtaatcaggtgtgtgccagcgcttcctgctgggcccaggccagggagaactcctgtgaatgaaaactgac

SEQ ID NO: 167937 - DNA, 231 bp, Homo sapiens
atttttataggtgatgagaaaacaagcttagaaagggaaaggaacttgcttgagttaatagcgttaagtgggacagttgaacctggaacagccttaccttcagagcctgagctcgtaactatcatgctttactgccacctgaagttgggatgatatacaagtaagtgcttagccattaataaatgttatttttattgttagataggttgggaccagatggaggtttgcaag

SEQ ID NO: 167938 - DNA, 1516 bp, Homo sapiens
tcattaatacaagtttttaaaaacagaaacattttagagtaattttaacacttttatcttgcccagaacataaaaaaatcttcattttcaatccttataactttgtgtgagggaaattaggcatcagggtgggaaacagaggtgacttttatttgtctaagtctaccaaattgctgaactagtaggtaaaactcccttcctcttaactgagctgactgatttttgctagatttttcttttcgtttcttcattttgtttcttccgtttcctgggatttcatgtgtgatttctttttctaaagcacaacctttggggtgtagttaagagacatttttccctgtgtccccaccaccccttccacacatgtgcaggtctcccctgagtgcccagacagcgcaggaccacgcagtccactccctctgcccctcagagattctgcctctctctcctgacctgtgccacattcttgtgtcaggaccccacctcccgctgcgttttcttcaacatatgagagtctagatgggcacagcatttagaggagctgccctattctggtgtcctggggagagagacgtgcttgtgaccccggctgtgcaggagccctgaacctttctgggagcaccagctgcgggggccatggtgggagctcacttgggtgattggctcattcaggtctcctccctccttgctgctgcctctggagggtctgctggccgggctggacatgagctctttgtagccagtgtggactggacccatttggccctaagtaactgaattgtgtaccagtcagcagtagggatgcataacaccagagcttcattgattcaaaggcaaagcaggtggcattttactgaacaattaaatgtttgaagtaaccttttatagagtgagaaagatgtctgtctagttttaagtctttctgaagagaaatgggctggaatgtttggttggttgcagctattcttgtgttctttttaaaatatctgaaattatacttagatatggggcaggctttattcctacccaagtagcagcgatcagcgatgctggtgctaacccctggtctttgtctgtttccctattgctgacctcaggcaccacactgtaactcgaggcatcaccaaaggcgtgaaggaggactttcgcctggccatggagcgccaggtctcccgctgtggagagaatctgatggtggttctgcacaggttctgcattaatgagaagatcttgctccttcagactctgacctgagtggagacctttccaccagacacagctcgggcctgtgtaattgtaggagaagacactcagcagtgattgccatggcacagagccgtggtcattgttgctgttacaaagaagaaaaccatctgagttctaactccttggttgcttaaaagtagttcccaagagtctgagaagctatttctatttttaagagtcattttttgtaatttttgtaaaacaaaagtaccaatctgttttgtaaataaaaatcatcctaaaatttgaa

SEQ ID NO: 167939 - DNA, 2785 bp, Homo sapiens
atggcgaagaggcctggcgcctgcccgctcccgcgcatgctccctgacttcaccaaggtcacgctgcagcccgcaggaatgaaaatccacttctccgcattttcgaggtgacctggaagcggttcaactgctctggcttctcagaagaggaggggaccgggcggtaacgaggagccaaggggaggagactgctcgcaaaacccggaaaagctttcccgatccactctgccagcctccgtgcgcctccagacatgcgcagtagcctcccccgcggtggcggcggcggcggcggtggctgccgtggcggctgagagtccagagccggacgttccggccgcttcgggctggcggctggagagcgctcgggtcatgtctgcccagggggactgcgagttcctggtgcagcgagcccgggagttggtgccgcaagacctgtgggcagccaaggcgtggctgatcacggcccgcagcctctacccggcagactttaacatccagtatgagatgtacaccatcgagcggaatgcagagcggaccgccaccgccgggaggctgctgtacgacatgtttgtgaatttcccagaccagccggtggtgtggagagaaatcagcattattacatcagcattaaggaacgattcacaggacaaacaaacccaatttttaagaagtttatttgaaactcttcctggtcgagtccagtgtgaaatgttactaaaggtcacggaacaatgcttcaacacgttagaacgatcagaaatgttgcttctacttttgaggcgcttccctgaaacggtggtgcagcatggggttggccttggggaggcactattagaggctgaaactattgaagaacaagaatctccagtgaactgctttagaaaattatttgtttgtgatgtccttcctctaataattaacaaccatgatgttcgattacctgccaatttattgtataagtacttgaacaaagcagctgaattttatatcaattatgtcactaggtctactcaaatagaaaatcagcatcaaggcgcccaggatacatctgatttaatgtcacctagcaaacgtagctctcagaagtacataatagaagggctgacggaaaaatcatcccagatcgtggacccttgggagaggttgtttaagattttgaatgttgttggaatgagatgtgaatggcagatggataaaggaagacgaagctatggagatattttgcatagaatgaaggatctctgcagatacatgaacaactttgatagtgaagcacatgcaaaatataaaaaccaagtggtgtattccaccatgctggtcttctttaagaatgcattccagtatgtcaacagcatacagccatctctcttccaaggtcctaatgccccgagccaagttccactggttcttcttgaagatgtatcgaatgtgtatggtgatgtagaaattgatcgtaataaacacatccataaaaagaggaaactagctgaaggaagagaaaaaaccatgagttcagacgatgaagactgttcggcgaaaggaagaaatcgtcacattgtagtcaataaagccgaacttgctaactccactgaagtgttagaaagctttaaattggccagggagagctgggagttgctctattccctagaattccttgacaaagaatttacaaggatttgcttggcctggaagacggatacttggctttggttaagaatcttcctcactgatatgatcatctatcagggtcaatataaaaaggcgatagccagcctgcatcacttagcagctctccagggatccatttctcagccacagatcacagggcaggggaccctggagcatcagagggcgctcatccagctggcgacgtgccactttgcgctaggggagtacagaatgacatgtgaaaaagtccttgatttgatgtgctacatggtactccccattcaagatggaggcaaatcccaggaggaaccctcgaaagtaaagcccaaatttagaaaaggttcggatctgaagctcctgccttgtaccagcaaggctatcatgccatactgcctccatttaatgttagcctgttttaagcttagagctttcacagacaacagagacgacatggcattggggcatgtgattgtgttgcttcagcaagagtggccacggggcgagaatcttttcctgaaagctgtcaataaaatttgccaacaaggaaatttccaatatgagaattttttcaattacgttacaaatattgatatgctggaggaatttgcctacttgagaactcaggaaggtgggaaaattcatctggaattactacccaatcaaggaatgctgatcaagcaccacactgtaactcgaggcatcaccaaaggcgtgaaggaggactttcgcctggccatggagcgccaggtctcccgctgtggagagaatctgatggtggttctgcacaggttctgcattaatgagaagatcttgctccttcagactctgacctgagtggagacctttccaccagacacagctcgggcctgtgtaattgtaggagaagacactcagcagtgattgccatggcacagagccgtggtcattgttgctgttacaaagaagaaaaccatctgagttctaactccttggttgcttaaaagtagttcccaagagtctgagaagctatttctatttttaagagtcattttttgtaatttttgtaaaacaaaagtaccaatctgttttgtaaataaaaatcatcctaaaatttgaagtttttaaaaaaaattcttat

SEQ ID NO: 167940 - DNA, 1541 bp, Homo sapiens
tcattaatacaagtttttaaaaacagaaacattttagagtaattttaacacttttatcttgcccagaacataaaaaaatcttcattttcaatccttataactttgtgtgagggaaattaggcatcagggtgggaaacagaggtgacttttatttgtctaagtctaccaaattgctgaactagtaggtaaaactcccttcctcttaactgagctgactgatttttgctagatttttcttttcgtttcttcattttgtttcttccgtttcctgggatttcatgtgtgatttctttttctaaagcacaacctttggggtgtagttaagagacatttttccctgtgtccccaccaccccttccacacatgtgcaggtctcccctgagtgcccagacagcgcaggaccacgcagtccactccctctgcccctcagagattctgcctctctctcctgacctgtgccacattcttgtgtcaggaccccacctcccgctgcgttttcttcaacatatgagagtctagatgggcacagcatttagaggagctgccctattctggtgtcctggggagagagacgtgcttgtgaccccggctgtgcaggagccctgaacctttctgggagcaccagctgcgggggccatggtgggagctcacttgggtgattggctcattcaggtctcctccctccttgctgctgcctctggagggtctgctggccgggctggacatgagctctttgtagccagtgtggactggacccatttggccctaagtaactgaattgtgtaccagtcagcagtagggatgcataacaccagagcttcattgattcaaaggcaaagcaggtggcattttactgaacaattaaatgtttgaagtaaccttttatagagtgagaaagatgtctgtctagttttaagtctttctgaagagaaatgggctggaatgtttggttggttgcagctattcttgtgttctttttaaaatatctgaaattatacttagatatggggcaggctttattcctacccaagtagcagcgatcagcgatgctggtgctaacccctggtctttgtctgtttccctattgctgacctcaggcaccacactgtaactcgaggcatcaccaaaggcgtgaaggaggactttcgcctggccatggagcgccaggtctcccgctgtggagagaatctgatggtggttctgcacaggttctgcattaatgagaagatcttgctccttcagactctgacctgagtggagacctttccaccagacacagctcgggcctgtgtaattgtaggagaagacactcagcagtgattgccatggcacagagccgtggtcattgttgctgttacaaagaagaaaaccatctgagttctaactccttggttgcttaaaagtagttcccaagagtctgagaagctatttctatttttaagagtcattttttgtaatttttgtaaaacaaaagtaccaatctgttttgtaaataaaaatcatcctaaaatttgaaaacatctgctcccttctctcctgct

SEQ ID NO: 167941 - DNA, 1137 bp, Homo sapiens
ccaacactgagggcacccggtgcttcactcaaaggagggagaagctcttaatctgttatacagaccttttgctcttaagtattttaaaatagagaaatgtttctgtgctgataaatgcagtatcttagttgtattagagtggattaaaatggaaaacaatgtcctacttatactctgaatagggtggataataatgttctatgaggtgatcaccagctaatacactaaatctttgttgttacagaattctgcacagccatgggtcccggactcttattttcccccatctgttctcaatacgtttttgaaattgaaactcacccttttttttaatcaaaaacattgccagaccatttagtcctcttggaagggcctctccggtggggcttcagtcctgttaaagatggttaccagacatcaccaggttgaatgctgggactggtgtaccgtgagaagagtggaaagtaaagaggctggctttgaaaatgtgtcttctcaaaggctgcccctactccctattgccattcagctgcattccatcatcctcttcctcactggtcgctttttataccacctcaaaagggggctgagctctgggaccaggaactgagacgcctctggacacgcaccagcagcagcgggtgcagtgagggctggctagcttctccccagtctccttaaacacccagccacggccaggggcttgttgaggttaatgagtttctgtttagtctgcttctagtcttgtgtattttctctggagtgttgtttttgcagtgcagggtgagtcggtgtgggtgtttgaatgctgctgtttgctgttttttaaaggccttctagccctcccatggggttactgcagcaggaattcttacctgtgcttcagcccagcatacagactgctgacaggtaccaagtggaatcaacgcccgctcatagtgtgctgtttgtcaacatgttcgctgcccatggttctcagctcttcgttcctcagtgctctttttcatgctttctttcttttttaatttgttccgcattttggcaaaccatctggttgtaatattgtaacatttcttattttttttccataagttgccagtgtgtttgtgttcgatttaaaaatcattatggatctgg

SEQ ID NO: 167942 - DNA, 494 bp, Homo sapiens
catctcatgccaagagttatctgtgcgagggagtttagtgggtataagaatcaggttttggcatcagacagatctgggttcaaatatggagtctgcagttagtggggtagcaatgggcaagttactcaactgccaagaccccatttccttatcagagagaactggcaccttttttagtgggatggcaatgggcaagttactcaactgccgagaccccatttcctcatcagagaaaactagcacctttttttacatgtggttaacctgaatctggcctgcagatattgatatgctggaggaatttgcctacttgagaactcaggaaggtgggaaaattcatctggaattactacccaatcaaggaatgctgatcaagtaagcatgttctcttttgctcttccatgctgagtgctcaccttttgtgtctttgtatgaagtatttgtaaatgtctatacctatcaaaaatttaatacaaaggactttaaacctggac

SEQ ID NO: 167943 - DNA, 2764 bp, Homo sapiens
atggcgaagaggcctggcgcctgcccgctcccgcgcatgctccctgacttcaccaaggtcacgctgcagcccgcaggaatgaaaatccacttctccgcattttcgaggtgacctggaagcggttcaactgctctggcttctcagaagaggaggggaccgggcggtaacgaggagccaaggggaggagactgctcgcaaaacccggaaaagctttcccgatccactctgccagcctccgtgcgcctccagacatgcgcagtagcctcccccgcggtggcggcggcggcggcggtggctgccgtggcggctgagagtccagagccggacgttccggccgcttcgggctggcggctggagagcgctcgggtcatgtctgcccagggggactgcgagttcctggtgcagcgagcccgggagttggtgccgcaagacctgtgggcagccaaggcgtggctgatcacggcccgcagcctctacccggcagactttaacatccagtatgagatgtacaccatcgagcggaatgcagagcggaccgccaccgccgggaggctgctgtacgacatgtttgtgaatttcccagaccagccggtggtgtggagagaaatcagcattattacatcagcattaaggaacgattcacaggacaaacaaacccaatttttaagaagtttatttgaaactcttcctggtcgagtccagtgtgaaatgttactaaaggtcacggaacaatgcttcaacacgttagaacgatcagaaatgttgcttctacttttgaggcgcttccctgaaacggtggtgcagcatggggttggccttggggaggcactattagaggctgaaactattgaagaacaagaatctccagtgaactgctttagaaaattatttgtttgtgatgtccttcctctaataattaacaaccatgatgttcgattacctgccaatttattgtataagtacttgaacaaagcagctgaattttatatcaattatgtcactaggtctactcaaatagaaaatcagcatcaaggcgcccaggatacatctgatttaatgtcacctagcaaacgtagctctcagaagtacataatagaagggctgacggaaaaatcatcccagatcgtggacccttgggagaggttgtttaagattttgaatgttgttggaatgagatgtgaatggcagatggataaaggaagacgaagctatggagatattttgcatagaatgaaggatctctgcagatacatgaacaactttgatagtgaagcacatgcaaaatataaaaaccaagtggtgtattccaccatgctggtcttctttaagaatgcattccagtatgtcaacagcatacagccatctctcttccaaggtcctaatgccccgagccaagttccactggttcttcttgaagatgtatcgaatgtgtatggtgatgtagaaattgatcgtaataaacacatccataaaaagaggaaactagctgaaggaagagaaaaaaccatgagttcagacgatgaagactgttcggcgaaaggaagaaatcgtcacattgtagtcaataaagccgaacttgctaactccactgaagtgttagaaagctttaaattggccagggagagctgggagttgctctattccctagaattccttgacaaagaatttacaaggatttgcttggcctggaagacggatacttggctttggttaagaatcttcctcactgatatgatcatctatcagggtcaatataaaaaggcgatagccagcctgcatcacttagcagctctccagggatccatttctcagccacagatcacagggcaggggaccctggagcatcagagggcgctcatccagctggcgacgtgccactttgcgctaggggagtacagaatgacatgtgaaaaagtccttgatttgatgtgctacatggtactccccattcaagatggaggcaaatcccaggaggaaccctcgaaagtaaagcccaaatttagaaaaggttcggatctgaagctcctgccttgtaccagcaaggctatcatgccatactgcctccatttaatgttagcctgttttaagcttagagctttcacagacaacagagacgacatggcattggggcatgtgattgtgttgcttcagcaagagtggccacggggcgagaatcttttcctgaaagctgtcaataaaatttgccaacaaggaaatttccaatatgagaattttttcaattacgttacaaatattgatatgctggaggaatttgcctacttgagaactcaggaaggtgggaaaattcatctggaattactacccaatcaaggaatgctgatcaagcaccacactgtaactcgaggcatcaccaaaggcgtgaaggaggactttcgcctggccatggagcgccaggtctcccgctgtggagagaatctgatggtggttctgcacaggttctgcattaatgagaagatcttgctccttcagactctgacctgagtggagacctttccaccagacacagctcgggcctgtgtaattgtaggagaagacactcagcagtgattgccatggcacagagccgtggtcattgttgctgttacaaagaagaaaaccatctgagttctaactccttggttgcttaaaagtagttcccaagagtctgagaagctatttctatttttaagagtcattttttgtaatttttgtaaaacaaaagtaccaatctgttttgtaaataaaaatcatcctaaaatttgaa

SEQ ID NO: 167944 - DNA, 1844 bp, Homo sapiens
attagctagtacgaggctgggtgttgaatcggccgaggaagtcttgaacaaagcagctgaattttatatcaattatgtcactaggtctactcaaatagaaaatcagcatcaaggcgcccaggatacatctgatttaatgtcacctagcaaacgtagctctcagaagtacataatagaagggctgacggaaaaatcatcccagatcgtggacccttgggagaggttgtttaagattttgaatgttgttggaatgagatgtgaatggcagatggataaaggaagacgaagctatggagatattttgcatagaatgaaggatctctgcagatacatgaacaactttgatagtgaagcacatgcaaaatataaaaaccaagtggtgtattccaccatgctggtcttctttaagaatgcattccagtatgtcaacagcatacagccatctctcttccaaggtcctaatgccccgagccaagttccactggttcttcttgaagatgtatcgaatgtgtatggtgatgtagaaattgatcgtaataaacacatccataaaaagaggaaactagctgaaggaagagaaaaaaccatgagttcagacgatgaagactgttcggcgaaaggaagaaatcgtcacattgtagtcaataaagccgaacttgctaactccactgaagtgttagaaagctttaaattggccagggagagctgggagttgctctattccctagaattccttgacaaagaatttacaaggatttgcttggcctggaagacggatacttggctttggttaagaatcttcctcactgatatgatcatctatcagggtcaatataaaaaggcgatagccagcctgcatcacttagcagctctccagggatccatttctcagccacagatcacagggcaggggaccctggagcatcagagggcgctcatccagctggcgacgtgccactttgcgctaggggagtacagaatgacatgtgaaaaagtccttgatttgatgtgctacatggtactccccattcaagatggaggcaaatcccaggaggaaccctcgaaagtaaagcccaaatttagaaaaggttcggatctgaagctcctgccttgtaccagcaaggctatcatgccatactgcctccatttaatgttagcctgttttaagcttagagctttcacagacaacagagacgacatggcattggggcatgtgattgtgttgcttcagcaagagtggccacggggcgagaatcttttcctgaaagctgtcaataaaatttgccaacaaggaaatttccaatatgagaattttttcaattacgttacaaatattgatatgctggaggaatttgcctacttgagaactcaggaaggtgggaaaattcatctggaattactacccaatcaaggaatgctgatcaagcaccacactgtaactcgaggcatcaccaaaggcgtgaaggaggactttcgcctggccatggagcgccaggtctcccgctgtggagagaatctgatggtggttctgcacaggttctgcattaatgagaagatcttgctccttcagactctgacctgagtggagacctttccaccagacacagctcgggcctgtgtaattgtaggagaagacactcagcagtgattgccatggcacagagccgtggtcattgttgctgttacaaagaagaaaaccatctgagttctaactccttggttgcttaaaagtagttcccaagagtctgagaagctatttctatttttaagagtcattttttgtaatttttgtaaaacaaaagtaccaatctgttttgtaaataaaaatcatcctaaaatttgaa

SEQ ID NO: 167945 - DNA, 2630 bp, Homo sapiens
atggcgaagaggcctggcgcctgcccgctcccgcgcatgctccctgacttcaccaaggtcacgctgcagcccgcaggaatgaaaatccacttctccgcattttcgaggtgacctggaagcggttcaactgctctggcttctcagaagaggaggggaccgggcggtaacgaggagccaaggggaggagactgctcgcaaaacccggaaaagctttcccgatccactctgccagcctccgtgcgcctccagacatgcgcagtagcctcccccgcggtggcggcggcggcggcggtggctgccgtggcggctgagagtccagagccggacgttccggccgcttcgggctggcggctggagagcgctcgggtcatgtctgcccagggggactgcgagttcctggtgcagcgagcccgggagttggtgccgcaagacctgtgggcagccaaggcgtggctgatcacggcccgcagcctctacccggcagactttaacatccagtatgagatgtacaccatcgagcggaatgcagagcggaccgccaccgccgggaggctgctgtacgacatgtttgtgaatttcccagaccagccggtggtgtggagagaaatcagcattattacatcagcattaaggaacgattcacaggacaaacaaacccaatttttaagaagtttatttgaaactcttcctggtcgagtccagtgtgaaatgttactaaaggtcacggaacaatgcttcaacacgttagaacgatcagaaatgttgcttctacttttgaggcgcttccctgaaacggtggtgcagcatggggttggccttggggaggcactattagaggctgaaactattgaagaacaagaatctccagtgaactgctttagaaaattatttgtttgtgatgtccttcctctaataattaacaaccatgatgttcgattacctgccaatttattgtataagtacttgaacaaagcagctgaattttatatcaattatgtcactaggtctactcaaatagaaaatcagcatcaaggcgcccaggatacatctgatttaatgtcacctagcaaacgtagctctcagaagtacataatagaagggctgacggaaaaatcatcccagatcgtggacccttgggagaggttgtttaagattttgaatgttgttggaatgagatgtgaatggcagatggataaaggaagacgaagctatggagatattttgcatagaatgaaggatctctgcagatacatgaacaactttgatagtgaagcacatgcaaaatataaaaaccaagtggtgtattccaccatgctggtcttctttaagaatgcattccagtatgtcaacagcatacagccatctctcttccaagagttcagacgatgaagactgttcggcgaaaggaagaaatcgtcacattgtagtcaataaagccgaacttgctaactccactgaagtgttagaaagctttaaattggccagggagagctgggagttgctctattccctagaattccttgacaaagaatttacaaggatttgcttggcctggaagacggatacttggctttggttaagaatcttcctcactgatatgatcatctatcagggtcaatataaaaaggcgatagccagcctgcatcacttagcagctctccagggatccatttctcagccacagatcacagggcaggggaccctggagcatcagagggcgctcatccagctggcgacgtgccactttgcgctaggggagtacagaatgacatgtgaaaaagtccttgatttgatgtgctacatggtactccccattcaagatggaggcaaatcccaggaggaaccctcgaaagtaaagcccaaatttagaaaaggttcggatctgaagctcctgccttgtaccagcaaggctatcatgccatactgcctccatttaatgttagcctgttttaagcttagagctttcacagacaacagagacgacatggcattggggcatgtgattgtgttgcttcagcaagagtggccacggggcgagaatcttttcctgaaagctgtcaataaaatttgccaacaaggaaatttccaatatgagaattttttcaattacgttacaaatattgatatgctggaggaatttgcctacttgagaactcaggaaggtgggaaaattcatctggaattactacccaatcaaggaatgctgatcaagcaccacactgtaactcgaggcatcaccaaaggcgtgaaggaggactttcgcctggccatggagcgccaggtctcccgctgtggagagaatctgatggtggttctgcacaggttctgcattaatgagaagatcttgctccttcagactctgacctgagtggagacctttccaccagacacagctcgggcctgtgtaattgtaggagaagacactcagcagtgattgccatggcacagagccgtggtcattgttgctgttacaaagaagaaaaccatctgagttctaactccttggttgcttaaaagtagttcccaagagtctgagaagctatttctatttttaagagtcattttttgtaatttttgtaaaacaaaagtaccaatctgttttgtaaataaaaatcatcctaaaatttgaa

SEQ ID NO: 167946 - DNA, 2789 bp, Homo sapiens
atggcgaagaggcctggcgcctgcccgctcccgcgcatgctccctgacttcaccaaggtcacgctgcagcccgcaggaatgaaaatccacttctccgcattttcgaggtgacctggaagcggttcaactgctctggcttctcagaagaggaggggaccgggcggtaacgaggagccaaggggaggagactgctcgcaaaacccggaaaagctttcccgatccactctgccagcctccgtgcgcctccagacatgcgcagtagcctcccccgcggtggcggcggcggcggcggtggctgccgtggcggctgagagtccagagccggacgttccggccgcttcgggctggcggctggagagcgctcgggtcatgtctgcccagggggactgcgagttcctggtgcagcgagcccgggagttggtgccgcaagacctgtgggcagccaaggcgtggctgatcacggcccgcagcctctacccggcagactttaacatccagtatgagatgtacaccatcgagcggaatgcagagcggaccgccaccgccgggaggctgctgtacgacatgtttgtgaatttcccagaccagccggtggtgtggagagaaatcagcattattacatcagcattaaggaacgattcacaggacaaacaaacccaatttttaagaagtttatttgaaactcttcctggtcgagtccagtgtgaaatgttactaaaggtcacggaacaatgcttcaacacgttagaacgatcagaaatgttgcttctacttttgaggcgcttccctgaaacggtggtgcagcatggggttggccttggggaggcactattagaggctgaaactattgaagaacaagaatctccagtgaactgctttagaaaattatttgtttgtgatgtccttcctctaataattaacaaccatgatgttcgattacctgccaatttattgtataagtacttgaacaaagcagctgaattttatatcaattatgtcactaggtctactcaaatagaaaatcagcatcaaggcgcccaggatacatctgatttaatgtcacctagcaaacgtagctctcagaagtacataatagaagggctgacggaaaaatcatcccagatcgtggacccttgggagaggttgtttaagattttgaatgttgttggaatgagatgtgaatggcagatggataaaggaagacgaagctatggagatattttgcatagaatgaaggatctctgcagatacatgaacaactttgatagtgaagcacatgcaaaatataaaaaccaagtggtgtattccaccatgctggtcttctttaagaatgcattccagtatgtcaacagcatacagccatctctcttccaaggtcctaatgccccgagccaagttccactggttcttcttgaagatgtatcgaatgtgtatggtgatgtagaaattgatcgtaataaacacatccataaaaagaggaaactagctgaaggaagagaaaaaaccatgagttcagacgatgaagactgttcggcgaaaggaagaaatcgtcacattgtagtcaataaagccgaacttgctaactccactgaagtgttagaaagctttaaattggccagggagagctgggagttgctctattccctagaattccttgacaaagaatttacaaggatttgcttggcctggaagacggatacttggctttggttaagaatcttcctcactgatatgatcatctatcagggtcaatataaaaaggcgatagccagcctgcatcacttagcagctctccagggatccatttctcagccacagatcacagggcaggggaccctggagcatcagagggcgctcatccagctggcgacgtgccactttgcgctaggggagtacagaatgacatgtgaaaaagtccttgatttgatgtgctacatggtactccccattcaagatggaggcaaatcccaggaggaaccctcgaaagtaaagcccaaatttagaaaaggttcggatctgaagctcctgccttgtaccagcaaggctatcatgccatactgcctccatttaatgttagcctgttttaagcttagagctttcacagacaacagagacgacatggcattggggcatgtgattgtgttgcttcagcaagagtggccacggggcgagaatcttttcctgaaagctgtcaataaaatttgccaacaaggaaatttccaatatgagaattttttcaattacgttacaaatattgatatgctggaggaatttgcctacttgagaactcaggaaggtgggaaaattcatctggaattactacccaatcaaggaatgctgatcaagcaccacactgtaactcgaggcatcaccaaaggcgtgaaggaggactttcgcctggccatggagcgccaggtctcccgctgtggagagaatctgatggtggttctgcacaggttctgcattaatgagaagatcttgctccttcagactctgacctgagtggagacctttccaccagacacagctcgggcctgtgtaattgtaggagaagacactcagcagtgattgccatggcacagagccgtggtcattgttgctgttacaaagaagaaaaccatctgagttctaactccttggttgcttaaaagtagttcccaagagtctgagaagctatttctatttttaagagtcattttttgtaatttttgtaaaacaaaagtaccaatctgttttgtaaataaaaatcatcctaaaatttgaaaacatctgctcccttctctcctgct

SEQ ID NO: 167947 - DNA, 2216 bp, Homo sapiens
atggcgaagaggcctggcgcctgcccgctcccgcgcatgctccctgacttcaccaaggtcacgctgcagcccgcaggaatgaaaatccacttctccgcattttcgaggtgacctggaagcggttcaactgctctggcttctcagaagaggaggggaccgggcggtaacgaggagccaaggggaggagactgctcgcaaaacccggaaaagctttcccgatccactctgccagcctccgtgcgcctccagacatgcgcagtagcctcccccgcggtggcggcggcggcggcggtggctgccgtggcggctgagagtccagagccggacgttccggccgcttcgggctggcggctggagagcgctcgggtcatgtctgcccagggggactgcgagttcctggtgcagcgagcccgggagttggtgccgcaagacctgtgggcagccaaggcgtggctgatcacggcccgcagcctctacccggcagactttaacatccagtatgagatgtacaccatcgagcggaatgcagagcggaccgccaccgccgggaggctgctgtacgacatgtttgtgaatttcccagaccagccggtggtgtggagagaaatcagcattattacatcagcattaaggaacgattcacaggacaaacaaacccaatttttaagaagtttatttgaaactcttcctggtcgagtccagtgtgaaatgttactaaaggtcacggaacaatgcttcaacacgttagaacgatcagaaatgttgcttctacttttgaggcgcttccctgaaacggtggtgcagcatggggttggccttggggaggcactattagaggctgaaactattgaagaacaagaatctccagtgaactgctttagaaaattatttgtttgtgatgtccttcctctaataattaacaaccatgatgttcgattacctgccaatttattgtataagtacttgaacaaagcagctgaattttatatcaattatgtcactaggtctactcaaatagaaaatcagcatcaaggcgcccaggatacatctgatttaatgtcacctagcaaacgtagctctcagaagtacataatagaagggctgacggaaaaatcatcccagatcgtggacccttgggagaggttgtttaagattttgaatgttgttggaatgagatgtgaatggcagatggataaaggaagacgaagctatggagatattttgcatagaatgaaggatctctgcagatacatgaacaactttgatagtgaagcacatgcaaaatataaaaaccaagtggtgtattccaccatgctggtcttctttaagaatgcattccagtatgtcaacagcatacagccatctctcttccaaggtcctaatgccccgagccaagttccactggttcttcttgaagatgtatcgaatgtgtatggtgatgtagaaattgatcgtaataaacacatccataaaaagaggaaactagctgaaggaagagaaaaaaccatgagttcagacgatgaagactgttcggcgaaaggaagaaatcgtcacattgtagtcaataaagccgaacttgctaactccactgaagtgttagaaagctttaaattggccagggagagctgggagttgctctattccctagaattccttgacaaagaatttacaaggatttgcttggcctggaagacggatacttggctttggttaagaatcttcctcactgatatgatcatctatcagggtcaatataaaaaggcgatagccagcctgcatcacttagcagctctccagggatccatttctcagccacagatcacagggcaggggaccctggagcatcagagggcgctcatccagctggcgacgtgccactttgcgctaggggagtacagaatgacatgtgaaaaagtccttgatttgatgtgctacatggtactccccattcaagatggaggcaaatcccaggaggaaccctcgaaagtaaagcccaaatttagaaaaggttcggatctgaagctcctgccttgtaccagcaaggctatcatgccatactgcctccatttaatgttagcctgttttaagcttagagctttcacagacaacagagacgacatggcattggggcatgtgattgtgttgcttcagcaagagtggccacggggcgagaatcttttcctgaaagctgtcaataaaatttgccaacaaggaaa

SEQ ID NO: 167948 - DNA, 2450 bp, Homo sapiens
atggcgaagaggcctggcgcctgcccgctcccgcgcatgctccctgacttcaccaaggtcacgctgcagcccgcaggaatgaaaatccacttctccgcattttcgaggtgacctggaagcggttcaactgctctggcttctcagaagaggaggggaccgggcggtaacgaggagccaaggggaggagactgctcgcaaaacccggaaaagctttcccgatccactctgccagcctccgtgcgcctccagacatgcgcagtagcctcccccgcggtggcggcggcggcggcggtggctgccgtggcggctgagagtccagagccggacgttccggccgcttcgggctggcggctggagagcgctcgggtcatgtctgcccagggggactgcgagttcctggtgcagcgagcccgggagttggtgccgcaagacctgtgggcagccaaggcgtggctgatcacggcccgcagcctctacccggcagactttaacatccagtatgagatgtacaccatcgagcggaatgcagagcggaccgccaccgccgggaggctgctgtacgacatgtttgtgaatttcccagaccagccggtggtgtggagagaaatcagcattattacatcagcattaaggaacgattcacaggacaaacaaacccaatttttaagaagtttatttgaaactcttcctggtcgagtccagtgtgaaatgttactaaaggtcacggaacaatgcttcaacacgttagaacgatcagaaatgttgcttctacttttgaggcgcttccctgaaacggtggtgcagcatggggttggccttggggaggcactattagaggctgaaactattgaagaacaagaatctccagtgaactgctttagaaaattatttgtttgtgatgtccttcctctaataattaacaaccatgatgttcgattacctgccaatttattgtataagtacttgaacaaagcagctgaattttatatcaattatgtcactaggtctactcaaatagaaaatcagcatcaaggcgcccaggatacatctgatttaatgtcacctagcaaacgtagctctcagaagtacataatagaagggctgacggaaaaatcatcccagatcgtggacccttgggagaggttgtttaagattttgaatgttgttggaatgagatgtgaatggcagatggataaaggaagacgaagctatggagatattttgcatagaatgaaggatctctgcagatacatgaacaactttgatagtgaagcacatgcaaaatataaaaaccaagtggtgtattccaccatgctggtcttctttaagaatgcattccagtatgtcaacagcatacagccatctctcttccaaggtcctaatgccccgagccaagttccactggttcttcttgaagatgtatcgaatgtgtatggtgatgtagaaattgatcgtaataaacacatccataaaaagaggaaactagctgaaggaagagaaaaaaccatgagttcagacgatgaagactgttcggcgaaaggaagaaatcgtcacattgtagtcaataaagccgaacttgctaactccactgaagtgttagaaagctttaaattggccagggagagctgggagttgctctattccctagaattccttgacaaagaatttacaaggatttgcttggcctggaagacggatacttggctttggttaagaatcttcctcactgatatgatcatctatcagggtcaatataaaaaggcgatagccagcctgcatcacttagcagctctccagggatccatttctcagccacagatcacagggcaggggaccctggagcatcagagggcgctcatccagctggcgacgtgccactttgcgctaggggagtacagaatgacatgtgaaaaagtccttgatttgatgtgctacatggtactccccattcaagatggaggcaaatcccaggaggaaccctcgaaagtaaagcccaaatttagaaaaggttcggatctgaagctcctgccttgtaccagcaaggctatcatgccatactgcctccatttaatgttagcctgttttaagcttagagctttcacagacaacagagacgacatggcattggggcatgtgattgtgttgcttcagcaagagtggccacggggcgagaatcttttcctgaaagctgtcaataaaatttgccaacaaggaaaaaaaaaaaaaaaaaaaaaaaaacaacaacaacaaacaaaaacgaaaacatacaaacaaaacccccggggcgcttcatattgtgcgggggcggcagaagacacagcgggataaaaaggggggcacagggcaaacaaggtgttttcgagaccccacgttttgttggacacggggggaaaaacggggcgcccccaataaaggaggcggcgaaataagcgcaaaagccgcgaccccaa

SEQ ID NO: 167949 - DNA, 1328 bp, Homo sapiens
ccaacactgagggcacccggtgcttcactcaaaggagggagaagctcttaatctgttatacagaccttttgctcttaagtattttaaaatagagaaatgtttctgtgctgataaatgcagtatcttagttgtattagagtggattaaaatggaaaacaatgtcctacttatactctgaatagggtggataataatgttctatgaggtgatcaccagctaatacactaaatctttgttgttacagaattctgcacagccatgggtcccggactcttattttcccccatctgttctcaatacgtttttgaaattgaaactcacccttttttttaatcaaaaacattgccagaccatttagtcctcttggaagggcctctccggtggggcttcagtcctgttaaagatggttaccagacatcaccaggttgaatgctgggactggtgtaccgtgagaagagtggaaagtaaagaggctggctttgaaaatgtgtcttctcaaaggctgcccctactccctattgccattcagctgcattccatcatcctcttcctcactggtcgctttttataccacctcaaaagggggctgagctctgggaccaggaactgagacgcctctggacacgcaccagcagcagcgggtgcagtgagggctggctagcttctccccagtctccttaaacacccagccacggccaggggcttgttgaggttaatgagtttctgtttagtctgcttctagtcttgtgtattttctctggagtgttgtttttgcagtgcagggtgagtcggtgtgggtgtttgaatgctgctgtttgctgttttttaaaggccttctagccctcccatggggttactgcagcaggaattcttacctgtgcttcagcccagcatacagactgctgacaggcaccacactgtaactcgaggcatcaccaaaggcgtgaaggaggactttcgcctggccatggagcgccaggtctcccgctgtggagagaatctgatggtggttctgcacaggttctgcattaatgagaagatcttgctccttcagactctgacctgagtggagacctttccaccagacacagctcgggcctgtgtaattgtaggagaagacactcagcagtgattgccatggcacagagccgtggtcattgttgctgttacaaagaagaaaaccatctgagttctaactccttggttgcttaaaagtagttcccaagagtctgagaagctatttctatttttaagagtcattttttgtaatttttgtaaaacaaaagtaccaatctgttttgtaaataaaaatcatcctaaaatttgaa

SEQ ID NO: 167950 - DNA, 1232 bp, Homo sapiens
atggcgaagaggcctggcgcctgcccgctcccgcgcatgctccctgacttcaccaaggtcacgctgcagcccgcaggaatgaaaatccacttctccgcattttcgaggtgacctggaagcggttcaactgctctggcttctcagaagaggaggggaccgggcggtaacgaggagccaaggggaggagactgctcgcaaaacccggaaaagctttcccgatccactctgccagcctccgtgcgcctccagacatgcgcagtagcctcccccgcggtggcggcggcggcggcggtggctgccgtggcggctgagagtccagagccggacgttccggccgcttcgggctggcggctggagagcgctcgggtcatgtctgcccagggggactgcgagttcctggtgcagcgagcccgggagttggtgccgcaagacctgtgggcagccaaggcgtggctgatcacggcccgcagcctctacccggcagactttaacatccagtatgagatgtacaccatcgagcggaatgcagagcggaccgccaccgccgggaggctgctgtacgacatgtttgtgaatttcccagaccagccggtggtgtggagagaaatcagcattattacatcagcattaaggaacgattcacaggacaaacaaacccaatttttaagaagtttatttgaaactcttcctggtcgagtccagtgtgaaatgttactaaaggtcacggaacaatgcttcaacacgttagaacgatcagaaatgttgcttctacttttgaggcgcttccctgaaacggtggtgcagcatggggttggccttggggaggcactattagaggctgaaactattgaagaacaagaatctccagtgaactgctttagaaaattatttgtttgtgatgtccttcctctaataattaacaaccatgatgttcgattacctgccaatttattgtataagtacttgaacaaagcagctgaattttatatcaattatgtcactaggtctactcaaatagaaaatcagcatcaaggcgcccaggatacatctgatttaatgtcacctagcaaacgtagctctcagaagtacataatagaagggctgacggaaaaatcatcccagatcgtggacccttgggagaggttgtttaagattttgaatgttgttggaatgagatgtgaatggcagatggataaaggaagacggtaataaatagcttatttccagaattg

SEQ ID NO: 167951 - DNA, 305 bp, Homo sapiens
aagctatggagatattttgcatagaatgaaggatctctgcagatacatgaacaactttgatagtgaagcacatgcaaaatataaaaaccaagtggtgtattccaccatgctggtcttctttaagaatgcattccagtatgtcaacagcatacagccatctctcttccaaggttggtttacaaattttagagtgtccaaaaagccagttcatactgtggggatggtaaggaagatgaaagtgtttatccagtattgctggatccgaataactgtggggcggtaccagtcctttttatagttggcga

SEQ ID NO: 167952 - DNA, 1611 bp, Homo sapiens
atggcgaagaggcctggcgcctgcccgctcccgcgcatgctccctgacttcaccaaggtcacgctgcagcccgcaggaatgaaaatccacttctccgcattttcgaggtgacctggaagcggttcaactgctctggcttctcagaagaggaggggaccgggcggtaacgaggagccaaggggaggagactgctcgcaaaacccggaaaagctttcccgatccactctgccagcctccgtgcgcctccagacatgcgcagtagcctcccccgcggtggcggcggcggcggcggtggctgccgtggcggctgagagtccagagccggacgttccggccgcttcgggctggcggctggagagcgctcgggtcatgtctgcccagggggactgcgagttcctggtgcagcgagcccgggagttggtgccgcaagacctgtgggcagccaaggcgtggctgatcacggcccgcagcctctacccggcagactttaacatccagtatgagatgtacaccatcgagcggaatgcagagcggaccgccaccgccgggaggctgctgtacgacatgtgagtgggacgcttgacatcacttttactgcactgaatctctccatgaggttttgtttctctctgcagaagtgggagttgggggaagatcttcaagttcatctatatcttcgatacctaaagcaaacctagtaaggagtccaggcctgccataaattgctgacatggcttttgcagaagagtttaattattattcttatgttttatccttgttaaaacttctgtttcataatttattctagaaataatatgtgctcattacaaaaattcaaacactacttgttatagagaacaaaaagtgaaagtgcatcctaaactgaaccagagttaagttttgtaggcagtatatctatacatgtatgcataatacataaataaggttttggggggaaggggttacaaaagtgagaagaccatactacctttgccctgcagcatgtttcctttactcactctcatggaccccttcccatatcagtatgtagagatccacttcattccttttcatgcctgtgtagtatttcgtagacactctcttcttggtagacatttaaatagatagttttaaattatttgaaattatattcagtgtgtcaacaattttgtagtcatattttggtgtttttctgtggaatagattctaagacattttcatagtcaaagtttatgcgcatttgaaaatttgatacgctatgaaattactctccaaaatgtgcgatcccagtctacattaccgccaatggtgtataaagagtgtgttttcccatacccttcccaacactggatattattagtctctttttagttcttgtcactgtgataggagaaaatggtatcttgctattttaaaaaaaaatttgtactactcatactgttaataagattcagtattgtttcaactgttctctttggctgtgtgtattctgtgatttgcctttgcctattttttctttcaaatagtttgttttattcttgttgacttttagaagctctttctatgttatggttacttgtcttttcacctataaaacccactaaagactta

SEQ ID NO: 167953 - DNA, 2594 bp, Homo sapiens
atggcgaagaggcctggcgcctgcccgctcccgcgcatgctccctgacttcaccaaggtcacgctgcagcccgcaggaatgaaaatccacttctccgcattttcgaggtgacctggaagcggttcaactgctctggcttctcagaagaggaggggaccgggcggtaacgaggagccaaggggaggagactgctcgcaaaacccggaaaagctttcccgatccactctgccagcctccgtgcgcctccagacatgcgcagtagcctcccccgcggtggcggcggcggcggcggtggctgccgtggcggctgagagtccagagccggacgttccggccgcttcgggctggcggctggagagcgctcgggtcatgtctgcccagggggactgcgagttcctggtgcagcgagcccgggagttggtgccgcaagacctgtgggcagccaaggcgtggctgatcacggcccgcagcctctacccggcagactttaacatccagtatgagatgtacaccatcgagcggaatgcagagcggaccgccaccgccgggaggctgctgtacgacatgtttgtgaatttcccagaccagccggtggtgtggagagaaatcagcattattacatcagcattaaggaacgattcacaggacaaacaaacccaatttttaagaagtttatttgaaactcttcctggtcgagtccagtgtgaaatgttactaaaggtcacggaacaatgcttcaacacgttagaacgatcagaaatgttgcttctacttttgaggcgcttccctgaaacggtggtgcagcatggggttggccttggggaggcactattagaggctgaaactattgaagaacaagaatctccagtgaactgctttagaaaattatttgtttgtgatgtccttcctctaataattaacaaccatgatgttcgattacctgccaatttattgtataagtacttgaacaaagcagctgaattttatatcaattatgtcactaggtctactcaaatagaaaatcagcatcaaggcgcccaggatacatctgatttaatgtcacctagcaaacgtagctctcagaagtacataatagaagggctgacggaaaaatcatcccagatcgtggacccttgggagaggttgtttaagattttgaatgttgttggaatgagatgtgaatggcagatggataaaggaagacggtcctaatgccccgagccaagttccactggttcttcttgaagatgtatcgaatgtgtatggtgatgtagaaattgatcgtaataaacacatccataaaaagaggaaactagctgaaggaagagaaaaaaccatgagttcagacgatgaagactgttcggcgaaaggaagaaatcgtcacattgtagtcaataaagccgaacttgctaactccactgaagtgttagaaagctttaaattggccagggagagctgggagttgctctattccctagaattccttgacaaagaatttacaaggatttgcttggcctggaagacggatacttggctttggttaagaatcttcctcactgatatgatcatctatcagggtcaatataaaaaggcgatagccagcctgcatcacttagcagctctccagggatccatttctcagccacagatcacagggcaggggaccctggagcatcagagggcgctcatccagctggcgacgtgccactttgcgctaggggagtacagaatgacatgtgaaaaagtccttgatttgatgtgctacatggtactccccattcaagatggaggcaaatcccaggaggaaccctcgaaagtaaagcccaaatttagaaaaggttcggatctgaagctcctgccttgtaccagcaaggctatcatgccatactgcctccatttaatgttagcctgttttaagcttagagctttcacagacaacagagacgacatggcattggggcatgtgattgtgttgcttcagcaagagtggccacggggcgagaatcttttcctgaaagctgtcaataaaatttgccaacaaggaaatttccaatatgagaattttttcaattacgttacaaatattgatatgctggaggaatttgcctacttgagaactcaggaaggtgggaaaattcatctggaattactacccaatcaaggaatgctgatcaagcaccacactgtaactcgaggcatcaccaaaggcgtgaaggaggactttcgcctggccatggagcgccaggtctcccgctgtggagagaatctgatggtggttctgcacaggttctgcattaatgagaagatcttgctccttcagactctgacctgagtggagacctttccaccagacacagctcgggcctgtgtaattgtaggagaagacactcagcagtgattgccatggcacagagccgtggtcattgttgctgttacaaagaagaaaaccatctgagttctaactccttggttgcttaaaagtagttcccaagagtctgagaagctatttctatttttaagagtcattttttgtaatttttgtaaaacaaaagtaccaatctgttttgtaaataaaaatcatcctaaaatttgaa

SEQ ID NO: 167954 - DNA, 2842 bp, Homo sapiens
atggcgaagaggcctggcgcctgcccgctcccgcgcatgctccctgacttcaccaaggtcacgctgcagcccgcaggaatgaaaatccacttctccgcattttcgaggtgacctggaagcggttcaactgctctggcttctcagaagaggaggggaccgggcggtaacgaggagccaaggggaggagactgctcgcaaaacccggaaaagctttcccgatccactctgccagcctccgtgcgcctccagacatgcgcagtagcctcccccgcggtggcggcggcggcggcggtggctgccgtggcggctgagagtccagagccggacgttccggccgcttcgggctggcggctggagagcgctcgggtcatgtctgcccagggggactgcgagttcctggtgcagcgagcccgggagttggtgccgcaagacctgtgggcagccaaggcgtggctgatcacggcccgcagcctctacccggcagactttaacatccagtatgagatgtacaccatcgagcggaatgcagagcggaccgccaccgccgggaggctgctgtacgacatgtttgtgaatttcccagaccagccggtggtgtggagagaaatcagcattattacatcagcattaaggaacgattcacaggacaaacaaacccaatttttaagaagtttatttgaaactcttcctggtcgagtccagtgtgaaatgttactaaaggtcacggaacaatgcttcaacacgttagaacgatcagaaatgttgcttctacttttgaggcgcttccctgaaacggtggtgcagcatggggttggccttggggaggcactattagaggctgaaactattgaagaacaagaatctccagtgaactgctttagaaaattatttgtttgtgatgtccttcctctaataattaacaaccatgatgttcgattacctgccaatttattgtataagtacttgaacaaagcagctgaattttatatcaattatgtcactaggtctactcaaatagaaaatcagcatcaaggcgcccaggatacatctgatttaatgtcacctagcaaacgtagctctcagaagtacataatagaagggctgacggaaaaatcatcccagatcgtggacccttgggagaggttgtttaagattttgaatgttgttggaatgagatgtgaatggcagatggataaaggaagacgaagctatggagatattttgcatagaatgaaggatctctgcagatacatgaacaactttgatagtgaagcacatgcaaaatataaaaaccaagtggtgtattccaccatgctggtcttctttaagaatgcattccagtatgtcaacagcatacagccatctctcttccaaggtcctaatgccccgagccaagttccactggttcttcttgaagatgtatcgaatgtgtatggtgatgtagaaattgatcgtaataaacacatccataaaaagaggaaactagctgaaggaagagaaaaaaccatgagttcagacgatgaagactgttcggcgaaaggaagaaatcgtcacattgtagtcaataaagccgaacttgctaactccactgaagtgttagaaagctttaaattggccagggagagctgggagttgctctattccctagaattccttgacaaagaatttacaaggatttgcttggcctggaagacggatacttggctttggttaagaatcttcctcactgatatgatcatctatcagggtcaatataaaaaggcgatagccagcctgcatcacttagcagctctccagggatccatttctcagccacagatcacagggcaggggaccctggagcatcagagggcgctcatccagctggcgacgtgccactttgcgctaggggagtacagaatgacatgtgaaaaagtccttgatttgatgtgctacatggtactccccattcaagatggaggcaaatcccaggaggaaccctcgaaagtaaagcccaaatttagaaaaggttcggatctgaagctcctgccttgtaccagcaaggctatcatgccatactgcctccatttaatgttagcctgttttaagcttagagctttcacagacaacagagacgacatggcattggggcatgtgattgtgttgcttcagcaagagtggccacggggcgagaatcttttcctgaaagctgtcaataaaatttgccaacaaggaaatttccaatatgagaattttttcaattacgttacaaatattgatatgctggaggaatttgcctacttgagaactcaggaaggtgggaaaattcatctggaattactacccaatcaaggaatgctgatcaagccttctagccctcccatggggttactgcagcaggaattcttacctgtgcttcagcccagcatacagactgctgacaggcaccacactgtaactcgaggcatcaccaaaggcgtgaaggaggactttcgcctggccatggagcgccaggtctcccgctgtggagagaatctgatggtggttctgcacaggttctgcattaatgagaagatcttgctccttcagactctgacctgagtggagacctttccaccagacacagctcgggcctgtgtaattgtaggagaagacactcagcagtgattgccatggcacagagccgtggtcattgttgctgttacaaagaagaaaaccatctgagttctaactccttggttgcttaaaagtagttcccaagagtctgagaagctatttctatttttaagagtcattttttgtaatttttgtaaaacaaaagtaccaatctgttttgtaaataaaaatcatcctaaaatttgaa

SEQ ID NO: 167955 - DNA, 1223 bp, Homo sapiens
accaggcgcacttctggccaggcagcagcaagctgtgaacagctgctgagctgtcgctgtggcttgtggctcatgcgccattcctggtgagttgctctattccctagaattccttgacaaagaatttacaaggatttgcttggcctggaagacggatacttggctttggttaagaatcttcctcactgatatgatcatctatcagggtcaatataaaaaggcgatagccagcctgcatcacttagcagctctccagggatccatttctcagccacagatcacagggcaggggaccctggagcatcagagggcgctcatccagctggcgacgtgccactttgcgctaggggagtacagaatgacatgtgaaaaagtccttgatttgatgtgctacatggtactccccattcaagatggaggcaaatcccaggaggaaccctcgaaagtaaagcccaaatttagaaaaggttcggatctgaagctcctgccttgtaccagcaaggctatcatgccatactgcctccatttaatgttagcctgttttaagcttagagctttcacagacaacagagacgacatggcattggggcatgtgattgtgttgcttcagcaagagtggccacggggcgagaatcttttcctgaaagctgtcaataaaatttgccaacaaggaaatttccaatatgagaattttttcaattacgttacaaatattgatatgctggaggaatttgcctacttgagaactcaggaaggtgggaaaattcatctggaattactacccaatcaaggaatgctgatcaagcaccacactgtaactcgaggcatcaccaaaggcgtgaaggaggactttcgcctggccatggagcgccaggtctcccgctgtggagagaatctgatggtggttctgcacaggttctgcattaatgagaagatcttgctccttcagactctgacctgagtggagacctttccaccagacacagctcgggcctgtgtaattgtaggagaagacactcagcagtgattgccatggcacagagccgtggtcattgttgctgttacaaagaagaaaaccatctgagttctaactccttggttgcttaaaagtagttcccaagagtctgagaagctatttctatttttaagagtcattttttgtaatttttgtaaaacaaaagtaccaatctgttttgtaaataaaaatcatcctaaaatttgaa

SEQ ID NO: 167956 - DNA, 2185 bp, Homo sapiens
atggcgaagaggcctggcgcctgcccgctcccgcgcatgctccctgacttcaccaaggtcacgctgcagcccgcaggaatgaaaatccacttctccgcattttcgaggtgacctggaagcggttcaactgctctggcttctcagaagaggaggggaccgggcggtaacgaggagccaaggggaggagactgctcgcaaaacccggaaaagctttcccgatccactctgccagcctccgtgcgcctccagacatgcgcagtagcctcccccgcggtggcggcggcggcggcggtggctgccgtggcggctgagagtccagagccggacgttccggccgcttcgggctggcggctggagagcgctcgggtcatgtctgcccagggggactgcgagttcctggtgcagcgagcccgggagttggtgccgcaagacctgtgggcagccaaggcgtggctgatcacggcccgcagcctctacccggcagactttaacatccagtatgagatgtacaccatcgagcggaatgcagagcggaccgccaccgccgggaggctgctgtacgacatgtttgtgaatttcccagaccagccggtggtgtggagagaaatcagcattattacatcagcattaaggaacgattcacaggacaaacaaacccaatttttaagaagtttatttgaaactcttcctggtcgagtccagtgtgaaatgttactaaaggtcacggaacaatgcttcaacacgttagaacgatcagaaatgttgcttctacttttgaggcgcttccctgaaacggtggtgcagcatggggttggccttggggaggcactattagaggctgaaactattgaagaacaagaatctccagtgaactgctttagaaaattatttgtttgtgatgtccttcctctaataattaacaaccatgatgttcgattacctgccaatttattgtataagtacttgaacaaagcagctgaattttatatcaattatgtcactaggtctactcaaatagaaaatcagcatcaaggcgcccaggatacatctgatttaatgtcacctagcaaacgtagctctcagaagtacataatagaagggctgacggaaaaatcatcccagatcgtggacccttgggagaggttgtttaagattttgaatgttgttggaatgagatgtgaatggcagatggataaaggaagacgaagctatggagatattttgcatagaatgaaggatctctgcagatacatgaacaactttgatagtgaagcacatgcaaaatataaaaaccaagtggtgtattccaccatgctggtcttctttaagaatgcattccagtatgtcaacagcatacagccatctctcttccaaggtcctaatgccccgagccaagttccactggttcttcttgaagatgtatcgaatgtgtatggtgatgtagaaattgatcgtaataaacacatccataaaaagaggaaactagctgaaggaagagaaaaaaccatgagttcagacgatgaagactgttcggcgaaaggaagaaatcgtcacattgtagtcaataaagccgaacttgctaactccactgaagtgttagaaagctttaaattggccagggagagctgggagttgctctattccctagaattccttgacaaagaatttacaaggatttgcttggcctggaagacggatacttggctttggttaagaatcttcctcactgatatgatcatctatcagggtcaatataaaaaggcgatagccagcctgcatcacttagcagctctccagggatccatttctcagccacagatcacagggcaggggaccctggagcatcagagggcgctcatccagctggcgacgtgccactttgcgctaggggagtacagaatgacatgtgaaaaagtccttgatttgatgtgctacatggtactccccattcaagatggaggcaaatcccaggaggaaccctcgaaagtaaagcccaaatttagaaaaggtacagtgacatgttttatgactattttgtaaaaatagctttagaaagccaggcacggtggctcacacttgtaatctcagctactcggaagtcgaggcgggaggatagcttttgagcccaggagtttgagaccagcctgggcaatgtagtgagaccccatctcttaaaaaattttaa

SEQ ID NO: 167957 - DNA, 350 bp, Homo sapiens
agctgcatcccacccttcagccagcattcctagcaccctgccatcctccggtttcttttgtgtggcctcaccagccgctttctctcctcaatgtgtcaccgaacatggggccatctggaagtgtgtttagaagataacggagcacaggaatagtcccaagaagtgcatttaaaaactgttactgtgtaataactttatgatacattctgccgcatcctcttaaaaataccttttgtatctgttttcttgtcatttccattatgccttttaaagtgggttgaagaccgtgaatgaacaactgagtggtgtaccatggctgcccttttgcaaaattgaagacctttttttcc

SEQ ID NO: 167958 - DNA, 456 bp, Homo sapiens
aaaaaatccaattcaaactgttttgaacgttggaaaaaaaaagtttggtacattttgctaacccaaaagttaaagcagaaggcaatgtttgacctaagtctcctcaccaagggcaccaaagatccagcctctgcctagtacattttctgttatttctctcaggcccagccttctgggagaccatgcatttctttcagggagcatcaggtgctcttcttggagtcacataggaaggtcaacctccctcctcacagaattgctgttcagatgcagagagcttcactctcagagcagccaagcaagcataattccttagcctggttttcagtggcttaaaatctgtgagactctttcctgaaaccaatgaatataattaagctgattcgattaagccagttactaagtctctatagaggttaaagtgtggtctatcccaccaaaatttatttagagttt

SEQ ID NO: 167959 - DNA, 135 bp, Homo sapiens
tgctttcctattctcttgcctgatgtgaagttgcacattgcatgagttggggctgccaagacaaattaccatatgctgggggcttcaaactacaggaattcttctgtgaccattgtgaaggccagaaagctcaca

SEQ ID NO: 167960 - DNA, 508 bp, Homo sapiens
ggaatattttgaaatcacatcaccagtatttactaaacacttgaaaaaaatgtatcatcagtacatggagacttgaaaactactctttggtcacaaaaagcacttggcagcacatttccagaatgtttaaatttttatttctactcaactaagaacaaaaccaacaagtactactgtaaaccagataagatgatctgctttcagacaaacatgacaggtagcaaaagaagtgaaaaatgactgactacagaaaatagatcatagaataattaggcagattaataagaacaaagaaacagctgcagaaaggtttgtaaccttaccattttaaaaaaaatccaatttcaatattatacacaacagtatcaaccctaaaaattcacagcttagggagaaatgccctgaatcagacaggctgtctgtatgtaataattgttaataatttttttttttgaaacggagtctcgctctgtcgcccaggttggagtgcagtggcaccatctcgcct

SEQ ID NO: 167961 - DNA, 308 bp, Homo sapiens
gtcatttttccattatggtttcttacttttaggtcttgaaagttttcggctttctatctgcctatataattcacatagtgctatggtggacaacactctgtaatggtttttggaaagctaggtactccacaagagtgcatgaagcgtcagagaggaggtctagaactctgggagagctaaggagcaatcaaggactagagctgccctttggctgagggttccttcattaagactagtgactgccatgttgtgctgtgagcccagagaagacgagcatcctgtgggagttcccacctgtggagttcatc

SEQ ID NO: 167962 - DNA, 334 bp, Homo sapiens
aaattgagtgtgaggtgtatgggaactctggactatctttgtaatttttctgtccatctaaaactactaaaattaaaattttattttaaaaagcatagctaaataaaggtaagacactattataagtaatggttattttatccagaaggatattatcgagctctggtatataattcccttagttttaaaagtctattcatgaagtcattcctcaacttctctctctgggtgatatttaatgtccttatggatcgtacttcatctcttctcccactagcttggagcagtttcaggttcccagctaaagaaactgaaggatatcacataacagttc

SEQ ID NO: 167963 - DNA, 832 bp, Homo sapiens
aggtgtgcggagggtaacggatgtagggaggcatttagtagggcttgttctctaaccacctctctccgagagtttcaaagggagtgggatctggggaaggttgaggcctcaggcctgggaactaggaatactttcccttttacccaccaccatcccaggcctggaagaagatcagaagttggacaggagaggtccggccgcgcggacgtcaccttagcgcgccactgtcggctccggtgggctcgggtgagctcgggtgaacgcagcgagcgagggcagaggccagcagaggcgaggagtggatgctgcagggccgaggccgggcagagaaacgcataccgggtcgctccctgcttcgccgccgcctcctggcaggggccagcgaagccaagtgctccagcgccccccgtaacacctcaaagcgcacggagtccgtgtgggggaacttggcggcaggagtgactgggacctaggaacctgcggggggccgcgcggcctccgggggccgagcgcctggacctcgccctgaggtaaacgcgggtcgacccggggggcggatggggctcgggcgggtcgagcgaggcggaggtgagcgagcggagaacgcaggagcatgcgggggccgctaggggggaccaatggatacgcggcggcggggctgccggagcagggcggggcaggcaatgacagcggactttcacgggcgacctaatccccgagattttaggaaacccggcagggagacaatgcagcacccggggggggccccaagggaaaacaccgaaaataataatacgagcagcgggccaaaccagaaacacgatgcagcgct

SEQ ID NO: 167964 - DNA, 594 bp, Homo sapiens
gcagggaagactcactccactgctcttctccatcccaggcggcctgcatgtggttagcacatcattctccaggacacagtacatctgggacaagaccctgccctgccagcttggtgcctcctgccctgcttgccgttctgctctgcatggactcactgggggaacctttcttgtcttcaagcattttctggacactacctgcctgagtgcactgagggtgcagatgagaaggtacaaccctgcctgcaggaaagtcatagtctcctaggggacacagacaaatgaactgggtcacagcaccttgggacgaatgtcaaggcagacaacaggcagctgggtgcaatggtgtaagcctgtaatccctactactcgggaggctgaggtgggaggatagcttgagcctgtgagttcaaggctagcttgggcaacagagcaagaccctgtctcaagaaacgatggacaataggcctagaactttactctgtctcctgacactaagacatccatctgggactcagctgtgtgttcagtgcctggcaccaagcctgcccagcagcagaggtgcagcaacacctgatgaaggaaggaatgtgc

SEQ ID NO: 167965 - DNA, 176 bp, Homo sapiens
gacaaaaaaaaaggaaataaaaggtacacacactgggagggaagaactcacactgtctttgttcacagataacatgatcatctatgtagacattccaaaacaatcaaccaaaaaaaaccaaggttcatattcagtagcaaggccgggcgcggtggctcatgcctgtaatcccagca

SEQ ID NO: 167966 - DNA, 115 bp, Homo sapiens
atttcaagccattgcttctataaattactttttctgcatgatctctccctttccttctggaactttattgtcccatacgttgctgaagctctgtttgttttttctcagtctttat

SEQ ID NO: 167967 - DNA, 476 bp, Homo sapiens
gataacagtagacttgctctgttgcccaggctggagtgcagtggtgcagtctcggctcactgcaacctgtgcctcctgggttcaagcagttctcgtgcctcagcctcccaagtagcagggatatttttagtagagatggggtttcaccatgttggccaggctagtcttaaacaccttacctcaagtgatctgcccaccttggcctctcaaagtgctgggcttacagatgtgagccactgcgttcggccctcatttcttaattacctgtaacttttacattgacccaaatctgggagataggataggatctaattttgaaatgtcaaagacgtgcttttagaacatcataagaagaaccttttgttattttgttggtgggggatggagtctcactctgtggctcaacctcttcctcctgggttcaaggaattctggtgcctcagcctcccacatagctgggatcacagacatttccc

SEQ ID NO: 167968 - DNA, 342 bp, Homo sapiens
cagattttttttttttaattctacaacagaagtaaaattacttgccccaggtcatggaaccaggaaataaaatctagaaacaatccccaagcctttcaagtctcttgagtacattaagcacagtggttgcaacagcaccaggggtcagaagaccttggcagtgcctgactccaccactaacgggccatgtgccattgggcaagtcccatgacttccccctttccacctacagagcctactgacagggctgggactgagcatcggaagagatgctgtccgtgaaagcactctcaagtcaggaactgaactaagaactttactcctcttgacaactccttacca

SEQ ID NO: 167969 - DNA, 290 bp, Homo sapiens
tctcccctccctttttgtttgttttgctggttgggaggttggggatagcaggtgctttgtagagtcaagactctaccacttgactgtctagagaccatagggatctgtagttgctgatcacagactggaatactggaaggtactgttttcagggctatcctgttaaagtgcttcttgttttgtcttgaactaaaacaatgaatactctgaatttctgactcgacattttataaagatggagtgatatgcatttattgaattaacttatttttttagcactctggcttttt

SEQ ID NO: 167970 - DNA, 443 bp, Homo sapiens
taggacatggatgggcacaggacatgtgtctggtgagcgtagctgccagggccggtccctgacaccccaaggagactttctggtcccagcccagcctacactcccacctgctctggagaggctgtgtttccttccaaggatggatgctgatgatgtctgatggcttctggatgtctgatctcaaggggaccttctcttagggggctttaggccaccctggaaaggtctcagcatcaccccttggagcggggaggattttcaccccttgcccacacacaagctaaaactgcttctgctgcagctctgggagacctagaaccagggcccctcctgagagccagtgggtgggggcaggccccctggaaaatcgctgagagctcagcagtttcagccttcactcccctcctcactcccctcctccagcctgcagaaacctagcccag

SEQ ID NO: 167971 - DNA, 299 bp, Homo sapiens
  misc_feature (2)..(2): n is a, c, g, or t
  misc_feature (26)..(26): n is a, c, g, or t
tnacatcaacccagtcaacaccatantctaatagaaaacaaccttaaaccaaataattctgaatggaatagaaggaaaaattaccaactctaaactgcaaaggacaaaaaaaaaaaataaaaagccagctgctttaccctgctaatcacctgaccatgaaaagagccaaattctgtaaaatatttgaagagtaaatttttctgtaaaatattctgagccaaatatgagtggtcatgacccaaggcacagtctcaagaggtcctaagaacatgtgcccaaggtggttgggttgacaaaag

SEQ ID NO: 167972 - DNA, 364 bp, Homo sapiens
agatgggatctcactctgttgcccaggcaggtctcgaactccttgagctcaagtgatcctccctcctcagcctcccaaggtgctgggattacaggtgtgagccaccatgccctgtctaaacaagctgtttaattacagtgttttagatgctgtgagggaaaagtatgtgtgtacagtgagagcaaacaacgcagcctgtgagggaggatctcctggctttgaatccactttcatgcgtctgtcccattaaagtcagacacttgccagccgtgaaactttaatctttttgccacgggtatttaatctaaatttagaggatgagaatgatgcagaggtaccttggatgtcatgaccttccttacgt

SEQ ID NO: 167973 - DNA, 420 bp, Homo sapiens
aagtggatagtagatggcttaactttagttgaacttgagtgaatgtatagtgagttggtgaaatgattgccttaacggaaatgctggtgctgatggatctttgtagacagagagtgagggcgtagtatattctgttgccgttagtttataaggtaccattgatgagaccaagttcaggtcgtcttcctgatttcttcgaatttgagagcctgagtattggtgaggcttggctgccagtattcatttgggatatttgccaaggaggattagataactttctgcatttgcatcgcatattacctctacctggaattgatatggcctgaacactgtttttgaatattttttgcttcatttgagtccttacgagcttgcagtccactccaggtggaccatatcttttaccatcatggccttttt

SEQ ID NO: 167974 - DNA, 1822 bp, Homo sapiens
gcagtgtcactaggccggctgggggccctgggtacgctgtagaccagaccgcgacaggccagaacacgggcggcggcttcgggccgggagacccgcgcagccctcggggcatctcagtgcctcattccccaccccctcccccgggtcgggggaggcggcgcgtccggcggagggttgaggggagcggggcaggcctggagcgccatgagcagcccggatgcgggatacgccagtgacgaccagagccagacccagagcgcgctgcccgcggtgatggccgggctgggcccctgcccctgggccgagtcgctgagccccatcggggacatgaaggtgaagggcgaggcgccggcgaacagcggagcaccggccggggccgcgggccgagccaagggcgagtcccgtatccggcggccgatgaacgctttcatggtgtgggctaaggacgagcgcaagcggctggcgcagcagaatccagacctgcacaacgccgagttgagcaagatgctgggcaagtcgtggaaggcgctgacgctggcggagaagcggcccttcgtggaggaggcagagcggctgcgcgtgcagcacatgcaggaccaccccaactacaagtaccggccgcggcggcgcaagcaggtgaagcggctgaagcgggtggagggcggcttcctgcacggcctggctgagccgcaggcggccgcgctgggccccgagggcggccgcgtggccatggacggcctgggcctccagttccccgagcagggcttccccgccggcccgccgctgctgcctccgcacatgggcggccactaccgcgactgccagagtctgggcgcgcctccgctcgacggctacccgttgcccacgcccgacacgtccccgctggacggcgtggaccccgacccggctttcttcgccgccccgatgcccggggactgcccggcggccggcacctacagctacgcgcaggtctcggactacgctggccccccggagcctcccgccggtcccatgcacccccgactcggcccagagcccgcgggtccctcgattccgggcctcctggcgccacccagcgcccttcacgtgtactacggcgcgatgggctcgcccggggcgggcggcgggcgcggcttccagatgcagccgcaacaccagcaccagcaccagcaccagcaccaccccccgggccccggacagccgtcgccccctccggaggcactgccctgccgggacggcacggaccccagtcagcccgccgagctcctcggggaggtggaccgcacggaatttgaacagtatctgcacttcgtgtgcaagcctgagatgggcctcccctaccaggggcatgactccggtgtgaatctccccgacagccacggggccatttcctcggtggtgtccgacgccagctccgcggtatattactgcaactatcctgacgtgtgacaggtccctgatccgccccagcctgcaggccagaagcagtgttacacacttcctggaggagctaaggaaatcctcagactcctgggtttttgttgttgctgttgttgttttttaaaaggtgtgttggcatataatttatggtaatttattttgtctgccacttgaacagtttgggggggtgaggtttcatttaaaatttgttcagagatttgtttcccatagttggattgtcaaaaccctatttccaagttcaagttaactagctttgaatgtgtcccaaaacagcttcctccatttcctgaaagtttattgatcaaagaaatgttgtcctgggtgtgttttttcaatcttctaaaaaataaaatctggaatc

SEQ ID NO: 167975 - DNA, 2378 bp, Homo sapiens
ctgttctttgcgagcctgacgcccaaaaccaggggtgtgtagcggccacgtcctttcttaaggctctgggttcccttcccgcttcccgccctccgaccctccaaagcagctttccgccttgctctccggctcccggattccccaggtggccgggggcgcgggtccaacggctctgggaaggcgacttcccggcacctccgggcggcgcgagagcacccttggccctgaactgggccggttgtgtccatccctcgaccccttccctagttaggtgtccttttctgtttttcgaacgaccgggtgatgggtgagcggaaagccgcttccaggagaccaaaagaaaggggtgcctttagaggacgggtgttccccaagggctcggactcaggagtcccagatctccctctttaacttcaccccggttgcgcaattcaaagtctgaggggggaggtgcgtccaggtggggccaggtggggcctggagcgggagcgcagccgataagccctgcgcccctctcccccttccttccactgtgcaggcaagtcgtggaaggcgctgacgctggcggagaagcggcccttcgtggaggaggcagagcggctgcgcgtgcagcacatgcaggaccaccccaactacaagtaccggccgcggcggcgcaagcaggtgaagcggctgaagcgggtggagggcggcttcctgcacggcctggctgagccgcaggcggccgcgctgggccccgagggcggccgcgtggccatggacggcctgggcctccagttccccgagcagggcttccccgccggcccgccgctgctgcctccgcacatgggcggccactaccgcgactgccagagtctgggcgcgcctccgctcgacggctacccgttgcccacgcccgacacgtccccgctggacggcgtggaccccgacccggctttcttcgccgccccgatgcccggggactgcccggcggccggcacctacagctacgcgcaggtctcggactacgctggccccccggagcctcccgccggtcccatgcacccccgactcggcccagagcccgcgggtccctcgattccgggcctcctggcgccacccagcgcccttcacgtgtactacggcgcgatgggctcgcccggggcgggcggcgggcgcggcttccagatgcagccgcaacaccagcaccagcaccagcaccagcaccaccccccgggccccggacagccgtcgccccctccggaggcactgccctgccgggacggcacggaccccagtcagcccgccgagctcctcggggaggtggaccgcacggaatttgaacagtatctgcacttcgtgtgcaagcctgagatgggcctcccctaccaggggcatgactccggtgtgaatctccccgacagccacggggccatttcctcggtggtgtccgacgccagctccgcggtatattactgcaactatcctgacgtgtgacaggtccctgatccgccccagcctgcaggccagaagcagtgttacacacttcctggaggagctaaggaaatcctcagactcctgggtttttgttgttgctgttgttgttttttaaaaggtgtgttggcatataatttatggtaatttattttgtctgccacttgaacagtttgggggggtgaggtttcatttaaaatttgttcagagatttgtttcccatagttggattgtcaaaaccctatttccaagttcaagttaactagctttgaatgtgtcccaaaacagcttcctccatttcctgaaagtttattgatcaaagaaatgttgtcctgggtgtgttttttcaatcttctaaaaaataaaatctggaatcctgcttttttgctctactagtacctctgtcacactaatcttatcaaaaaccagttcttaagatcaatgttaagtttattagttaatgtaaatttctcatcctcgaaaagggtgaacataaatgcctttaaggagtatatctaaaaataaacattaggatatctaagtttgatgtaattgtttcaggaaggaaaaaagaaaagcattctggaatgagcctacttcaagtaatcttagtttctaaaactaacagttaatattttcaattccagtatatcactttaagtagaaggggatgtccaagtaattttggttttctaactgttgaatcataagcttgacctgcccccagaggctttttggatgtttttatctgtgttttgccatctctttacactcctcgacattcagtttaccttaatcttcacatttttacaccttgggaagtggcaagcatcgctgggtttaagataaaggagtcacaaaaactaatcaaaataaaatttgcattatgacaacttttaaaactt

SEQ ID NO: 167976 - DNA, 257 bp, Homo sapiens
actcaaaaccactcctagcaataccagatggagacaacaaggcactggatgttactttacgctatcttaaaacattgcagtattttactcatgtcagattataatcaaacaaatcacgctgtcaaacagtttttagacattatcaaatgattaattttgaaattcaaaaaacatgtatccaatattggctggggaaaaccccttgtgactggcactttcgaacagctgtgggaatataaggcagcagcagctttctg

SEQ ID NO: 167977 - DNA, 230 bp, Homo sapiens
acccgcctcggcctcccaaagtgctgggattataggcatgagccactgtgcctagccagagaaaggtataacattgatgagcaaactcatgaattggaagattacattgaggaattctctgagaatgcagcattatatgataaagaaagataacacatggagtaaaatctaagagatacgataggtataggtagaaggactatctagataaataggtgtcttagaggaga

SEQ ID NO: 167978 - DNA, 360 bp, Homo sapiens
ggggttggcttatgcatctgaaatctcatcttgttttaggaagaattgctctgaatatctatggacctggaggctaagaaagacattcatgaaagattgacaaatcaaatcaaatccagaagtatttaaagcaaaggtgcatcaggagaaagtcaggcttaacctagaaattcaagaatgattcaacacggaaaaatctattacagtaattcattaggttaggggaaggcagtgtcgggtgggaccaggcaaggccctggaggaagcaaggctctcctttcccactttagcttgggcagggtggggcatacagcccacagacacatttcaacttgagtgtcattctgtacgcaacatcgt

SEQ ID NO: 167979 - DNA, 779 bp, Homo sapiens
ggttaaactacaggatactagcaaatatgatgcaagcccaaacgtgaagactgcttgagcacagcaggcttgctcccatgtgaataagccccagctgacctcttcaaggatgaaaaccaatgcagagaagaagacctcagcccctaagcatcccatctggcaccatcctagatcatccaaccctaatcgagccagtccaaatcataagaactacatagtcgagtcccagaccaatgaacaataaaaatgtttgatgttttaatccactaagtatggggtgattcatcacgtagtaaaagctaactgatatatgcatatgcccagtgaaagactaatttctaatttgagtccaaaataagttagagacaagattcaaaactcttacatggtgatatggtttggctgtgtcaccatccaaatctcaccttgacttgtagctcccttaattaccacgtattgtgggaggaatccagtggggggtaattgaatcatggaggcgggtcttccccatgctattcttatgatagtgaataagtctcgcaagatctgatggttttataaagggtagtttccctgcacaagctctcttctctcatctgtggccatgtgagatgtgcctttcaccttcagccatgattgtgaggcctccccagccatgtggaactatgactccattaaacctctttgttttgtaaattgcccagtcacaggtatgcctttatcagcggcatgaaaatgagctaatacacatggagcgggggaaggaactcagagaacaa

SEQ ID NO: 167980 - DNA, 404 bp, Homo sapiens
ggagacagagtcttactctgtcacccaggctagagtgcagtggggtgatctcagctcactgaaacttctgccttctgggttcaagcaattctcctgcctcagcctctcgagtagctgggattacaggcatgtgccaccatgcccagctaatttttgtaattttagtagagatggggtttcgccatgttggccaggctggtcttgaactcctgaccttaggtaatccacctgccttggcctcccaaagtgacaggactgcaggagtgagccactgcacccagcccattccttcttttttcattccttcttgtggatttgttttatcaccttatgatattccttatggcttgaaggacttttctttttttttgagtcacagtctcactctgttgcccaggctggag

SEQ ID NO: 167981 - DNA, 489 bp, Homo sapiens
ctgacgtcaacccaatcaaccaaacaacaacagcaacaacaataataacaaaaaacaaaagaaggaaggagtggtcagcagccccagatactacttagatgtcgattgagatgagcttagaagaatgtgcctttagtttgcagcatggaggttgctgatgccatgaaaagcttttttaggaagagctgggacgaattgattggagcaggttaaagaattggagatgaggaagtagacaccacacatacagaaacacatacagagacagctactcagggtcaggcacggagaagacaaatgcttccagggttggagtttggccagttcttcacagtgaagggatggggcaaaagattggagggcatttggaaggaaattcttatagtgacagaactggagtctaagctggtcacggaagaaaatgcaagtccggaggggatttggtgtgaagatggtagtggttctgttgattgggttgacgttagggca

SEQ ID NO: 167982 - DNA, 489 bp, Homo sapiens
  misc_feature (4)..(4): n is a, c, g, or t
cctnacgtcaacccaagtcaacaaaactgttcgtccaagtgcactttccagtacacttaccatgtgacgacttggcgtcctctatatacatgcgtagggatatcaattaaatgtcctttgaagtatagtgcatgagggtgaaggatggaggttgctgatgccatgaaaagcttttttaggaagagctgggacgaattgattggagcaggttaaagaattggagatgaggaagtagacaccacacatacagaaacacatacagagacagctactcagggtcaggcacggagaagacaaatgcttccagggttggagtttggccagttcttcacagtgaagggatggggcaaaagattggagggcatttggaaggaaattcttatagtgacagaactggagtctaagctggtcacggaagaaaatgcaagtccggaggggatttggtgtgaagatggtagtggttctgttgattgggttgacgttagggca

SEQ ID NO: 167983 - DNA, 621 bp, Homo sapiens
tcatcacccaacaccagtaccccagacatatgttcagggaatgagccaatgggccaagggaaaaaaaaagagcatgctaactcttcataaaagtcgaaatcatttctgatggaaggaaaggaagacagagagctgctgaaaaatgggcatgttttttttttcctgcaacagaactgtcctgaatgtcaagccaatgttggcatcatggtagtcaccagagaagagttaatagaactcttcttttataggtaggttaaaaataatttttctgctttagatgtttgtaaaattcctctaggaacagagaggaggaatgagtctttgtgtcagtgggctgtgggcagccagcacccccagtctgccacacatgtggtgccagggatttccatggaaagaacctcaggagacctgattctgggcctgtttcataaggctagcaggctagtgagggccctaggtcataattttaaaatcatactaatatacatccaggtgtgtgtatacattctcagggtagcaggaagaaagtggtggcaagcgaggctggaaaggtggcaggggccagaccccacaagcccctgcagggcatggtatggatttttgcctttgccttaaatcgtc

SEQ ID NO: 167984 - DNA, 432 bp, Homo sapiens
atgatttttaaattcaatacatactgactagaaattttcccaccccagtaaatgataaaaaattaagaacaatgttcatcattggaaattatgcttggggaatcagatggccctttcttttctttctttggcacttgcaacgttgatatttctttggatattgtgaatgacttttgaatccagtcaacttttctttatcaagttttagaaaataatcgtaagcctctactttgcacatgtgtataccttggtagaacagtcaccctgaagatagcgggaatgccacacaagccccttgctggggacataggacgtgcaaatcaatgtcttttcctccagggacagaaaagtggaacgactccaagcaaatcccttgtgtcccaaaagccctgcgtcatctttctggaaaacagctgtgcttataaaagttaa

SEQ ID NO: 167985 - DNA, 356 bp, Homo sapiens
gaggaagtagacccaagagacacgcattggagatcagagagcggccatgcaaaaggaaagacagcaaacgagctgcagcaagctcctaagccctgcagcccaggcacaggaaaccagaggcagagcctcaggcccagggtgaggggcgaagcaccagcctgagcctcttgcagcacagagcagctggaagagagaagtgctggagccaccggaggattatggctgtctactccgagggcagcaacctgcctaggcctgcggtgcaaggcccaagtcctgaccaggtgctttggccaagcccagggagttaggaagtgtaccaggctgctagaggtagctagggctggaaacgcact

SEQ ID NO: 167986 - DNA, 232 bp, Homo sapiens
tgagatcttgagtgctacaggggaaaaggtctgtaagcctgccgcctaccatctcctatggaagtcaggttctccccagatatcgggcatgacgtgacttaaataggatacaggagggagatctccctacgtggaatcctacttacatcatgaaactaatttaattattcccgcttctctctccctccccacctctccaggctcagtctgagttctatctcctccctgaact

SEQ ID NO: 167987 - DNA, 658 bp, Homo sapiens
ggccggaatcctgaagagaggctcaaggcacacagacagggcagggaccacgcccccagtttttgctccagggctgggcaaagaggaagtactcaagggcggaccctgcggctgcccaaccaggatagctgaaggcagagtgaagggaggagcctgggggactgttataggggcgaggagactcggaagggatgttgttttgcttccgcagacacctgacctccaacttcctaggccccagtggacccagagcagcctctggtcagaaaagggcggatgcatccacaggtgtgcataaaagggaaactcaatgattgtcacacagtaggtgtcaggggtaaactgcatttccctacaattgcaaggagtctctttcctctctctctctctcatatgcacacacacacacacacacgcacagagcaacagcatcataggtatgctacagagagccacagagtaattacacacacacacacacacacacacacacacacacacacgtgcacacatacacacacccagacacacacacacacgcagagagcataacacacacagagacacacacacgcagtgcacatatacacacacccagacacacacacacacgcagtgcacaaatacacacacacagacacacacacacattgcacaa

SEQ ID NO: 167988 - DNA, 345 bp, Homo sapiens
tttatgaatcgagttcttcttgtcccacccattcacccactggggtttctgtaaactagcccacttccttttctctttatttttattttattttattttattttttttgagacggagtctcgctctgcactccagcctgggtgacagagtgagaccctgtcttgaaaagaaaagaaaatgaaaagaaataaaaataaacttatgcttttaagcagaagaaacagagaactactactcgtgaactacatgtcagtgtttcaagtatattttcctcttttgctttatctttcaccagcctgggcgacagggcaagactctgtctcaaaaaaaaggggatcctctgaa

SEQ ID NO: 167989 - DNA, 456 bp, Homo sapiens
agataacactatgtgttagtcagatttcaggtcacccatagagcaagacaatttctttctaaagtttagggcagcggttcttacatctcagcaagcatcagaatcatggggaaggcttggcaagctgatgctgtgcttcacctccgaagtctcctttcagcaggtctggtcagagccagagagtgcatttctgacagttctcaggtgaccctttgataagcatggttctggggtcgtgctggctcaggtaggatgcagtcagcactcagtccagggcctggcagtaacctgggggaaagaggaaagtgaggaggggaaggacccacactcccaaatccccggatcccatggtcatcccagcatgcaggctccccacaacaactctagcattgtctcactctttagtaactgtaccactttggtgccctgaagttctcttatacatgctcacccatc

SEQ ID NO: 167990 - DNA, 251 bp, Homo sapiens
aagatgtgagttcttgacttatatctggactgcacatgtgttttatatacaggtgtttctttatgcagtaggtggaaatttgtccattctggttgttagactacttttaagtaatataattcagtaaagctttattatctggaattttcaatcaatttttcctcaaattctaattttaaaaaaattaaccagaactaacccagacacctctgttatgtagctctctgtgaacggtaatgtaaatgtacctg

SEQ ID NO: 167991 - DNA, 345 bp, Homo sapiens
ctgaaccttctcccttgtcctctctcaatctcaagtcccttcttgtgacccacggttccctccctgtccctggaatccatggcaggtagagcgtagacatagatcccttggggtggtgggagtgggaggagtgtcgtatctctcatgccttgaagagcccagatttgcgctgggattaggtttcttcattgaatcagtgctgaaaagggtgatttgtctctgttgcattggttcagtgttgtgattctactgcagtgcctggtgaggctgttatggacttggcctagaatataactgtcatttgtaatttctttaggaaaatgtgttcctcaatccaattggcag

SEQ ID NO: 167992 - DNA, 406 bp, Homo sapiens
ttttttttttcactttcaaagttgttaactatttgtgtttcctcaacattcagataataacccagaatgtcttggtgatactattccagttcctcaaatttcttttaagaatagtatattcttttaccttccccctcattttgataactctttctgcttgaatagtattcttgctcttcccgtataagaattttcagtttaaattaagtctgaattaaagtagatgaattttattatcttcaaaagagcagaactgattatttggatacaaagtgttcaaaatctgttttgtgatgcttttatacttaaatatttaagccaaatgtcagttagtgtaaattagcagtatgttatattaagtattgagcttcaaaactatagctattgttgccgtgtatttaacttt

SEQ ID NO: 167993 - DNA, 499 bp, Homo sapiens
cagagaccaacagcatctcaaaagcaggctctgtcttgtttatctttttattcccagcaccagaacagtctcagaatcaaaatatcagggcatagtttttgagtgacttttcaagaactagatttaatcctggcttggtttttttgttcatcctttaatcaatgctaatcaaatacccaggaccactcagcaggtatttattaagcatttgctctgtgccagacgctaaactaatcgtatctggttcagtggtgaagatagatgggagccttgctcttgagtgcagttacagtacagtactcattctatgatggggcacacaggagggatatgtgagccaaagcaggttggtgggtgggacaggacaagtttcccagaggaagtaaaacctagctaaaatcccaggtatgattaggagctagccacttgagagaagagggaagtgactaaattttcataccacttcacatatatttttcaagaaaatactcgaaagtgc

SEQ ID NO: 167994 - DNA, 357 bp, Homo sapiens
catcacagtaactaatgggctgagaatgtttctattttttcaccaagtaatccatatgcaaatttcctacagtattcaatatgcacttccaagctcagtaaatgttttctattcttttctgcttagctctctcagctttttccaattaggccctgtttatttagaaaaaaagaaaatgtctaaaggaaggattaagctctgtatcttatggagaaagaatgaatattagaaattctttcaggatctagaggatgcattctttactcatcctccccgctgggatgggtaatgagaataaagtaaaagaggatgaagctttttacttcatttggtttgttcagctgaaaacatgccttt

SEQ ID NO: 167995 - DNA, 497 bp, Homo sapiens
ctcccctctttattccccgtctcctgaagctgtgtcatgtgtttttattaatggcaccatagaaaattcttcccttattatggcctaaagatgaattaacataatagcaagcaggtgtatacaaacttgacaattatgcaaatatagtaaatggccctgtaggtactgtacttcttcagaaagatttgagatggacattaagtcttccttgttaatcctgtatttaatgacctctaaatagcatctattgagaccttccattcctttcaacaagttagaaaaacgttccgatttatccctgttcctttttcccatcctctggcaccagctactgtctttatattagaatttgacttcctttcctttcacattgtggctaaagaaataattgttatcatgttttactagtgacttcgtagatgtctaacaatacatcactttatcagaaggagaggagaggaattccctgagctctgtgcaggagctatgttcagttg

SEQ ID NO: 167996 - DNA, 433 bp, Homo sapiens
acatgaaaccaaaccaggtgctcatcaatggtggattagattgtgtacatatataccaccatatggtacatatacactgtggaatactatgctgccataaaaaagaatgtaatcatgtattttgcagcaatatggatgtagctagaggccattattctaaacaaactaacacagaaacagaaaccaaataatgcatgttctgacttaaaagtgggagctaaacactgaatacacatgggcataaagatgggaacaatagacagtgggggctattagagaggcaagggctgaaaaactacctattcggtgccctgctcactatctgggtgacagagtcattagcactccaaagctcagcatcacacagtatacctttgtaacaaacctgcacatgtaccccctgattctaaaataaaagtcgaaggaaaacaac

SEQ ID NO: 167997 - DNA, 656 bp, Homo sapiens
gctggcaactgggaatctttggtgttatttctgcgagcaatgtgaattcattgggttgaacaaatggctagccctttttgcattttcagttttccattccatttattctttattgtgtccttgtatctttctggcccctaaaactcgctcactcactccttttctttctctctgtactgtaagccacttacaaagttgattacatacggcgactaggaacccaccgctctttccccacacctttccctttgcttgccttttttctttttttgaaaaccctcccctctctaagagcctatgtaaaccctgcctgttcttcaacttcctccctagatcctgctctcggcacagcttgcttcttcctctgaaatccagtggtatttcttgtcgggatttctcacctggccccatacgctactgcagtacattgctagttatctctttcctacttaggcgagtgatttacctagctattctgaaaggtgcagcaaagactgtctcctatccttttgtgtttctttctcgttatcagcacaccaactggcttctaactcattaaagattgcgtgattggaatgtaaaacagtcgcgtgaacaacagccatgaccattgttttttttttttttttttttggagacggagtctcgctcgtcgc

SEQ ID NO: 167998 - DNA, 524 bp, Homo sapiens
ataagcctcctaatcaattacaaaagagtcatttttcactttcctttaaaattaaaaagaagtttctctttgtccatatttcaggcctctcatacattgtttgctgacagcgtttctgtgttggaaccacatctcttgttcttccagtagataccctcagggcatagtttctgcacaaaatttatctgaaatctttagtgaccttttgcaggatttaatatcagttcatttggatagttccacatgcataaatgggccttaacaggaatttagcaaataaaagatagtgcctcccatacaccttcttattttttaggcttgctaagtaaaatttaagcagaagagactgtctctgtctttctcttgggctccgtttctgcgttttttgtggaacactaccattcttaggtagagtgggtagggagagagaaggaacagcatcacctcttctctatttttgctcacacagatgccctgtttggcgacatctaagcactagagacttattgaaccggatagcttgt

SEQ ID NO: 167999 - DNA, 561 bp, Homo sapiens
atctcacacgtcagcaaggggtgagattcatgattccttacataataacaggtctgctccagggtgacttccctctccacccatgaacctgaacttgcgagcataattttcacttcacctgacacccacatatacaggcccaggtgtctatgtctctctttctgtttgaatattggaatgagtctctatgaatgtgttactgtgtatgtgtgtctctacttgtgacctttgggcaactgactgtattcttaacctgactgtgcctcagtttcctcatctgtacaattaacatctactttatagggttattaaaaggattacatgagtcaggcatggtggcacatgcctgtagtcccagcctcttaggaggctgaggcaggaggatcacttgagcccaggagtttgagtccagcctgggcaatacagcaagatcctgtctctgaaaaaaaaaaatggattatgtgtaaagtgcctaaaatggtgcttgggtcattgtatatgctcactaagtacttgatgctactgttataattgttaatgtgtcttctgacgtgtcgaggt

SEQ ID NO: 168000 - DNA, 335 bp, Homo sapiens
ctggctttatcccagagctcaggccacatgtttatgttctgtcttccaactccctgcaaaacagcccttctttagccatcttggggccttgggatatgcacaccagtgatagatctgggaaagaggccttgggagtggccttggggctgttccagcagggaattccaagtgccaggtaggaggtaggccagagcggggcctctaaagcacaaccccagagcaaggaccctgttacctaggtcttcaagtggtagcagcctaaagagcaggtgtttactggtgttcatacagcactggcaaatagggagagacacagactgacagaggaattctgc

SEQ ID NO: 168001 - DNA, 420 bp, Homo sapiens
gctgggctgccgtgcgtctgggatggggctgagggagggtgctgcccaggtgctggaggatgttccagcaccaggttccagcggagcctcggaaacaggccccagaggctggtgagcctcgctgggtgtgggcactaatcccgtgcatggtgactcgtgggcgctcacggcccacctggtggcaggtgaaggcttccggttgggcagcagatagtcctgggggaagctggcagtcctggcaccatgacgtatctgggctggtgtcatgcacagtagggcgaatggccacagctgcctgccagcagccctgatcccggggtgtctgcacccttccagcccaacctctgggtctccaaaagcacagtcgggggagcatccaccaggcacaacctctgcggtcctcagaggactgagcagaga

SEQ ID NO: 168002 - DNA, 527 bp, Homo sapiens
atccatttctgtcttattccaaagggtacccctttcaatcacatctgtatttttctgcaaatgtccatttggaacattggactgtggtttgatgggttttttcccttatggtcagtattctgtgttggcttacggagcccctcacccctggtaatttcttctcattaaacctatggagattatattttctattgataaacctatttgtgaaaaatagttgcttaaaaccagattatacctccacttgtaataatgggaaatcttaataaccagcagtagtatctgaaaccagttaggcctcaatgcagatttttgttttaattcctctttttagtgtcctcagactttctggcatacttaatagctgaaaggctgttggtggatttcagtggctactgtttgttaatttttattgcttagtgttaaaatattaagaagtttttgtaaagatatactttagaaagtaacaaagacagacttttgaatttcagaaagatttggaaggaagtgaagttttgtttgagctt

SEQ ID NO: 168003 - DNA, 549 bp, Homo sapiens
caatagctaccctttcctgaatgtttacatgatgctacagaacaggttatttctatggacaggctcttgacagaaactctgaacatggatattactgtccccttcattcaaatgaggctgaactgaggctcataagtatttaactctcacacctagttaacacagtaagatttgaaaccagatatatatgaatccacgaagtcttatctgttaagtatcattcccctctcaacaagaaaaaaacaaaacacagaacaaaaccaaaccaagcaggccgggcgcggtggctcatgcctgtaatcccagcactttgggaggccgaggcgggcggatcacgaggtcaggagatcgagagcatcctggaccacacggtgaaaccccatctctattaaaaatacaaaaattagctggctgtggtggcacacacctgcagtctaagctactcgggagactgaggcagaaggatcgcttgaacctgggaggcaaaggatgtagtgagccaagatcacgccactgcactccagcctagagacagagcgagacttggtc

SEQ ID NO: 168004 - DNA, 153 bp, Homo sapiens
cctgccaagctctatgacaacctgggttatcttccggaacaggatggctctggatttgagatgagatcagagaggtggactgctaaagagaaagagagtttgggaagtcaatgcaaaagtataattgtgggcaaaatatgctgtgttctcaag

SEQ ID NO: 168005 - DNA, 468 bp, Homo sapiens
ggactggtttctgtcttgtctcacaggaaagggcaccaggttggggacctctgaggacaaatgggatggtgaaactagcacgtactgactcctcattgccctctccctgctcttctcgggagggaaggagttggagcatgagtccagcattctaggttttctggagtctgcccaagactctcgttcctgtctcactcgatgaagcactgatgggacctggcatggtctaggtccctgggggctgctgagaacaagagaaagctgggtggtttgtactgcgccagaggacccacggtacagtaggcagagtccagtgcacctcgaaggctgctttttgggtccaggggaagagtagagcatgtgttcagcatttgggcttctcaaggggctgcctgagggactggcttctgtctcacccaactcactgctggcagaacccaacctactctagatgccttggagctgctg

SEQ ID NO: 168006 - DNA, 241 bp, Homo sapiens
ttttgagttgtaagagaatacaacaatttaacgaaattaataaattcattagctgagtgagaaattgaacaaagatagatattatggaaaggaacaaaacaggaatcttggagcttgaggaattaagtgaatgaaattaaaaaaaatacaattgagagccacagtaacagactagaacatgcagaataatacatttctgaacttgaagacagatcgtttgaaataacccattcagaagaag

SEQ ID NO: 168007 - DNA, 397 bp, Homo sapiens
actgcaacctctgcctccaggactcaagagattctcccgcctcagcttcccgagtagctgtgaacacaagcacctgccaccatgcccggctaatttttgtatttttagtacagacagggtttcattaaattggccaggctggtctcaaactcctggcctcaggtgatgcacctgtcttggcctcccaaagtgctgagattacaggtgtgagccaccatgcccggccatgactggcgtaaaatggtgatctcacagtgtatttcactgtagtgttaatttgcatttctctgatgattagtgatattgaatattttttcttatgatttttggtcatgtgtatgccttcttcatgtctttgccgtcgacccggccgcgaatttagtagtagtagtcgacc

SEQ ID NO: 168008 - DNA, 435 bp, Homo sapiens
gcagcaacccaactgtgaagggaaccagccaggtctaccagcagatccttacctattctaccagtccttggtgaaatgagagaagcttacatttagaagctcttggtattaaaatatcccttcttttctgaattgataatagaatttggctttgctaataatgtcctgatgtgccaaatcaacaattgacaagtctgtgtggtttgcccaatactccatgggctcatgaactccaaaaacctgggaagcaccacagtagacaatggcctggggcctcacaagagcaggaacctctgtgatcctggtttatgagcatagacctgtcctcactctgtgtacccctgagctgcctgaataaaccacatgacatagattatcagctcttttcatttttttttttttttttttgagacggagtctcactctgtcgcccat

SEQ ID NO: 168009 - DNA, 237 bp, Homo sapiens
gataattgattacttaaaatccttatatatcttgctcttttttagatagattaatattgtctaaaagctcgcaattttcacgatttattacaatttgttttttaatggcactgcctctggcctagttattcaactcccagtctctatatcttaaggggtcttcttaccaagggttgcttgatgaggaaaatcacacaagcctgtttaccctcctaaatctctgatacctctctcatt

SEQ ID NO: 168010 - DNA, 460 bp, Homo sapiens
ctccattaataatgggattagaaagacacaggtgagttagtgctgaagatgcagagaatgaaggcagttcaacataataaagaccatatatgaaaagcctccatctaacatcacactcagtggtaacagactataatccctccctccctcagaccaagaacaagacaagtgtgccactttctctacttctgctcagcacagtcctggaaatcccagccagagcaactaagcatgaaaaagaaaggaaaccacactggaaaggataaagtaaaattatctctgttcacagacatgattttataagtagaaaatcctaaagatacacacacacacacaaaaccccaactaggattaataaataaattcagcaaaattataggatatggccaggcgcggttgctgaagcctgtaatcccagcactttgggaggccgaggcaggcggatcacctaaggtcagga

SEQ ID NO: 168011 - DNA, 498 bp, Homo sapiens
agatactagagttaaaacagaaagcaagaagtagggggctctgcatgttaagtaggttcagcaaccgtaattagtgattttctagggttgaacaggacacttcctgctttcatgggaaaatcagtttgctgctgaccaacccgtacttctagagcactgagtaaccagcctctaattcggttgtaatgaaccgtgtattaatgttgcagccttctgcccgctctggagacctcacgccatgcctggccttgcagtgagtcttgcgcttgtcagttatgggggcaggactttcttgcaaagctgcttttgttttcccactaaaaatgtgcttatttctaccttaaatagagatgaatcccacaacttgcccaagataaatatgggagacgaaaatctcatttatatttaaggtcatgtgtagttttctatttctcgctctctcacacacatacacacacagagagacacacacttacatcttaaatgtctgcaaaaaaa

SEQ ID NO: 168012 - DNA, 206 bp, Homo sapiens
tatgtagatgtggaattgctgtgtcaaaggatagttgaatgtttaactatataagaaactgtcaaaaattttctaaagtggttgtgctattttatcctcccaacaagaatgaattagttctccagttacatccttgccaagagttgatggtgttatcagtcttttctcccagtctgagttttaccttttcagtttcttaatggtgg

SEQ ID NO: 168013 - DNA, 307 bp, Homo sapiens
aagtaccttatatataaacatcaatcaatagcatactgaattgatgaattaacaatttaaatggggtaaaattaaatacttcactattttagtagacaatttccatgtgtgttacactgtgctaggcactggagatttggggaggaaggatatgatgatgtgcaagacaaaggcatgcttacaagagttccacactctacaaagggaggaaaaaaatgtccctaaaaatgatttgaatcccatccccatcattcatattttgcaatcttgagcgagtttacttagcttctcttgtgtcctcattttt

SEQ ID NO: 168014 - DNA, 463 bp, Homo sapiens
tgcaggctgccccaggacagggcatgcaggcagacacagggctcaatggggtggggagcagattctagctcagtcagccagaatgttctctaagcagagctgttgagatgaaaatcttcgacttttgtgagcaccacgaggtgctttatgtatgttatggtgcattctcccgtgagtgagacgtggttgtcctattccacagatgaagaagggaagtcacttgcttcatggccagggaagggctccagcaagacatgggctcctgaaagtgacagtgtgtgaaggcccggagaggcacaggacctgctggaggatgccaaagtaaacttggtggccacatgtcaaagacggagatgcacaaaatgggaggaacctagatccctgaatgactttgtggagctgagcccctaggccaccctgcattggatgtgaaatgagtgagaaataaacctttggagtttca

SEQ ID NO: 168015 - DNA, 435 bp, Homo sapiens
tacgtggttccggacaggacttctccactcggcactagtgccatttgtagtggtgcgttctctgcatggtagatgttggcagcacccctgcccctagttgtgatactcaaaactttcttcagacagtgctgagagcccctggcaggcaaagttgcttccctctgtggtcgctggcttaagagagtaaagaagcctgcaccttcatgttcctgcccatggcaccttctctaggatcctggaaaccaaataggatttcagaaatggtttttctcccatttgggcttcgagcgcattgccatgtccctgaccattccaaaatgtaggtcaggtcttctgtgttaaatgcacagacacctggtggatactgtcaaggttttggtttttgtttttgttttttgttttttgtttttgtttggagacagagtgcctactccg

SEQ ID NO: 168016 - DNA, 614 bp, Homo sapiens
tcagtgctggcgcctttatcttgaccttcacagcctctagaactgtgagcaataaatttgttgtttatattacccagtctaaggtatttcatcacagcagcctgaactaagacaaataggtatacaatcttatattctgccttgttcatatatattccatatatttttctcgtttccagatagtcttgattatttcaaagggctgcataattagctgtactgacacagtataatttaccaagccctacactctggtaaaccatttaaacctttctaatattttgcattaaaaacatcacagtcaataactttgtatataaaaagcttttggcttatgttaaactacactctagtatatactgctgaatgaatgaatggacttccctgaagcattgcaactgtctcaatagtccaaacattttcacaggtcttgcaaagaaggacagactgcttctaaacggccttacaatttacaaggtaatcagaaatgcattcgctactatctggccaagaaaggtgttaatgagtttttgccaacttaaaaaaaaaacgaagaatgaggaaaaaaaccacacagacaacagtgtagtcagccttaaaatcagaggaaagtg

SEQ ID NO: 168017 - DNA, 424 bp, Homo sapiens
agatttccttcattgactgaaaaaaaaaagagtcataaagaaaaaaaaaactcctttttgcagccgcagccaccatttctccacatcctgtcctctccatctccttttctcacatatagtgacagtgtctgaagccgtggcagccactctgtggctatgtaacaacaaacccaaggacaacagggccaacacactgaaaactgtggaaagatgataatctcttgggaccttgatgatacctttaaattgtagaatcttcctatagttcttgttatgttagaaatatttcttttatttgagctgaaaccatttggattagttaattatagctgctataaaaaatgaactctaaaacagaaataacttaatacataaaaatctcatctctctcttacaacagctaaaacaggggttttcagttggg

SEQ ID NO: 168018 - DNA, 562 bp, Homo sapiens
actcaccccagaacggacaaggcgagggactatgatgggaacatacatgcccctccctccctgtcacttcgggctttctgccagattgacacaggggcagccaccgctctgagagacacgtggcttcgggcacccagctaggcaagcccagctcagtcggtgtccggaaaggccgcgttctcccgcgccaggggccggcaatggtgcggagaggggagaaagaagcaaggcgcctcctccgacagggactgaaagtctgagggcgggatgtcactcaaggcctaggggcagggggcgctcgtacgttcgggcctcaggactccctgccgccgccgatgctgctgccccatctcagcacaaacagcctcagaccgccctggtgcgggggcgcctctcgcagtcgaggcctccacctcccggccccgcccccgcgcggggaggagacgcctcccacctgcgagcgccggggaagaccgaccccggagcggggacccccagcacacacgcgcgtacacacatgcacacacagagaccactgccggtccgctcgcccggcggccgc

SEQ ID NO: 168019 - DNA, 373 bp, Homo sapiens
atcaacgagcacagaaaccctggattccacttttctttcaaataagagagacttccaatagtaaagataaaggaagagaacacctgggaatattaatataatttgaagtggagcttttctgggcaagagatcttgtgctggtgctttaggcaatttgatgagtcctcttctagggtctctggaagctttcttgtaggtggccatggtctgatatgcacaccaggagcagagctttgagcttctgacgttggagcaattgctgaccatcctgacaagggaactgcagagctggttttgagaactacttccagagaacagggagaaggtggttggtccattggtggaatgagagagaatttgatgagctgagaca

SEQ ID NO: 168020 - DNA, 501 bp, Homo sapiens
cctggcaccatcatacccaccgctccttagccctcagttcacactcactgccacggcctccgctcggtctcgtcactggtgagcccgccccacacctgtgtgcctcactcccaaggcgccttcttcaaatgctgcctcagctcaaacacaatcaggtcacaaggcttttctaaaaagcacttttcagaaacagtgacaccaaggcgccaaaggctgctcaggtgccttagcggccagttctgcggcatgtgtctggggctgacaggagggaccagcgacagccagctctgaggagcagagaccagacgatgaggccctgtctcagctctggaccttgttctctcagctcaaacacttacaatggtttctccactgcctaaaagatactggctgctcacagttctcggtttgaaatgtgacaccccacgatctgctttcttcctgcccctctaaccacagctctttcaactctactaaaacttcaaccaaactttcctacgt

SEQ ID NO: 168021 - DNA, 243 bp, Homo sapiens
ggaagggagacaggtagcttgtgggcctctcacttgccatcattgggacattttatttactcagcagatatgtccccaacccttgctctgtgccaggcactggctgaggtcctgggattcaaaggagagtgagcacagtcatggtttcctgcaggagctgagaaatggggtgggtgcagcaccgcattcaggtttggggaacctcagtcccctcatccacaatgggcccagtgatacccctcc

SEQ ID NO: 168022 - DNA, 448 bp, Homo sapiens
tctactaaaaatacaaaaattagccacgcatgatggcggacacctgtaatcccagctactcgagaggttgaggtgggagaatcacttgaaccagggaagtggaggttgcagtgagctgagattgcaccattgcactccagcctgggcgacacagggagactccatctcaaaaaaataaaaataaaataaaataaatggaggtaaagttgctggatgaaatcaacatgaaaactgtatttatatatatgagcaacaaagtaaaatgaaatcttaggccgtgtgtggtggctcacgcctgtaatcccagcactttgggaggccgaggagtgtggatcacctgaggtcagtagttcgagaccagcctggccaacctggtgaaacccgtctctactaaaaatacaaaaattagccaggcgtggtggcaggcacctgtaatcccagctactcg

SEQ ID NO: 168023 - DNA, 379 bp, Homo sapiens
cactttttcttgtaatactaaatatttgtgctcactaatcaatatttaaaaatcaaatttctagagtaatctaatatttaaaaaattcaggcctggtgcagtggctcatgcctgcaatcccagcactttgggaggctgaagagggtagatcacctgaggtcaggagttctagaccagcctgaccaacatagtgaaactccatctctactaaaaacacaaaaaattagctgggcatggtggcaggtgcctgtaaccccagctactcgggaggctgaggcaggagaatctcttgtacccaggaggtggaggttgcactgagccgagaatgcaccgttgcactccagcctgggtgacagagtgagactccatctcaaaaaaa

SEQ ID NO: 168024 - DNA, 135 bp, Homo sapiens
gggagttatgaacctagtttggaggagaacttgaggcatttggggcaagctccaaacagatgtgcttcttgcttcatttttgcatgtgaccaagtcgcaagaggcgcattccttgcatgaatttctttgaaggcc

SEQ ID NO: 168025 - DNA, 446 bp, Homo sapiens
tgaagagtacacagcagcagagtggggtggtcaggtccatgtcttaggattggtccatgtctcaggattggtggggcaggaaatccgagctcactgacagtcacagctgagatctaagtggtgcttctcctggccggtatgtggattcactcatttaattcttaacaaccttatgacttaggtactagttttattttcatgtctgttttgcagatgaggaagctgaggcaggttaagtgacttgtccagggccacacggctggttagtggattctaacccagtgtgactccagagttaaaattcctaaccactgtgtcatactcaggccagaccagcaaggggacggtttggagggttaggggcagggctgatggtggtctgagtgaggagagttgtagtggagacggaaggcgtgcatgggattctacagctctttaggagccag

SEQ ID NO: 168026 - DNA, 2660 bp, Homo sapiens
acattgtagaagagaaactactttctgaagaaacagagtgtctgctacgagctcaattttcagattttaagtgggagttatataattggagagaaacagatgagtactccgcagaaatgaaacaatttgcatgtacactctacttgtgcagtagcaaagtctatgattatgtaagaaagattcttaagctgcctcattcttccatcctcagaacgagcggccagtgaggcaggaggaaaaccaggagattgtgatggcctggaagccaagtgtagaaagtatttcaaggagggagtagtccactatgtcaaatgctgctgggagatcaggtggttatccaaatgccaacccagtccaggtttcaacagcaacattttttcttttcttcaacgaagagtagagaatggagatcagctctatcaatactgttcattgttaataaaaagtatacctctcaagcaacagcttcagtgggatcctagcagtcacagttttcaggggtttatggactttggtcttggaaaacttgatgctgatgaaacgccacttgcttcagaaactgttttgttaatggcagtgggtatttttggccattggagaacacctcttggttatttttttgtaaacagagcatctggatatttgcaggctcagctgcttcgtctgactattggtaaactgagtgacataggaatcacagttctggctgttacatctgatgccacagcacatagtgttcagatggcaaaagcattggggatacatattgatggagacgacatgaaatgtacatttcagcatccttcatcttctagtcaacagattgcatacttctttgactcttgccacttgctaagattaataagaaatgcatttcagaattttcaaagcattcagtttattaatggtatagcacattggcagcacctcgtggagttagtagcactggaggaacaggaattatcaaatatggaaagaataccaagtacacttgcaaatttgaaaaatcatgtactgaaagtgaatagtgccacccaactctttagtgagagtgtagccagtgcattaggatatttgttatccttagacctgccaccttttcaaaactgtattggtaccatccattttttacgtttaattaacaatctgtttgacatctttaatagtaggaactgttatggaaagggacttaaagggcctctgttgcctgaaacttacagtaaaataaaccacgtgttaattgaagccaagactatttttgttacattatctgacactagcaataatcaaataattaaaggtaagcaaaaactaggattcctgggatttttgctcaatgctgagagcttaaaatggctctaccaaaattatgttttcccaaaggtcatgccttttccttatcttctgacttacaaattcagtcatgatcatctggaattatttctaaagatgcttaggcaggtattagtaacaagttctagccctacctgcatggcattccagaaagcttactataatttggagaccagatacaaatttcaagatgaagtttttctaagcaaagtaagcatctttgacatttcaattgctcgaaggaaagacttggcgctttggacagttcaacgtcagtatggtgtcagcgttacaaagactgtctttcacgaagagggtatttgtcaagactggtctcattgttcactaagtgaggcattactagacctgtcagatcataggcgaaatctcatctgttatgctggttatgttgcaaacaagttatcagctcttttaacttgtgaggactgcatcactgcactgtatgcatcggatctcaaagcctctaaaattgggtcactattatttgttaaaaagaagaatggtttgcattttccttcagaaagtctgtgtcgggtcataaatatttgtgagcgagttgtaagaacccattcaagaatggcaatttttgaactagtttctaaacaaagggaattgtatcttcaacagaaaatattatgtgagctttctgggcatattgatctttttgtagatgtgaataagcatctctttgatggagaagtgtgtgccatcaatcactttgtcaagttgctaaaggatataataatctgtttcttaaatatcagagctaaaaatgttgcacagaatcctttaaaacatcattcagagagaactgatatgaaaactttatcaaggaaacactggtcatctgtacaggattataaatgttcaagttttgctaataccagtagtaaattcaggcatttgctaagtaacgatggatatccattcaaatgagagacctaaaatatattaacattttaattaagaatacttgatcaacattttttgaagttcaatttaccatattttataaattgcgcattctgcacagtggacaagtttgcaattctgacttattaaaatttcaaattctgcatatcacaaaatctccttatacttttggtatggcttgcagcatttatgagttttccaaaatatagaaagcagtaggtcagtaggagcaaactagccaacaggtactgtctttgaatttactactgtaagactaagcagtgttactggacacagttttaacttgttcaatctgcttcaaaaacaagaaaaacaacaactatgagttatca

SEQ ID NO: 168027 - DNA, 2294 bp, Homo sapiens
acattgtagaagagaaactactttctgaagaaacagagtgtctgctacgagctcaattttcagattttaagtgggagttatataattggagagaaacagatgagtactccgcagaaatgaaacaatttgcatgtacactctacttgtgcagtagcaaagtctatgattatgtaagaaagattcttaagctgcctcattcttccatcctcagaacgtggttatccaaatgccaacccagtccaggtttcaacagcaacattttttcttttcttcaacgaagagtagagaatggagatcagctctatcaatactgttcattgttaataaaaagtatacctctcaagcaacagcttcagtgggatcctagcagtcacagttttcaggggtttatggactttggtcttggaaaacttgatgctgatgaaacgccacttgcttcagaaactgttttgttaatggcagtgggtatttttggccattggagaacacctcttggttatttttttgtaaacagagcatctggatatttgcaggctcagctgcttcgtctgactattggtaaactgagtgacataggaatcacagttctggctgttacatctgatgccacagcacatagtgttcagatggcaaaagcattggggatacatattgatggagacgacatgaaatgtacatttcagcatccttcatcttctagtcaacagattgcatacttctttgactcttgccacttgctaagattaataagaaatgcatttcagaattttcaaagcattcagtttattaatggtatagcacattggcagcacctcgtggagttagtagcactggaggaacaggaattatcaaatatggaaagaataccaagtacacttgcaaatttgaaaaatcatgtactgaaagtgaatagtgccacccaactctttagtgagagtgtagccagtgcattaggatatttgttatccttagacctgccaccttttcaaaactgtattggtaccatccattttttacgtttaattaacaatctgtttgacatctttaatagtaggaactgttatggaaagggacttaaagggcctctgttgcctgaaacttacagtaaaataaaccacgtgttaattgaagccaagactatttttgttacattatctgacactagcaataatcaaataattaaaggtaagcaaaaactaggattcctgggatttttgctcaatgctgagagcttaaaatggctctaccaaaattatgttttcccaaaggtcatgccttttccttatcttctgacttacaaattcagtcatgatcatctggaattatttctaaagatgcttaggcaggtattagtaacaagttctagccctacctgcatggcattccagaaagcttactataatttggagaccagatacaaatttcaagatgaagtttttctaagcaaagtaagcatctttgacatttcaattgctcgaaggaaagacttggcgctttggacagttcaacgtcagtatggtgtcagcgttacaaagactgtctttcacgaagagggtatttgtcaagactggtctcattgttcactaagtgaggcattactagacctgtcagatcataggcgaaatctcatctgttatgctggttatgttgcaaacaagttatcagctcttttaacttgtgaggactgcatcactgcactgtatgcatcggatctcaaagcctctaaaattgggtcactattatttgttaaaaagaagaatggtttgcattttccttcagaaagtctgtgtcgggtcataaatatttgtgagcgagttgtaagaacccattcaagaatggcaatttttgaactagtttctaaacaaagggaattgtatcttcaacagaaaatattatgtgagctttctgggcatattgatctttttgtagatgtgaataagcatctctttgatggagaagtgtgtgccatcaatcactttgtcaagttgctaaaggatataataatctgtttcttaaatatcagagctaaaaatgttgcacagaatcctttaaaacatcattcagagagaactgatatgaaaactttatcaaggaaacactggtcatctgtacaggattataaatgttcaagttttgctaataccagtagtaaattcaggcatttgctaagtaacgatggatatccattcaaatgagagacctaaaatatattaacattttaattaagaatacttgatcaacattttttgaagttcaatttaccatattttataaattgcgcattctgcacagtg

SEQ ID NO: 168028 - DNA, 521 bp, Homo sapiens
taaagtgctgggatgacagatgtgagccactatgcacagcctccccagttgttttcaatccattcttttgcctacttgtaccttctttcccttccacccatccacatttttcgtgttcccttcctttcttcttctcaccatctattttcctttctgtttctcctccttcccctcttcttttccccactccacattttatgcctaattccttccagaggagcacagacctcattagttgagatttctttaaccccaacccacatgatttttagtttgaattcctaaaacttggctatagattataaatggctctgtgtttgtagacatctttgttggcctaacgagaaaatttgcctctaagatcatttatcagagatctctgtcccatgtgtaaacctatctagttgccagttacacaatgtctaaagtgtttaccttaaggggaatttttgtcaccttaaaaattttctatatttggtacctctgtatcttgaactttaattaaaagtgtatcttcataa

SEQ ID NO: 168029 - DNA, 508 bp, Homo sapiens
aattaagcatcacatccagattcagatatggcatggattttggaattatcagacagaatttcacttgatctaagccaaaaggccaagaagtgatatcagacagaatttaaaataactctcattaatatgttaagaactataatggataaaatagagaacacatgagtactgtaaatagagacagctaaaaatactaagaacaaatcaaaagaaaatgttagaaaattttaaaaaaggcactgtaatagtcatacttttggtgggattatcagtaaactgtacgtggccaaagaaagaataagtgagcttgaagatatgtcagtagacagtttagcttagaaagcacaaaccaggataaaaccccccaattttacacctaagtatatctattaaactgcagaaaactaaagaaaaaaggaaaatcttaaaagcagccaggtgtgcaccttaactatagaagaagaaagataagaattatatcagacttcttttcagaaatcatgcaaga

SEQ ID NO: 168030 - DNA, 215 bp, Homo sapiens
caggcagtgtggtgggcgatggatggatgctgcctcccttgggcggatggtttcttctcccagccccttttttgagtcctgcaagaggaagaaaaagccagcagcaatatgcttggatagctttaactttggatctgtgttcagtgaaaatgctgagtcactttgaatgacctgttcccttatcaattttctcctttggcttttgtgccttgtaa

SEQ ID NO: 168031 - DNA, 462 bp, Homo sapiens
cacatagcagaatgaccattaaaagaggcgggaatgaggtaacatgactgttgatggtactcatctaaatgttttaatatattttgaagttttaaaacttaagccatttgcagttttagtttaaaattcttggtttcttcatagcagcaagttaagaattgtggatgcttcgatattcaactatttacactgtttagagaagaagctgtgctaggagaaaggggagaaaggaagaccactggaggcagccactcctctgttctgggtatttcacctctgctctgaaacttgcaggctgcattgagcaaaagaaaaacaatgtgctttgtgacagcatgcgtgaatgtagaggactttatgctaagtgaaataagccaggcagaagaagacaaatactgcattatctcacttgtatgtgaaatctaaagagttcagttcatagaagcagagagtagaatggtg

SEQ ID NO: 168032 - DNA, 323 bp, Homo sapiens
gccaaagaactggaggaaggacatcgatcacacagtttcagagctgaaagggcattaacacaaggcagttacttctgtgatttatagagatgagaaaggagcaaggatttagaggactagccaaaacacactcagataaaccagctggcaagtgtggatttgaattctgaatactgaatagaagcagctaaagaaacaacatctccctgtgaaacccaacccgatcaaggcaggtgacatctctccactcaacccttagtttaatcaattcctcagttagaactggcttgtcttcttatctcctcttttcatgctcaaaacca

SEQ ID NO: 168033 - DNA, 310 bp, Homo sapiens
gaggcgcccatcgggtgatgcacttggcccacacgcgtgtgctggggaggccgtggggacacagaagtgtgcttcggtgcaggacaggctgggctgagcagctccaggaagtaggcggtggtgaaaccctaaaacatggacctactcacacaagggcttggtgaggggacccccagagctcacagcacaagtgggaatcgtgcaaactaggcttcatggtggaaataccaggagacttttaaaagttcgtagaaaatgcatattttgaaaaaaactgcatgggtttcaaaatgtttctgcaccaaaataa

SEQ ID NO: 168034 - DNA, 497 bp, Homo sapiens
tctaccctactggcagggctatggggaaacaggcactttcatatgctgctgatgggaatgcaaaatggcacaaggcctctgggggaaaatttggcaatatctagcaaaattacatttgcattcagcatttggcccagctgtaccactttttagggatctacctaaatctacactggaaaaaaatgaaaagacacatggacaagactatttgttacagtaaaagattgggaacagccctaatggccatcagtaggagactggtttaataaaccaggacacatccacacaatcgagcgctatgcagctataaaaaggaatgaggaatttatgtagtgctttgaagtgatatctgggatatagtcttcagtgaaagtcaagggacagaacagtaggtatagtatgctgccttttatcttaaaaatgaaaagcatctaaatatatagatacagatatggatatagagatttctgtgtatgtgtgcatatgtttgcttattt

SEQ ID NO: 168035 - DNA, 107 bp, Homo sapiens
aattcctaccctccatttgtctgtcttccctgagctggccaaagtaggcaagatgtagtccacacaggagtcagaaggcaggagggtatcttgggcatgggaggcag

SEQ ID NO: 168036 - DNA, 195 bp, Homo sapiens
tgaaagaaagtgtcaaattagagtcaggacatttgattgctgtttcaccttagtatctccaacctaacatagagaacaatctctgcctagactggtgcatacagtggttatggaaatgaaatgagaaatgagaaagcttcaaaaaccaaatttcaaaataaaagagtatttctcagattaattgttctcaaactg

SEQ ID NO: 168037 - DNA, 352 bp, Homo sapiens
gcctatccctgctggagttcaaatgagtatctgcaactcagagctttccctcaaacaccagacctctctatccatctgcctgctaaatacttctgcttgtaaatgttacaagcactttaagtttagtgcaccacacaccacacccatctctccctggccatcccagcccctgacctcactgcttctgagtgcccctccagtcagtgaatggcacccccaccccctctgacccttccatgaggcacaccagggctggttccttctaattgctaggcataactccaacctatttagtcctcaccttcctcattaacagagtcaaatctgggccccaatcataaaagtctgaccg

SEQ ID NO: 168038 - DNA, 359 bp, Homo sapiens
aagatgttgtaagactatacataggattattccaccaactctttaaatgttcgtggaaaaagtgtgggtaaaaatatacttatttatttgttcatggttaatggatagggttatgggcgactttattttatttctgtaatttatacatttttacaatgtaaatactactttgtttttcttatcattaattgcattgttcaataatatgtaattactgtggaaaaggtagataatacgtaaaaagaagatacatacacacatagttcttttgttatttatgtttgttagtttgagacagagtctcactctgtcgcccaggatggagtgcaattgcgtgatctcagttcactgcaacctcc

SEQ ID NO: 168039 - DNA, 504 bp, Homo sapiens
aagatggtcaaggtaagcagttccttagtctcctattgtgacaaatggtcggggggatggggagcctaaatgttaaaaacaaaaaacccacctcttaaaaacaataaattctactctaagaatgtttcatactactttggaatcagttagcaccccaacacaacttgagccaaacttactctttcttaaagtcctaaaaggagtcatctagcaccaacttgctttcctacactgcaaaaaagaaattttaccttaaccaaagcctacgtttaaaaagagtaagaaaacagttttctaaagaagcatgcattacctgaactattccttcctattttgattagcaattgttttaaaattagcatgttagattataacctcaaagtaaaattaaattctgtatctattctccagataagacctaaagtaaacattacactgcatgttcaaaactagatcaaaacacttgaaatgctacagtaggtgcagagaaccagtttcatagga

SEQ ID NO: 168040 - DNA, 198 bp, Homo sapiens
tatctacccatctgtttactagaggtcctctctgcatatcccatctatgtgggggtttgcatagagaacatcaatactcaaacaaaagaagagctgctcccgctgaataaacctaaggttctgtggaactgttagatacagctaggttcctcttcaaacagcttgtccagttcccctcttctttattctctagttcca

SEQ ID NO: 168041 - DNA, 520 bp, Homo sapiens
agacatatcgcccaacacaaaggaatgacaagggtttgaggtgatggttttgctaattaacctgatttggtcattatacattgtatgtatcagaatatcacatgtacccccataagtatgttcaattatgtagtcgagaaaaccctacagggtaagaaagaggtgccacatcatgggcacttcccagtccagggtactgtaattaaaggtccctaagaaaggtcctcagatcctccaacatatctagtgaaatgatacctaaaacccataattagaactctcgcttcctttcactgcagttccactaggttgggccacattgggtgaggctgggtgcagctagaaccagcattattctgagctgttggcactcttttccaccccaatacagatgaagatactgagaacggagtgtgatggggtaggtgtggaaatagatggaagtaatgacgagaagacaactttctagtattacccacaattgattcatttcaggtctctctcccatgaaccccactga

SEQ ID NO: 168042 - DNA, 149 bp, Homo sapiens
ttgtttagtctgcaccagccatgctggcctccttgatgattctggaatgtgccaagatactcctgcttaggacatttgcatctgctattcactctgcctggaatgttcttcccccagaagttgtacaactatctcctttacaatcttca

SEQ ID NO: 168043 - DNA, 583 bp, Homo sapiens
ttccacattcttatatagcctttattacattcagtgaaattctgtttaaaaacacacattctcagtcttcaaatgaaaatcaacaaaaatatatggctcactataactgtgctcacagtcaactttgtggaagcgcaccttaatttgcttagtgagagatattatatatactacttgatttcaatgttagcttttgtaaagtagctctttgttcttaaccgatggtatcttgttagaaacccagtcctatccattccttgactcttgcaagtttaactggcagaagactgcaaaattatcaagtaaacatgtgacttaaccattccagatcgttcaagcgaacaattcttcaaaacatccaaaatttatactagaataaactcaaatttactatgcaattgcacaacctttcattgtatttctaaagagcagaggacacagaaagaggagaggggcagcccatcggactcacttgacgtattaaggttagcttgccttatatgtaaattttcatatgcacccagccgagcacacaaactcagttaccactgccctggacatgctacatttgagtccaaaaaaa

SEQ ID NO: 168044 - DNA, 405 bp, Homo sapiens
acctgtcctcaagtttatcatatttacaacatgggagacagacataaaagccggtaagctgtaatacaatgtgatacatgctagaagtatatacaagagaatatcttctaggaagtatttgagtatacttagattgagaaggaaacttcctcggattgtctccaaacctattatctaaaacaaaggaaggcatgcccctgaaatggtttctatctctgaacttcccattcccactctcaccctacctgtaacccagggtttcttaacctctgcactagtgacactttgggccagataattcttcactgcggtgggcagtcctgtgcactataggatgtttagcagaatccctggcctctagccaccaaatgccagtagcacccttcttacgttaccccctccatg

SEQ ID NO: 168045 - DNA, 212 bp, Homo sapiens
tgctgtgtgtaagataacagtttccattccaaactgagatacaatgtctttgatggagccagccgggtaggcctttcgggcatcaaaatccttactaaggaaagagccgttttcttcactctggcatatcccctttgtgagaactgcaatataactctccatcattttaactgggctcccatgtttcaggtacattctacacaatatcctag

SEQ ID NO: 168046 - DNA, 404 bp, Homo sapiens
gtggtttacaaataagcccccctgacatttttgtgacatgaggttggtgattaaacctattttacagatgaggaaactgaggctcagcgaggtcaagtgccttccccaggtcgcatagccaggaaatggtgaagccggactttgaacctaggaatgtctggctctaaagccaaagctcattctttctaaatctgcaaatctcataccccgctgtggccctgggaggcttgcccgtgccagtggggaaggcacctctctctccaaccaagagatcaaaaagatgggtgtgtgggctgggtgcagtggctcatgcctgtaataccagcactttgggaggccatagtgggaggatcacttgagcccaggagttcaagaccagcctgggcaacatggtgaaaccctgt

SEQ ID NO: 168047 - DNA, 228 bp, Homo sapiens
gcctccaggcacatggtaactcccagctggttctctgactttggagtcaccgggtgatgtgcaattcctcacttgtgtgctttgaaggttgcatggaaagaacccccaaatgctttccagctcagaaattccaagataatttttgggtgttcaatcaatttgaaagctcctaccaccaaccccgtcagtttctttctacttttatgctttccaaagcttccaaaatca

SEQ ID NO: 168048 - DNA, 667 bp, Homo sapiens
ggcccgtgcagagaagaaagctgcggcaagggggatctccatgaagaccccaactgtcccacgagcaggttaaccccgacagcaccttggtggagaacaagaagcctcagctggtggtgactgcacgtgactctcgtcgagcttgctgtctctctgtctgcgctgtgtcctacagtggggttcccttactgcgttatccaggggaaggcaggacggagatgcctggtctgcaggaagaccccagaaaagactgtcaccttcacacaggctcactgggaagacaaagcagctctggctaaggtggcggaagctatcaggaccgattacaatggcaggtgtgacgagatccacagtcactggggaggcaatggaacctcctttgcaaaaattataactgaggaaattatgacagtgaaagaaatcagacctaaccgactccatcttgcgtctaacctttaagctgtccttgtccattcctcggcgtgggctgaacaaacttcggggaggaattcagctcgtggtttgactctgaaacaaaatttataatagcccttaaccgaaaagactcttcttgcctggggaccagtctgcctttgcaagactaacagattagctacgagatcagaaattgtagtttaggggtcatgcagactctgactctaagagt

SEQ ID NO: 168049 - DNA, 465 bp, Homo sapiens
aaagaatagcctccaggatatatgaaaactctttcaaatcaataatagacaatcacatgaaaaaaaatgagcaaagacttgaacagaagaaaatataaatggtcaataaacatgcaaatatgctcactctcattattaattagggaaatgcaagtataacaacagtgagataccattaactatcctctagatggctaaaattcaacagtttgataacaccaattgttggcaaggatgtgatgcggcaggaactcttcagactgctgttgattaattggtgtgttcagtttgggaaacaatttggcattatctagtaaagttgaagatacatatatcccgtgatggctattctactgccaggtcgatgatcttaaagatctcctaggatacatgcatcaggatattcaaagcagcattgttcatcataccccacactgaatacaacaaaacgtctatccacagtaa

SEQ ID NO: 168050 - DNA, 345 bp, Homo sapiens
ttgatgattaagattacatatcattttgagttttacgtagagaggttcagatgaatgtggagtatgttttgaagagagcaaaagataaaagagaggtaaacacttcatagaattagagctgtaacttagggaagaagaggaaatgccaaaagatcgaaagagtatgacctagtagctgccatagatatttggaagtttatcatattgataagagatttgacttctttatgaataaaagggaaagacctaggtcccttaggcagcagttagagggaggcagagtttaagtggctaaaagggggaacttgtggttctccaaaatggaataataggttccctggctgg

SEQ ID NO: 168051 - DNA, 406 bp, Homo sapiens
gataggtgctcaaggagtatctattgcctgacaagtcaattaaaaatgcaataaatactgctgctgcagccccacagagaaaaagactgatggttatcttggaaaggaggaagacggtccagacggaagccacacaactggctgcagaggtaagaacggaaggaagtcctgtacaagatgtgaaagaccgccagcaacttgagataggctttgttctgccagctactcctgctgcacgcaatgcttcacaaatcagtgctgctgccagcacctcggaggtgcacttcagctcggacgaaggatgcttctcaggtcacacagaaaaccaacaagtacagctgagaacaaagctcaaccacaacttctggctcaagacactaagacaaacctacctcccagcacaaaa

SEQ ID NO: 168052 - DNA, 365 bp, Homo sapiens
aatggcactcacgggagcctcgacctcctgggctcaggcgattcttctgccttagcttcccaagtagctggacgacaggcggcgccaccactctattttgttgctcctatttttagtagtgggagggtcttcctatgttgcccaagctggtctcgaactcctgggctcaagggctcctcctgccccagcctcccaaggtgttgggattacaggcgtgagcaactatgaggctggcatttggtattatttagtaaatatttgttgaaaatgagaaaagaaagacaagtgttccaaagaattttttttttaatagaaaggcaatgagagttacccttctagaattttacatgatgccacggtcatga

SEQ ID NO: 168053 - DNA, 558 bp, Homo sapiens
gtcaaagcatttgaaccaggcccaggctgtgggtgctactttctaaaagattctccccaagccaagggttaccaacttggacctcctcttacagtcctgtttgagcatgatccacctgatcaggcaatttctagcttaatctctttctaaacttttcattgcctggttcagtaccttattttccttagtaggatcctatgttttttgcatttttaagtttcttagttgtcttgccctctaacatttacagcattcgtaatttagcaaatcactaaatgttgtatttgtgattggcatgaatagacccgatatattttttaagctgaaaaagaaatataaccaacctgacattggtttttaaaagtattctatacatacttttattgttttggtaaattagatttggtgaaggttttggttgaagtttgggaaacgttttttatgattctgcagtttctgacatgctaggatgaagccagctttatactgagtaattaaaaagaaatattatgaggcctgaattgtgattttataaatcaatgacaccggtttgggaag

SEQ ID NO: 168054 - DNA, 214 bp, Homo sapiens
tcataaaacatcattatggtttgctatatcatgctttcagcacctttctgaaagataatatgctattttaaaataaacactatgtaaatagtggtgtctgttttgctggaaggtgtagtttggaaagaaacaatttaaattttgcataaaagcagttggttgtaaagcataattgatgcattcttttatactaattaaaattttcatacgtact

SEQ ID NO: 168055 - DNA, 399 bp, Homo sapiens
tatttaatctgatgataaaaaatgcatcattcttgtgttcatatttagcattaaatatgtttagcccatgaaatgagtttagcccacatgaaatggttaggaaccaataatctaagccagcctactacagtaggaaagggaagatgtacctacacattttagtaaagggtcgaggactgcataaactgttgttattggtcatcttgtttgaaatgaagtcattctctcccccaaatgatctgttttgagtcatttttaaaaaatcaatcagggacaccaatgacattccctctaagcttagttaacacttttcaatcttaatccttggcagtatttcatattgtgctctaaatgtcataacttttcctgctgcttctgaggtactccattttcctgatt

SEQ ID NO: 168056 - DNA, 499 bp, Homo sapiens
gctcggtttcctccactagtgcaggtctttgtaagggctctatttctcactgagataatgtgccagctgaggaataaattttacaacacttcttttacctccttggtaacaaggacaagagaaaccttgacaatatatctgatgtaaatcttaagtctcttagcagactaaaatggattcccagatgttttttctgagatgttgcaagaaggcactgcagaggtcaggaattccagttagttttgctactagctcaagatacagggtttttaaggtattaatttgtaatactttctaaaagtatttaattgctgttttttccatttcatcatccatctggttggccctatggtttctctacagtttattccttaagaaaacttcaaaatccaaggcaaccttgcttaggctgatgaattcaaattagcttgtatgttagaatccaacaagaacaggaattaataacttcctctttctacctcattaagaaactatttca

SEQ ID NO: 168057 - DNA, 629 bp, Homo sapiens
cattcacctttaaatgtgctttatagaacttttatagagagcatttattacataaaataaaaaaaaccttctttaaatttgcttcttttttctgttttagaaacaaggtcttgctctgttgtccgggctggagtgcagtggtgcaatcatagcttactgcagcctcgaactcctggcctcaagcaatcctcccacctcagcctcctaagtagctgggattacaggcatgagaatcgcttgaacctgggaaacggaggttgcactgagccgagattgtgccactgcactccagcctgggcaacagagcgagactctgtctcaaaaaagaaaaaaaagaaagaaagaaaaagaaaaggaaaaagaaaaaaagaaaatgcaaatttgttccaatgccactcatgttagggaggaatttgagcataactcaaattttatgtctatttatgcgcatttcctccaggagaaataccaggtaaatgcagaaaattgcacccagtcatgtaggaaaacacaaaatacacgagtcaaacatctaccggttcacacatatgccagggtgccacacccatctacgcctgctgtctcaacttcccctacaacttcagataaccttccttatgcccttcaca

SEQ ID NO: 168058 - DNA, 496 bp, Homo sapiens
acatccaggccttactttcctccctgttaccatctatatgtaaatgttttgactcttgtatttgtatattgatccaagactatgaaattatgaagccttccttgaatgcaaatcagagatttgtataagggttggaaaacagcacagaggagaaaaaaagaatgagaatgctcatcatagcctcagtgatagaactggaagagatcagtggcttcacagcccctgaacagctctcagcaagcaagtgggtttcacaggcagcacctcagggctccatgtagcagcctgcattccctggagctgtgagaagcaaaactcatgcaactggttgcagacatgtttacaagtcactggtgggccaaagatgtggccagaattggtctcaagacacagagaaatcaataaaagaagaaaaagaaaggataacaaagtaagaaccaaactgatgggccaaagatgtggccagaattggtctcaagaaacagagaaatgaata

SEQ ID NO: 168059 - DNA, 929 bp, Homo sapiens
cttttagaaattatatataaaatataacatgtataagtatcaattctgtcatgccctttaaaatgttttgagacagggtgtcttaaaaaagttgtttgcttctgtaatgaagtgtctaatctgtgccacctcattgctatttcttttttattattgacattttaaagaatacataaaagtagagagaataaaataagccccatatacccatcaccacagtttaaccagtatctaatcttgcttcttttatcccttcttctctctcaagctggattattttaaaacaaatatcaaacatcagatcacttcatacataagtatttctgtattacagtgactttcttatattaattattattgatataatttaattgttaatataattattgtattaatttttaattactctgtatagtttataaactatttcttggaatattctagtttatttcagcaaagtctcttgtgactctcctgccctcttttcaagacagagtgctgcaggaggctaccgcttctagtatatagtatatcctataacctatgttgaaattgtaggccatgctgctagattggagttcatattgttgctctgacatttacttgtatggccttagcctaataatttaatcttttttgcttcaattttctcatctttaaacgggagcaataatagtgcctcatcctaggtttttgtgaagattatttgaggcaaattcgtgtaaagcatttaatttagcacatgctaagtgctcagtaaatgttagctaaagttaaaaaatttttaaaaactaaatgctagctgtagagtgtttactgtgtgccaagaactttacaaataagaactcctgaggtgggcatatcacttgaggtcaggagtttgagaccagcctggctaacatggtgaaaccccatctctactaaaaaaa

SEQ ID NO: 168060 - DNA, 295 bp, Homo sapiens
ccctgtgctcctggcctgctttcacttcctggagctgctctttgtccccaaacacactggtaattgtggtctatccagaagtcgaattcaaagttccaagttcctggcacgaaagccccttgactgtgctgtggacagagaccccatctgtaattagaccaggctggagagaagatagaaggtctctccctgtgttcctcctggaaattggtggttatgatcacgtttatgtggcttaagcgtcaagcggatcaaagggcgtgagcctggatggcgtccgtggggcctctccgtg

SEQ ID NO: 168061 - DNA, 244 bp, Homo sapiens
ttgcttatgcctataacctcagcactttgggaggccaaggcaggaggaccccttgagcccaggagttcgagaccagcctgggcaacatagggagaccctgactctagggagggaaattacccacaaagccagcaaacaaattgagcgttctgtatttttattgtagagtttataccaatatccattctatagatgctctctgttgaaatgattcaagaaaaacgaacatctagtttttccttgg

SEQ ID NO: 168062 - DNA, 406 bp, Homo sapiens
tcccctgtcctcacaagctctctgacattccacacaacacaagagttagcagtcatccttcgactgatcctctgccctgctttggctcacttctcacataaagtctcattgaagagtcttccaaaataaagagggctgcatctgctttttctcagctctgccactacttcccaagggcaagtcatcaccatttctggcccatattactgcgcgaaagcagaaaggtgttgataataaagacagtaacagaaggtggtcatcttaactcaggaaagggtcttcttcaggattccagagaactcagtgtcctcagtgttggaaggcatgaatgaatgaaggatgaactgtcttttgaagaaatgactagaaggaaggaggaaaatcgtgatgcattacaatactgagc

SEQ ID NO: 168063 - DNA, 270 bp, Homo sapiens
agtgggaaaaaggaaaggggtttactgcttttaagcttgcattggaaaggttgtcagcccctgtcctataccttctgtgcctacacaatgaaaattgaatcctcagaatgacttggaatcagtctaccctgtggtttgacataaagttttctacatatgtaaagttaaccaggccccactatttctgcattattgaggttctcctctaagtagaatgtctttttgctcttcactatctttcaaaaaataatgagtaggattagagcactt

SEQ ID NO: 168064 - DNA, 116 bp, Homo sapiens
tgaagatattgataacaatcctaactgaattattaggaaactttctgaaggttataatcacactcaaagccttgccattaccctgcagtaccccttacatccaattccccaactcc

SEQ ID NO: 168065 - DNA, 476 bp, Homo sapiens
tctttaagagttatgtgatggttgaattaagtcatgatactgtctgatggaggcttcagtgtatacagatgtaagacaactagaacatgaggggagaagggtgaagggacctagatggtagtgaggtttctacatgctacttgaaatggcaaaacattaatctaaattgactgtaagagtatgtgtatttggccgggcagggtggctcatgcctgtaatcccagcattttgggaggccaaggtgggtggatcacctaaagtcaggagttcgggactagcctgaccaacatggcaaaaccctgtctctattaaaaatacaaaattagccaggtgtggtggtgcatgcctgtaatcccagctactcgggaggctgaggcaggagaattgtttgaaatcgggaggcggaggttgcagtgagccagattgtgccattgcactccaacctgagcgacaagagcgaaactccatctccaaaa

SEQ ID NO: 168066 - DNA, 609 bp, Homo sapiens
aattattccttcaaatatgttttctgtgttgtatactttttctcctctctcaggaatgccaataatttataggtttggtcactttacataatcccatatttctcaaagattttgtttatttttcttaattctttttttaattttttgtcagacttggttattttgaaagactggtcttcaagctctgaggttttttcttctgcttggaacagtctattgataaaactttcaaatgtgttttgaaaatttcagttgagtttttgaattccagaagctctgattgatttcctaagatgtgtatctcttacttcatttcctgaattgatttaggagtttctttgtgttgactttcaacacactctagtgcctgtgtttaaggctgttgagcaagatggaagagtgactgtattttcacttacatgaaaatagctctacccaatacgattttatttgttgcctggcagaggccatcccaggaagtttcttcccagttaaggcctcattttgggatgagatttgtttccattgtgttcctgagggcaactcattttactccaggagagaaatgtaatagtgatgtaggttgtattcaaacagtaactaactgaa

SEQ ID NO: 168067 - DNA, 1144 bp, Homo sapiens
gaattgcatttctctggtgattagtgcagttcagcaccttttcagattcctgttggccatttggcacagaaatttccacactccttgacagaggtgcttaacccttatccatcagcattctcagacagcacctccggttagggacagtatctgaccgtccgacatccctgcagcccccatgtgtcacacagactcagcctcaggtagatggtttccgtagatggtggctttctttggacccttgacatcaaccagttactatttggtctaggggtctcaccaacgctgctcatctagcagggccacacataacaaatagaagcagagcaagccctggaactcctgcctgacagtgacacgacgacagaaacatcttaccagtcagaggaccatgagaaatagattcaaggagcattccacgtgcaagtgagtcttggccccatctgcctttggattttagccgtgaactggaaggtattggaaagaagaccctcagaaatagcttaatcaaaatccctgcgtctgaaccaagtgccttatttctctgtgggcctcaagcttcgctgacatctgtggagcacactgtcctaacaggagtgctgtctgatttcccaacgctctgcaaaacaaacagcctggaagggtggctggtggaaggtggtttttagagagagacttgtagataacaggaaagtgaaggctgtaaggaaggttgtaattaaacagcacatggaaacacaatcacattattgtcccattccatagggataatgatgaccacttcagtgggaaaaggagaggttttaagtcattagggactatgggccaccttttaggaagatttattttcaaaggttaaaatagtgttttggcaattcaagtttcattttcagaaaatgtaattgatgggaacctcagtgactctggatgaataagatgctgttgagtggctctgacttgggccagccgtgcttctcacaggaccttggagaccaaggtcactgtgatctcaggttcagggggcaagtcctctccacacagccctagttggcctcacagctgaaaatgtctcccttactgttggactcctttgttcacccacatgagtttgtgaataaatcctttccagtctgaaaaaaaaaga

SEQ ID NO: 168068 - DNA, 309 bp, Homo sapiens
ggtcattttcttccttgaaatgggcacagaaatttccacactccttgacagaggtgcttaacccttatccatcagcattctcagacagcacctccggttagggacagtatctgaccgtccgacatccctgcagcccccatgtgtcacacagactcagcctcaggtagatggtttccgtagatggtggctttctttggacccttgacatcaaccagttactatttggtaagaacttaagtcattccagtgcctctctcagaagcatttgcatttagaatttctgtgcccatttaaggggatctcagacgt

SEQ ID NO: 168069 - DNA, 1077 bp, Homo sapiens
tctagaggatcccggcctaaagtggaactgctccgttggtcatgctgtaaaatggccatggccacagatgctgtgtcaggaggttgaagtctatagaacacactagacacgtaagagaaggatgccaggtcagggccagggacacaggctgcacatctcacctctcttgatctcatccctcttaatgggacctctcaggtctaggggtctcaccaacgctgctcatctagcagggccacacataacaaatagaagcagagcaagccctggaactcctgcctgacagtgacacgacgacagaaacatcttaccagtcagaggaccatgagaaatagattcaaggagcattccacgtgcaagtgagtcttggccccatctgcctttggattttagccgtgaactggaaggtattggaaagaagaccctcagaaatagcttaatcaaaatccctgcgtctgaaccaagtgccttatttctctgtgggcctcaagcttcgctgacatctgtggagcacactgtcctaacaggagtgctgtctgatttcccaacgctctgcaaaacaaacagcctggaagggtggctggtggaaggtggtttttagagagagacttgtagataacaggaaagtgaaggctgtaaggaaggttgtaattaaacagcacatggaaacacaatcacattattgtcccattccatagggataatgatgaccacttcagtgggaaaaggagaggttttaagtcattagggactatgggccaccttttaggaagatttattttcaaaggttaaaatagtgttttggcaattcaagtttcattttcagaaaatgtaattgatgggaacctcagtgactctggatgaataagatgctgttgagtggctctgacttgggccagccgtgcttctcacaggaccttggagaccaaggtcactgtgatctcaggttcagggggcaagtcctctccacacagccctagttggcctcacagctgaaaatgtctcccttactgttggactcctttgttcacccacatgagtttgtgaataaatcctttccagtctgaaaaaaaaaga

SEQ ID NO: 168070 - DNA, 673 bp, Homo sapiens
tctagaggatcccggcctaaagtggaactgctccgttggtcatgctgtaaaatggccatggccacagatgctgtgtcaggaggttgaagtctatagaacacactagacacgtaagagaaggatgccaggtcagggccagggacacaggctgcacatctcacctctcttgatctcatccctcttaatgggacctctcaggtctaggggtctcaccaacgctgctcatctagcagggccacacataacaaatagaagcagagcaagccctggaactcctgcctgacagtgacacgacgacagaaacatcttaccagtcagaggaccatgagaaatagattcaaggagcattccacgtgcaagtgagtcttggccccatctgcctttggattttagccgtgaactggaaggtattggaaagaagaccctcagaaatagcttaatcaaaatccctgcgtctgaaccaagtgccttatttctctgtgggcctcaagcttcgctgacatctgtggagcacactgtcctaacaggagtgctgtctgatttcccaacgctctgcaaaacaaacagcctggaagggtggctggtggaaggtggtttttagagagagacttgtagataacaggaaagtgaaggctgtaaggaaggttgtaattaaacagcacatggaaacaca

SEQ ID NO: 168071 - DNA, 510 bp, Homo sapiens
cacaaaattaaaccactctgctacttctccagtgtgcatggatgtgtccacacttttctttgcttgatatattttatcagttgctccaaacattagcaaaaagctgttcatggacttgaacattatttagaaacaagcaaccctggtgttgaacatgcctttgacaatatacagttgtctaccttgaatctttcgctcctttcattagactgaatagcacaatggttaggaattggaactctggaattggactgcctgatttcagaatctggttctgccacacactggctgtggaccttgaataatttacttaacctttctggggcttggcttttttatctgcaaaatggggataatgtgggcacaaacctcatagagctgctatgagaaccaaatgctatgatgaatatacaatgttggctcagtgcccggtaaatagtgaatgctccagaaatatgacgatgatgatgatgatgatgatgacaagtaattggccttagctcttgcttt

SEQ ID NO: 168072 - DNA, 146 bp, Homo sapiens
ccacagcaactatgtatctttttatttcagtcctctagattcctctattctattccaatgtgttaattttaaagaatttagcagctagcttccaatttaaaataacgagaaagattttgtcctctatttttatatgaagcacttta

SEQ ID NO: 168073 - DNA, 577 bp, Homo sapiens
ataagtgggaatcatgtcacaaaatagagtaggcagctccagggcctagtccctctaacagaagcaaccagtaagctggaatgagagactggaataaactatttgggaactctggaacctgatgggacacttacaacaatcaggggagtgtttgatgacgagagaagttgctgcttttcattagtaagcactgtgtgcaaatcaactaccaccctcactccttcgcccctcgccgatgagacaggcagctggaattcctggagaagctggctggtgccaaggcaggcagtggggacctgttctctaagaactgaggattttatgttttggttggtctggtgatgccgagtgcctggtccaggtacgtgcattggttttgaccctcttggtggcagcagcttcccccagcaggatctatattggaagacttacagacaagatgctttttttctttttggagccaggtatttaaggaaatctttgtcagatcactgattgaccgcagagagaatgaaacagaaacatcagtgaccacgtacaacaagtaatacacgtgctacaataatcgtttggaaaa

SEQ ID NO: 168074 - DNA, 220 bp, Homo sapiens
gtactgatgcaccagtcttctaaatgtctctgtgctttttacctctgccccctacatgtctgagttctggacagtgaggtgaagtgacagaagtactgggatgatctttgggcaagactgatgaaagagagttgacttgggggacaacctgctcgggtccccttccattctgtggaagctttgttctttcgctctttgcaataaatcttgctgctgctta

SEQ ID NO: 168075 - DNA, 407 bp, Homo sapiens
aaagtagtattaccaacacaatgagctttgcataatatcacaatatgaaatcaataagcaattctagtaacaaaaaactatgacctatgtctcaggcacagaaaacaatatctgtaggatgcattacttaagactgttcaacaaataaataaggtagacttctgagggactgggtatttccagtctaaggaaagtttttattagcaatcacttcatctaaagtaggaggattaaggtataatgggctttaacttcttttcattagagcatactattaaataaatcccaaacaactacatactgcatatttacataaatgttttgtttactccaaaaaattttctcccattatattacatctcatttattaaatccagagatttacgaaaaattttctttttcttttc

SEQ ID NO: 168076 - DNA, 409 bp, Homo sapiens
gtggagttgagaaaaaaaagtgtagcctgatggaggtctctggaatagaacaagccttgcccatgcaggcttccgagcagccctgggtggggttgtggggaggcccccagcggcttgtggcagccttcagctctgcaggagcccgtggggtctagagtcaccgccctctgtgaactggaagctgctctaatgctgtgcacgttttgatgtcacaactatttttacgattctgaaatttaaattcaacagacagccaggtaaatttaaattcaacggacagaacaggtaaatttaaattcaacggacagaacaggtaagctgacatgctggtttgttttttagggtcatgaaccttctagaggctcggaactgtcacattaggtttccctactgtaaattcttttcctga

SEQ ID NO: 168077 - DNA, 521 bp, Homo sapiens
ggataggagagacccttaatgtgcaccaccacacccagctaatttttaaaactttgtatagagatggggtctctccatgttgcccaggctggtcttgaactcctgggctcaagagatcctcccacctcagccttccaaagtgctgggattacaggcattagccactgtgcctggtcatgtactatattgctttgaaggtcttagccagaccaatatagatagatagatagatagatagatagatagatagatagatagacagaatgaagattggaatggaagaaataaaactttcatcattagcaggtgacatgattatgtacatagaaaattttaaagaataagcaaataacctgttaggataaatagatgaatttaataagattgctgaatactcagtcaatataaagaaaatcaactttatgcctacattccaacaacaaactaatagaaaatgttttaatgatatcatttacagaaggatcaaaactatcaaaaatctaggaataaatctaatgaaa

SEQ ID NO: 168078 - DNA, 369 bp, Homo sapiens
cagctgagagagccaaacagactccatttttgtttcttcacttgcagcccccttatccccctcccttaaggacataactagtgcaagctgactccaagcacatccaggaatgcacttactgatagacactgaggcacgctgtaccagcagctcctaggaacgcactcagttaatggtacccaaagcccctgcgtttatcactttgtgataattaagcccctgcacctggaactgtttattttcctgtaaatgtttgtgtaaccatttatcttttaactttttgcctgttctgcttctgtaaaaattgcttcagctaaactccccctcccctatttagatcaaggtataaaaagaaatctagccccttct

SEQ ID NO: 168079 - DNA, 241 bp, Homo sapiens
ttcaccaccgccacgttgttgacgaactgcttgaagcggtccctgcgggcggcgcggccccgcgggtcgccggcatcgagcagcggcttgaagcggctcagcagctcggagttgcgcaccttcccgccgtgctcctgcaggaagcccagcaccgccgcctggctcaccccggcagccgcagcggcggcggcggcggccagcgccatggtggggccctgggttcctggctcccggggcgggt

SEQ ID NO: 168080 - DNA, 230 bp, Homo sapiens
acttcactgaaggacctagcaatggtgaaactgagagcggagagattcacggtgcggtgaaagacaatggagctcctccctggaggcgcactggcacctgcagggtgttagcaaggagttggggatcaggcaagatgagcccagagcaatggggcagaggagagaaaattagctcaatttgggtctgaaacgtcagtgaggatttcacaggagagcagcttttgattgga

SEQ ID NO: 168081 - DNA, 588 bp, Homo sapiens
gctgtatcttcaaaatatgtctatttgactaagaagaagttattcaacaggagttattatctatgaaaaaagtacaaccagaatataaaaaacttgaggaggataaaaagatgttggaagaagtaatattaaatcttaaaaaacatggaaactgcacattggtgaagacacattggtgaagtacaaaaatataaattggatgtagaagaaagggcaatgcaggcaatagaaaaattagtagaaatccctttacaggttagtttgtaaaatcaggtaagtttatttataatgtgctttcatttatttcactgcaaattatattttggatatatatattgtgtttcctctgcctctcttatagcaatttgccttgtagagttctagcaaaaaggtggcatctgtttttactttcaaatatttaaatttccatcattataacaaaatcaatttttcagagtaatgattcttactgtggagtcatttgattattaagacccattggcataagattacatcctctgactataaaaatcgtggaagaaaacctaggaaatattcgtctggacattgcacttggcagtgaattta

SEQ ID NO: 168082 - DNA, 103 bp, Homo sapiens
tcccaagtactatgtaataggtgaataagttttactgacggccgtatttctcaagtgtagactgtgcccacctttttacctgccaattctaagtctaggaatg

SEQ ID NO: 168083 - DNA, 484 bp, Homo sapiens
agcactcctcagggtcctttaataaataagcaaatcacaaatggagtgatggatacgttgaccagttatgagttccatatgagcttatgtaaagccagggttgatttttaattaaattaaggcaaggaaaagcacattcacttaagaagaaacatggattcaaatcaacctgaaggagagagaagggttgagtcagttaaggggtatcagtgctcgaataatcacagtcctgactcagcctaactagggaaaaatgggtaggttttatcctatgagatagattcctacaagctgttggagtttctagaagtagctctaaatgtccccatcgtcttctttccccatgtcttctcatatcacaggagggcattccagctgcacaaagcttcatgaagggctgtcccctggctccatctctgccaatacctgtggggaccatgggaactgtccaggatggcaggaggatagaatgtgtgagacaaga

SEQ ID NO: 168084 - DNA, 490 bp, Homo sapiens
tggctcatcctggctcaaaaagcacccccactgagcaccttgcgacccccactcttgcccgccagagaacaaaccccctttgactggaattttcctttatctacccaaatcctataaaacggccccacccttatctcccttcactgactctcttttcagactcagcccacctgcacccaggtgaaataaacagccatgttgctcacacaaagcctgtttggtggtctcttcacacggatgtgcatgaaagcctccagtggtatactgagttggtcaggacccccattttctctgcgtccaacatccccagttctcctctttggtgattgagtggttcagggaaactggcctttgtaagaactgagaatctaaattaatgcaatttaaacctttgactgtgtatgtgagaggagagaaagaccctctcacattgttttatattgttttatattcagtaaaaacaacaaggaagtaaaaccaaagacaggca

SEQ ID NO: 168085 - DNA, 384 bp, Homo sapiens
acttaatacttcaaggagctttgaacccagatacgacatttgaattcagttggacaggtgttatcattattggctagacaggaaacctgaagctcagaactacttctacttgtccagttcacactgaatgtcttttattgttaaatgtttttgtcctttcaatgtgcctatgctagattaaaacagaagaatcagtatacatttgctttgttaaattaatacatagttttattgccagtaggctacatacattcccttgaaatgtatgtgcttatggaagaaggaacttttttttttgagacagggtctcactgtgtcacccaggcgagagtgcagtggcacaatcatggctcactgcagcctttacctcccgggctgaaatga

SEQ ID NO: 168086 - DNA, 359 bp, Homo sapiens
aagcccgaggatggagagtcacagatgcttgtggtaggtagcaggtggtgtgtatggaaatgggaatgggatgccaaggggatttgggcaggcaccaagcatctgccgcattaccctaatccaggcaataacactcacagtatcccagggattccccttctagcctcgaattcctcttattctcatttattttgtatttactttctagaccatagtttctcagatagtaaaggttctactgactttcctcatctctctgcaacctctttcctgcctagcttctcttccatggtcaagccaatacacacagaattttgccttccattcttcactcaggtgtttcttccacttggaatctg

SEQ ID NO: 168087 - DNA, 348 bp, Homo sapiens
cttcccactcttctcagtctcactctagcccccctcaaatcccccttcccttacatcactttctaattgatgtgagttaaagagtaagtgtcctctcacacatggtactatagcagtgttttttcaaacttttttgattgataaatatatgatgtatatagaaatatacatatattattgaaacaaatgtttctgaaataatacctactattgccatatgtgactcacgtttttattttttactcttttttactctattctatccaactctatttggctaagaaattatatgtgctcagaaccctcttaattgattttatagctcactaacgtgtcaggacccatagt

SEQ ID NO: 168088 - DNA, 273 bp, Homo sapiens
aggggaagaatgttccagacagagtctctgaggggatacaagatgagcttgcatgaaggccagtgtggcaagagtgcacgaatagaggacagaaatcagaggcccagggagagaccagatcacttgaattttgttctagccataatagggagccttcagatgttttattttatttttatttatttattttttgagacagagtctcgctctgttacctaggccgagatcctgacactgcactccagcctgggcgacagagcgagactccgcctc

SEQ ID NO: 168089 - DNA, 276 bp, Homo sapiens
ttcttcataatgtgatctcctcacctccagatttcccttctgctcaatagaactaggaggaaggagagggagcttaacatttcccttctctcagacccttagctccaaggcaatcatcctgagacattttgctacgccatctgcatctgtcacaagttgagttcggagaactcagcttgagacacatctcttgtaacagaaacttcacttggccctttcttctcttatggtaaagaacaaagacatacgcatttgggtagtattctggggtccgac

SEQ ID NO: 168090 - DNA, 290 bp, Homo sapiens
ccgtcctgagcttccagtgttccagaatgttctctggaacattcagggcaccttgactgcttctcatatgctccagtggcctctggatgccaaatcgttggtgacagcctggcatggccccatcaaagagggtgcctcctctaacagctgcgtcttccacacctgcagaatccaggtccacccaggcactatgtacctagggatttgtatgtatcagatcataacaaaacataggtggacttgttaagaatgatttttgtattccaccgtagaccttaagctgaaagtat

SEQ ID NO: 168091 - DNA, 164 bp, Homo sapiens
cgcaacccaggccttttaaccagagctttggtgatcggttctgggaagggcaagtcagtttggcccaggtttagagtgcttgctcaaatactaagaaaaaaatatttttctgagcctcagaataactataaaatgcttcctcgtggtatttttaagcacctgga

SEQ ID NO: 168092 - DNA, 216 bp, Homo sapiens
taagcatggacactgtaatatatcttaatgaagacatatccaatgcagcgtcatctttattctctgataacagccattatgttattcacaggatatatgctcagtgccaaagataagattaagctgcttttaaaagtgaagagtaaggattaactagtgctttataaatacgttctaaaacatttgaccttcagacacagagggcaaaaatagtga

SEQ ID NO: 168093 - DNA, 437 bp, Homo sapiens
tattattgttcatttgattacttttataaatagaaactgttgtacattaaggtctagctttctgtgtcaaacctaagtcttggagtgatagttaagagggtaaaatttcaacaaaagctttctgtgtcaaacttaagtcttggagtgatagttaagagggtaaaatttcaacaaaaatacgtaacaaaactgattcttaacagatttcttaccacccaactcctactactttttttgtgttttttgtttgtttgttttttgagtcttgctctgtagcccaggatggagtgccatggtgtgatctcagctcactgcaacctccacctcccaggttcaagcgattctcctgcctcagcctcccgagtagctgcgactacaggcacgccaccatgcccagctaatttttgtatttttagcagagatgaggtttcaccatg

SEQ ID NO: 168094 - DNA, 526 bp, Homo sapiens
tttctataggtgagttattactcttgaagggacagctttgtttctgtgagaagttccaccttcctcttccagagctgcatactacagctgaaactttgtagcttcttcctgagctcttcaaaagtaatttcacctcaaatgaagaaaaatttcggcattgtaaaccagaacgtttttctttcccccttagccctcaactcaaatgttacaggtataaacatatacctgtatatgttacagtaaattgtttctaagtgagaacaaggattctctcaggagtatgtgcaataatttatcattatgttggcagagacttggaggtgagggaataatataagggtgtgtatattcaaattataaaagaaaatatagggccaggtgaggtggctcatgcctataatcccagcactttgggaggctgaggcagatgaaattgcctgaacccgggaggcagaggttgcagtgagccaagatcgtgccactgcactcctccagcctgggcgacagagccaggctctgtctcaaa

SEQ ID NO: 168095 - DNA, 379 bp, Homo sapiens
ataaatttatcagctcagctagctgatacttcagccccaggaaagtgaaatacataactggggtagaagaagctgccggccagagcccaaggaaaatggggcaccagaaacacgggttttacatgggcccaattcagttttacatagggtctctccctcatcccgcgtggagattagcaagtcaaatttaatacttttgaccacacactggtttagatgcagtattgaactaagtcagactgaatttcagtggtaaaaatacacaaacaaaaaattactacagaagtgaacttggctacagagtcataaggtgatgtgtttactctctcggacaataatcttgggcaacagaaaacacacacacacacatacacacaca

SEQ ID NO: 168096 - DNA, 716 bp, Homo sapiens
ggcagttcttttagacatgcattgtcttgttgcccaacagataaagaattttatgagggatcttaaaaagtagaacatctcttaaagttcgttttaaaaaatgagttgtctcttctaaaatttctctctgattgcttttaggttacctagggtatgaattaatacagacttggaaactctgaaagaacttagaatcagcattttgaggtaaatatgtatatgccaaagtagtgataaggttgccccagtctgctttgttgacttcttagcaaaacaaatttgtgtatgaaatgagaactttaacctccatgagaatgtcttttaaaggactggaagtagtaaaaagaggccactgccaatttgtttttcctgagcttatggtagtggaggcattgcagaaggctcagacctgagcgcaaaccaagtctgatgtcagatctaacaaaatcagtatttgttgatcaaattaaactttttatatctacattttatgctttcttagtttttgatttataatctcttttagagagccaccccaaatttaaatttatgcccgacattaacattaacagtgttcttgaattattttatttataaactaattctataaaaatgtatagtgtagatgtaactgtccttttgtgtttttaatttcattttgggaaattggaattgctgatggatttcatacctgtgttaaagagttactactgggt

SEQ ID NO: 168097 - DNA, 377 bp, Homo sapiens
gtaacttctataatgttgcagtaaatttaggtcgtattggtctgatataggtgtaataagaattttccaaaacaaatcctggtatttggaaacagctatttttacataattatagatactaagatacatttaaattgatatttttttttcttaagtagttttgtcttcttagaacttttaaaactcattgtcattgctcatcacttggtctgaattaaaattcacacgttttatatcattttctattggtaatttttctgtcattttatagtttaaaaagacttatggaagtaataaagcttacaaataaatatgctattaaaatacatcactaagcttagaacttacagtttgagaattttgtccttatgttttaa

SEQ ID NO: 168098 - DNA, 176 bp, Homo sapiens
gcaagcccagcagaattctgattcttacaatcacactctgcccacagcggacacacagagcacaatcagccatgtggaggcaaagccgtcccacgaaacagggggtcacaatgcatttgggtgaaacctggcagcagctgcccaagggctaccaagaaaccacacgaaatcatcat

SEQ ID NO: 168099 - DNA, 349 bp, Homo sapiens
gctgctgccctgggaaaggatcagcttccccatgttactttcaagatggctccccagatggtgcaagggattctggaagaaacatctatccaaatttctagatagaaggggaagatgtagctaacaactctcctctcctgcttgccatgtgtcacaggtgttccactctaatgttgtataatgaaggtgtgcatgaaacaactattaggcctttgcttagtacgtacttatcattcttgtcctaattcctaggaacaggtctctgatgtcctttattcactatacaattttccctgacgaaacttccctgtttaccttgtgaagtcttgattaattaatggaaaataat

SEQ ID NO: 168100 - DNA, 688 bp, Homo sapiens
  misc_feature (688)..(688): n is a, c, g, or t
atagcggtccagcatcacgttattatatctgtgtctggatatggttgacgattaattagtaatcaatcagaatgatcttcctcattgtcattttcctctgcattatttttgaaagcaactatgctgatgttttgcatcttaaattagtttttcttctaagaattccagtagatgggctcatggagtatgcccactgttatgtccagttctttctttctgcataaagtctctgagttttattcacattgttgagtatatcagatgttcattcctttttattgctgagtagtattccattgaacgaatataccacagtttatttgccagtgtcctgataatagacacttagattgtttgtagttttgggtatgtgaataaaactgctatgaacgttcttgttataatttgtgtgtgtgtgtgtgtgtgtgtgtacatatgttttaaagtctcttggaagaatatctaggtgaagaattgctaggaaaaaaaatgtttatgtttaaatgtataggagactgtcaaaccaaagtgattataacattttacattccctctaaaaatgtatgagttctgggtgttccacatcttcaccaagatttggtggtttctgactttataattttgccatgctatatgcgtgtaggatcccagagtgactgaagcatgagtgcattgttttttttataan

SEQ ID NO: 168101 - DNA, 335 bp, Homo sapiens
tttaaaaagagaccatcaaacaggataaagaggattgggaatagggcagagagtggtagaggacaaattgctaagtaattgagtggttaaaggaaagctttattgaaaatgtgattcttaggcagaggtttgaaggaggtgagggggaaactgtgcatgtagacattttggggagaaagcttccagcagagagaacaaatatgcaaatcctctgaattattctgtatttaaatccagaacttggtctcatcagttttttaataacttagaaacttaagtgttagttggttgatggagttactagtagaccatgttgggagctgacaacaatttga

SEQ ID NO: 168102 - DNA, 441 bp, Homo sapiens
aatctactggatctgccatttcctagggacttgcctttttcccacaaaacagagttgaggcaaaggaaaagccagcccaggtagaagaggcaacaaaggcaaggggtggggatccgcatcatgatttcagggaacagcaaacgttccatgggactggagccctgagtctgtgaggagaaatgaacaagtctaccacagtcatccagaatgagaggcaaaattatgtcacaaaaggtgtgagtgggaaaactgggcccagcggcagattattccaggaagggattgtgcctttgtatgtctctgcaatgctaacctcaatgccagttcctcagagtgttacagacatttgccatgcatctgttactcaagtgctctgctcagagagggtcagtcttaagcccccaggagcatcctgttgtgaatcggttcacacttctttga

SEQ ID NO: 168103 - DNA, 358 bp, Homo sapiens
agacaggagagacagagatggagagagacagagagaatgagaaactgagagaaacacagagagaatgaaagagacaaagagacagagtcagtgacagagagagggagatagagacagagacagagagacagtaaaagaaaatgagaaagacagtaagcaacagagagtgggaggaagagagagacagagaaataatgacaggagacagaaaggccaagagagagaagagagtcttcagatacgggaggtttcccgagtgactcagaacttgtgcttcgaaacagacaagcctgggtcccatcttgtgcctgagacacaggctcaagatggcagaatacgagtgtaatagctcacgttg

SEQ ID NO: 168104 - DNA, 336 bp, Homo sapiens
gacttgcgtcatagctcctatgctgacagactgtgcttgacctttgatgagctccagcagagtggccaccaccaatacacagcagtctacccacaaaacctaacccatgccactttgccggcatgcacctgcccacgaccacccctccattgctttgccatcacatggatggaccttgcatccccttccctgcccactgtgggtgcatgtgcactctattgtgccattgttaccagcctgagtgcacccacacctgctgccaagccgccattgcttgtgcaaacacacacaagtacgtcacagtcatggtgtgaatgcatacactgaggtcaccag

SEQ ID NO: 168105 - DNA, 698 bp, Homo sapiens
aatatagtttctaaagttattgcaaattagttcctgctgcttggtaaaataccatatttaaacttaattacaactgccttcctgcaatgaagggccaactttttcaaataatgtgttacagcccagtgactctagggagtctatggtcccattgctgcaaatgagcagatcggtgaaaacaaaaacatattaagaagtccacatttctaacaaacaccttgcaaagaataaaatggtaatttaaggaatatgtccacttaatatacatttcatgtatataggacacataatacaataaataccctttttactacccccaatttaagaagtagactagtataatagaaggcatatctccttggtactcagtatttctaaaaggcagtaatggctgtctcctctaagcacctgagatgatatgcctctgtgcactctagccttagaaatatgcttatctcctgcaggcagagcatgctggaagtgccagggagttaaggttaccaggaacagccctcaactaataatgaggaaaagcttgtggataaatatccaagccccctgccttcaggtaggaacactgatattttattagattggtgcaaaaataattgcggttatatagtctcaaagaggaaacagtctccacgtgaaatcgagccccagttgtccacagtaataacccgcttattaacttagcc

SEQ ID NO: 168106 - DNA, 386 bp, Homo sapiens
agagcatatacagctagtgctagaaaggtcgggtattagaactggaatgacctgcccatccagaagtttttttcactgtcccaaattgtattttatttctggtggtgtctgtactgagtattagggaataattggaattaaagaaaaagaggtaatggaattatatattgcataatatataattatatatgagatggacgagacaaatgtatttctttaggaattggtaatgtacgagcaggagctgaaggagtgggctgctggaatgatcttgagccatctttggtgagagaatgcatacttcgaaggaaatgctgatcgaaatcttattttaagatcttggattgatacatacaataatactttagagcaccatttggacactt

SEQ ID NO: 168107 - DNA, 435 bp, Homo sapiens
gattggctggccttgggctgggtgcctcctcctggttcaatataccatggctggggggtgggggcacaggtaccaagcagggccacctgtggggaaaagtggcctgggtgggtttccctcagcaggggctctggacaggcctgtgtcttgagagcagacatggtgggctctgggacttggcagtctgtgaggaggcctggttttttcctctctaagaacagggcttttaaatccagtgtgaatacagctcactgtgcctctcacttcccgtgtgagaaaaaccacagaaaagcacagctgcacctacatgagaaaccacgcaaaccaagccacttcccccaagtctggtttagccaaaaatgcatttgatttcctgtctccatgttgtggtcaagattgccatttgcttcctgagtttcaggatcacaatcgaca

SEQ ID NO: 168108 - DNA, 313 bp, Homo sapiens
aacatctgctaaattaaaaacaaaaggatctggccctttatgtgtcagtaaacaggtaagaactctgttctcaactatgcgaccggcggcagtggcacaaagacagcataggggaatgaggagtgacagttgagtctactaaggttgaactaagggaaaagagctgaaggtaagaaaacaagctcttgattgagggataaaggtgaatcaagaaggcaaattggttttgtttagttaagaagattaatgagataaagtcaggaaaatcctatagttttatatgtacattaagtaattcttatgttagagatca

SEQ ID NO: 168109 - DNA, 303 bp, Homo sapiens
aaaggattttccttgtcttcccacccaagagtgacggggctgacatgtgcccttgcctctaaatgatgaagctgaacctttgtctgggcaacttaacttaagaataagggagtcccaggcatgctctcccatcaataacaaattcagtgacatcagtttatgaatatatgaaatttgccaaagctctgtttagaccactgagtaactcacagctaggtttcaacttttcctttctaggttgtcttgggtttattgtaagagagcattatgaagaaaaaaatagatcataaagcttcttcagga

SEQ ID NO: 168110 - DNA, 338 bp, Homo sapiens
ttctagatccatgtggtgtcttctactccaggaaggctgtttcacctgggagtgcccccattcttctctccagcatgacattcaccatcctgagttgggattacctcgtcccttgtctgttttcaactagactgtaaacagacagggcctgtgtgtcatttatctttgaatccctagtaccgataccagtgttgccgcactggtatagcataaatgactcctgagcagaggcattgggggcagtgggactcgggcactgtgcctttatggtgggagggagggcaagggtggtctggcaggtcagccagctggttggccccacatgtagctccctcgcc

SEQ ID NO: 168111 - DNA, 202 bp, Homo sapiens
ttctccttcaccctcagcggcaagtcccgctttcctggggcaggacttgccgctttcctggggtagggacaagtacccctgaaccccttctccacattacctgcttttcaagggcctgtttcccttgcctccataactgttgtgggtattgacagccaggcttctaaacctcttaaaactcccccactctggtgccaacttg

SEQ ID NO: 168112 - DNA, 290 bp, Homo sapiens
tcccttatcccatatgtcttactcacttctacattaagcagatacaattatccacaggaaattaacactgatacaataacattaactaatctacaaacttaattagaaatccaccaattttcccactgatgctgtttatctgttctagaatcctatccaggaccccacattatatttaggtactatttcttcttaatcttcctccaatcttatagagttcttatcttcatctttcatgtcctggatgctgtccctcaatttgggtttttccaatactctcatgattacag

SEQ ID NO: 168113 - DNA, 287 bp, Homo sapiens
gtcagaaggcagtaactgtgatgggcactagaggggaaggggaagccctccttgctagtctcttcctctcccaagtttattttttgttcctggagccgagactgacatctttattttttatcatagacagaacaatggattgttggaagctgatgctgaaggaattaagtaggtactttgtatgtgtgcaaggaaggtttgaaattggatgaagaaaaatgtgtggactttgtgcactttgccctggccccttcaaaatgaaggtgacatacccacgaaacactgtt

SEQ ID NO: 168114 - DNA, 421 bp, Homo sapiens
tcaacccagtcaacaaagtgaaaagagaacccacagaatgggataaaacatctgcaaactatccatcggacaaggaattaccaacatgtaaggagctcaaatcagtagcaacaaaacaaaacaagccccaaataatccaattttaaaatgggcaaaagatctaaaatacacatttctcaaaagacatacaaatgattaacagatatatgaaaaaatgctcaacatcactaatcatcagagaaatgcaaatcaaaaccacaatgaggtatcatctcactccagttaaaaccacttgcatcaaaaagataggcaactacagatgctggtgaggatgtgcagaaaggggaaccctcagtgtaagtgcaaatgtctatgataacatccatcaacatcaacataatatatggggctcaagaccact

SEQ ID NO: 168115 - DNA, 412 bp, Homo sapiens
tcaacccagtcaacaaagtgaaaagagaacccacagaatgggataaaacatctgcaaactatccatcggacaaggaattaccaacatgtaaggagctcaaatcagtagcaacaaaacaaaacaagccccaaataatccaattttaaaatgggcaaaagatctaaaatacacatttctcaaaagacatacaaatgattaacagatatatgaaaaaatgctcaacatcactaatcatcagagaaatgcaaatcaaaaccacaatgaggtatcatctcactccagttaaaaccacttgcatcaaaaagataggcaactacagatgctggtgaggatgtgcagaaaggggaaccctcagtgtaagtgggaatgtaaattagagcagccactacgaagaacagtatgaaggttcctc

SEQ ID NO: 168116 - DNA, 284 bp, Homo sapiens
gcaacgtgagttagcacattcacaaggatgggattttccctgtgggcagctcgcccctgagttaactcaggcgcgagctgcccaggggacctcatagccccagtggcaccctatagccatcccttccaaggcctgagtgggtgcagacctgtagatttctcctggctcctttcttttttttttctctgctctgtcgcccaagctggagtgcagtggtgcaatcttggctcactgcaacctctgtctcgtgggttcaagcaattctcctgcctcagccgcccaag

SEQ ID NO: 168117 - DNA, 434 bp, Homo sapiens
gatgcgttgaactcgacggttccatccgctcacacagtttcttctctgcttctgccagggagaggaggttggggagaagcaggaggcacacttgagcatagccttgagcctcccgggtgcagagcctggtccccgcctcccttcctggagtcaccgtcagctggggtgggggccaggctacttcctgcagcggcttgacaagcaaaatgcaatgtgaggtgataaacatggaatctgagacagggccgtggaaaacggttttttgttgagcgtcggggctgccctgttagtattccttttataattttgtgactgccataaaactgtttaggggtcccacagcatggagatcttttgtattaaacagctttcataaaccctgaatgagttccagattctgagactccggaacttcagtccccctccttttcttt

SEQ ID NO: 168118 - DNA, 228 bp, Homo sapiens
cagtgttctccagacaagcagaaccaatagaatatccttctttatcacaaagtattggctcagatatggaggctgagaagtcccatgatctgatattgctgtctgcaagctggagacttaggaaaactattgctgtagtctgaaggcctgagagtcggaggtcaatggcatagattccagtccaagtctgaagtcctgaaaaccaggagcaccaagggcaggagaagc

SEQ ID NO: 168119 - DNA, 265 bp, Homo sapiens
ttagggacaaatgtgagggctttttcgttagttactatggtcactatatactcactcctaggtaccatttcatagcattaaggatggacagcaacaaatatgccttagaaatccattcattctgcaattatttgttgagccccagatactgctaggtctcacatggtccctgcctcatgaagctagttatctagtgaaatggataaacagtagtaaaataatcattctacctaattataggccaagggctaattattctcaggta

SEQ ID NO: 168120 - DNA, 209 bp, Homo sapiens
agaagggtgtaaattggctcaacgattctggagagcaatttgacagaatgtagtgaaagcgtcaaaaatgttcacacactttgacttaaaaattacattcctggaaatttataatacaaacattttctataaaaggtcagatggcaaatactttgggctttgaaggccacatatgtctctgtggcttttcttttgtgtgtgtgtttaaa

SEQ ID NO: 168121 - DNA, 309 bp, Homo sapiens
gtaagccagggaagcctcaaaatgcctcaggtccatgcacccaccgggagcaccgtgtccagcctccatgcccaccctgcttactctctgtggtttggaccaagcagggaatattctgctccaggggcagctctgcacagagacaaagacaagcaacggccaaggccattcaaagcaaggttgccccctaatctcaagcattttggggaggagaagtaaacataattgtaatatattcttgaatcacagttaaacagtacttccttatgttgccaaatatgtaataatatttctactgagcacagaaat

SEQ ID NO: 168122 - DNA, 1053 bp, Homo sapiens
  misc_feature (476)..(476): n is a, c, g, or t
gccaccggcttggcgcggcggccaaactggtgggacagtgtctccaggtagtgaggcccaacctctttaaaacaaacaaacaaacaaacaaaaaaccaaaatgcaaacgtgagtagagaatgaaatacacagtttaaatgccctcactatctttgggttactaatatactaagcctttctggactaagtaaaagatgcaggttcctgcggctagggatagaagccagactggcgtcttcagaatctcccaccaaggctgtacctctggaggagttctaggtttggatttggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagnaatatttagaagttgaacttgtccccacggacagcatttagtgcttttactttctggaagaagaaatgtgtggaaacaagaacttcctttatcgttcagagtgtccagaggagagacaaaatgggaaggcaaagcttatctccctggagttattttccaccaaatgtgacaaaattcaattcatttgcaattcatggatcaaaagataaacgaagttatgaagctctttaccctgtacctcagcatgaactgcagcaaggacaaaacctgattccattgcctagaatacttcaagtctttcaatttaacacactgctggagagagtggaaccaccggatcagactggggtaataggagaatgtgtctttcggggtatgggtacctacgatcattttccctatacctttagataaccaaataattcacttttagatggctgctccttcacaccccatttcctcggaggcggaaattttctgggccgttttttccaacataatctgggggacctgagacgtcgctctccaggttccccatttttacaaggagagtgccgcgggcttggtccacacgcgg

SEQ ID NO: 168123 - DNA, 861 bp, Homo sapiens
  misc_feature (284)..(284): n is a, c, g, or t
gccctctcctgtgacctcggctgaaaagaagaagccagtgtttgagaaaagcttcgtgagacttcagatggattttaaaattgaacacacttgggatggttttccagtgaagcatgagcccgtatttatcaggctgaatccaggtgacagaggagtgatgatggacattagtgctccatttttcagggatcctccagccccacttggagaaccaggaaaacctttcaatgaactgtgggattatgaagttgtggaagcatttttcttgaatgatataactgagnaatatttagaagttgaacttgtccccacggacagcatttagtgcttttactttctggaagaagaaatgtgtggaaacaagaacttcctttatcgttcagagtgtccagaggagagacaaaatgggaaggcaaagcttatctccctggagttattttccaccaaatgtgacaaaattcaattcatttgcaattcatggatcaaaagataaacgaagttatgaagctctttaccctgtacctcagcatgaactgcagcaaggacaaaacctgattccattgcctagaatacttcaagtctttcaatttaacacactgctggagagagtggaaccaccggatcagactggggtaataggagaatgtgtctttcggggtatgggtacctacgatcattttccctatacctttagataaccaaataattcacttttagatggctgctccttcacaccccatttcctcggaggcggaaattttctgggccgttttttccaacataatctgggggacctgagacgtcgctctccaggttccccatttttacaaggagagtgccgcgggcttggtccacacgcgg

SEQ ID NO: 168124 - DNA, 387 bp, Homo sapiens
acgggggcatatgcattcaatactaatgaggcttctgctcattacacagaacaccagaaaacacacacaagataagtacaggttcattcaatcactctttgaaaacacatcatcaaattcaaatgagtaaagcaaacaggtgtgtattccgaagtaaaaaaaattaaaaattttctttttataaagaactttagcataaaaacctggatgtgagaaacctgggaataccttagtcaacaatttggatataaaattatttttaatttgttggcactgaggtaatattttttttctcagtatgatggcatttttatccaagcatatatttgtgaattttgtgttagacttattctatatctgacacatttcgtgaatgggccggaaagg

SEQ ID NO: 168125 - DNA, 588 bp, Homo sapiens
cccatcaacaccttgatcttgggacttcaagcctgcagaactgtaaggcaataactttctgtcatggaaccccccagtgtatgatacttcgttaaagtaaccccagaaaactaatgcaccctgcctctcagtgctggaatgatcttggccaagtcacttccatcctggcctccagtccctcttctgaaaccacgtccaaggataggagccagtgtctccccaaaccaagaacatcgcttatcattgctctgggctgcatttcttggttttacatctccttgctgctcctatcccatgcagcttcctttaagaagggtacctccctgggccttccaacctgaagtcacgccctcccttaatccattcaggctgctaacaaactacaaaatatagtgtatctgtagtatataacaaaatactataaattgggtggcttacaatacaacagaaatttatttctcacagttctggaggctgcgaagtccaagatcaaggcgccagcagatttggtgtctggtgagggtggcttcctggtttatagacggtgccttcttgctgtgttctcatgtagttgaagggacaaacaag

SEQ ID NO: 168126 - DNA, 393 bp, Homo sapiens
ctttgtattgggtaaagagcttgagtctcaatgagtttgggttatatctagctcacatcacagagtctgaaattcttggagtttattttttatcaagtataaaaatcggcctaaaatagttctgtgtaaaaaaaatatcttgtatagtactgggggatgaggtgagaaatgtgccttaagttagtaggcatttatgtagtccatctacatcatggactggaggattgaattttctagtagcaatttaaaagagagagcagtagacatagttgtagacatttcagtggtggaacttcaaggtagaaatattgccatggaaacaaagatttgagtaggagtaagaagaggagttacaaaaggaggaatatttggggaaaaaaagaaaaagtatgt

SEQ ID NO: 168127 - DNA, 244 bp, Homo sapiens
ggtaattatatctggatggctcatgaaattactgtaacatccttgattttattgttccctcaggaatttcctctctattttaaataaaatgtgttttatgcactgagtacatttagtatctccactctgttagacaattacaacactgtagatacacagagctatgcaatgtgcctattttaactatagattagcttcctaggaagaacagtgttggtatcctttgccatttagagtcaaaagg

SEQ ID NO: 168128 - DNA, 114 bp, Homo sapiens
ggcatttccagtgaggttggaatggaggggatgaagataccttgcaggtgactcactgtctgttctaggtgaagaagaatcaagacagactcaggctctctgagtgtctggctt

SEQ ID NO: 168129 - DNA, 484 bp, Homo sapiens
ctcctctgcaaggaatgcagagccagacagacagatcctgaggccccatgctcaggtggtgaggccaatatcaggcactgtctttctccccttataaccaccaaacacatgctgcttcctgatagctcagtactttgcctcataaatgtggaaaacacactagaattcacctatataaaggtacttcggaaaaatgtcttaaggcaagtgcaaaaacaaaatcaaatctaagtgtcaattagttgcatgcagggtgttaggaaaagaataacaaaacactactagagaagatacaaaataggctggcactctagtgaagatggcaattagggggctaccaaggccatcactacttctacctaagggagacttacttacttactttatatatttatttatttatttttttgagacagagtcttgctctgtcacccagactgggtaagactctgtttcaaacaaacaaaccacccccccacaaaaa

SEQ ID NO: 168130 - DNA, 361 bp, Homo sapiens
tatggggatggatacaaagatttcatcccagtttggaagtgtcagcaaatgtgtctcagtgaaggagatgcctgtgttgtgctaaggatgattcggaggtaaaaaaagaaggagagagaggggtcctctggcagtcgaggactgtgtgcctctgcaagcttcccttaaccatggtttttaactttcccttggctgagtgtttttccacgagattaagaggcagaaaaaacagcaacaataggtgccctatgacatcatgggattaaatcataaatatggcttggggtggctcagatctcctcacatgttaatgtgctagaggtagaagtagaggcaaattaaccatgaagtagaagaggta

SEQ ID NO: 168131 - DNA, 202 bp, Homo sapiens
aaaaaaaatccacctagtttttattgagtaatgacttcatgcccagaatggtgttgagtattgggacagaaaatgacagacatataagatgggctgtgccctggagcttatagttgctaaaaggagcagacacacacgcccatgttattcaagaatcgcttgagtttgtcccagcaccccctttctacttctctgcctctgt

SEQ ID NO: 168132 - DNA, 212 bp, Homo sapiens
cccatttccctagtccaggagcagagcagcccaccacattagccatccagtggcctgttgtccagcttgtgcggctttctctggggctgtcatcccaggtaaaggttatttaggagatgataccaaagtaagggggacaatgatgaagattctgcttccgcctgtgcccacctcaaccttctccattcaggagaacctagtcataagtgctg

SEQ ID NO: 168133 - DNA, 640 bp, Homo sapiens
ttacaagaaatgcatctcttaaataagttatctctgttggtgtcctaaggtttattacacctttctacctcagcagggcagcacaatgtagtaagatttaggatgtgccaggggggagaggagccattatgaaatgccaggtgggcctggactgcaggagtcctcagacaattcactcttgcttcatttcctcagagtctgttggacttgtttctgatttttttttaataaggagcctcgtttttttctgtagtaattaaagtagttgcgtgcacatgtgtaatccataaaaagcatacttttgtagccttcactaaaagctacgaagggtggataactgttttattgatgttaaagcagatccacaggacttttggatctttctcctcccctttggctgtggtaaaaatggtttaatatgtaacccttttcaaggatagttgtactttaaaagaatgccgaatgctttaccatatatatatatatatatatatatatatatatatatatattcccgccccctccccaccaccaccataatgggagcccatgatttcaaagctgctttgagcccttatcgcggtaactgcaatacatccttgggcatctaataatgatcccatcttatagtaattaaaag

SEQ ID NO: 168134 - DNA, 699 bp, Homo sapiens
gagtgtccccatctgctcactgccagtcctttgcaaggggacgccgcctcctcagcctccgctctgagtgcgcagcagcccctcctgcccgtctctcgctaccagggtgtttcagaattagggtccgtgtttttccccatcacagtaatgatgataattacatgtttatgcatagctgaagaacaatcccacaaggatatttccatactgtttattagaccttttcagaattcactcttgcttcatttcctcagagtctgttggacttgtttctgatttttttttaataaggagcctcgtttttttctgtagtaattaaagtagttgcgtgcacatgtgtaatccataaaaagcatacttttgtagccttcactaaaagctacgaagggtggataactgttttattgatgttaaagcagatccacaggacttttggatctttctcctcccctttggctgtggtaaaaatggtttaatatgtaacccttttcaaggatagttgtactttaaaagaatgccgaatgctttaccatatatatatatatatatatatatatatatatatatatattcccgccccctccccaccaccaccataatgggagcccatgatttcaaagctgctttgagcccttatcgcggtaactgcaatacatccttgggcatctaataatgatcccatcttatagtaattaaaag

SEQ ID NO: 168135 - DNA, 4463 bp, Homo sapiens
  misc_feature (246)..(246): n is a, c, g, or t
  misc_feature (1066)..(1066): n is a, c, g, or t
  misc_feature (1089)..(1090): n is a, c, g, or t
  misc_feature (1152)..(1154): n is a, c, g, or t
  misc_feature (1156)..(1157): n is a, c, g, or t
  misc_feature (1444)..(1444): n is a, c, g, or t
ggagcagaactcgggcccaggcatacagggagcgagacatcctggccgcgctgagccacccgctggtcacggggctgctggaccagtttgagacccgcaagaccctcatcctcatcctggagctgtgctcatccgaggagctgctggaccgcctgtacaggaagggcgtggtgacggaggccgagggtcaaggtctacatccagcagctggtggaggggctgcactacctgcacagccatggcgtntctccacctggacataaagccctctaacatcctgatggtgcatcctgcccgggaagacattaaaatctgcgactttggctttgcccagaacatcaccccagcagagctgcagttcagccaagtacggctcccctgagttcgtctcccccgagatcatccagcagaaccctgtgagcgagtccgacatttgggccatgggtgtcatctcctacctcagcctgacctgctcatccccatttgccggcgagagtgaccgtgccaccctcctgaacgtcctggaggggcgcgtgtcatggagcagccccatggctgcccacctcagcgaagacgccaaagacttcatcaaggctacgctgcagagagcccctcaggcccggcctagtgcggcccagtgcctctcccacccctggttcctgaaatccatgcctgcggaggaggcccacttcatcaacaccaagcagctcaagttcctcctggcccgaagtcgctggcagcgttccctgatgagctacaagtccatcctggtgatgcgctccatccctgagctgctgcgggcccacccgacagcccctccctcggcgtagcccggcacctctgcagggacactggtggctcctccagttcctcctcctcctctgacaacgagctcgccccatttgcccgggctaagtcactgccaccctccccggtgacacactcaccactgctgcacccccggggcttcctgcggccctcggcagcctgcctgaggaagccgaggccagtgagcgctccaccgaggccccagctccgcctgcatctcccgagggtgccgggcccncgcccagggctgcgtgcccggcnnagcgtcatccgcagcctgttctaccaccaggcgggtgagagcctgagcacggggccctgccnnngnnacggcggcacccggcccggcggcggcacctgctgaagggcgggtacattgcgggggcgctgccaggcctgcgcgagccactgatggagcaccgcgtgctggaggaggaggccgccagggaggagcaggccaccctcctggccaaagccccctcattcgagactgccctccggctgcctgcctctggcacccacttggcccctgccacagccactccctggaacatgactctccgagcaccccccgccctcctcggaggctgcggtgaggcacagcgactgccttacnctccgggggggccctatcagggacatggggcaccctcaggctccaagcagcttccatccactggtggccacccaggcactgctcagccagagaggccatccccggacagcccttgggggcagccagcccctttctgccaccccaagcagggttctgccccccaggagggctgcagcccccacccagcagttgccccatgccctcctggctccttccctccaggatcttgcaaagaggcccccttagtaccctcaagccccttcttgggacagccccaggcaccccctgcccctgccaaagcaagccccccattggactctaagatggggcctggagacatctctcttcctgggaggccaaaacccggcccctgcagttccccagggtcagcctcccaggcgagctcttcccaagtgagctccctcagggtgggctcctcccaggtgggcacagagcctggcccctccctggatgcggagggctggacccaggaggctgaggatctgtccgactccacacccaccttgcagcggcctcaggaacaggcgaccatgcgcaagttctccctgggtggtcgcgggggctacgcaggcgtggctggctatggcacctttgcctttggtggagatgcagggggcatgctggggcaggggcccatgtgggccaggatagcctgggctgtgtcccagtcggaggaggaggagcaggaggaggccagggctgagtcccagtcggaggagcagcaggaggccagggctgagagcccactgccccaggtcagtgcaaggcctgtgcctgaggtcggcagggctcccaccaggagctctccagagcccaccccatgggaggacatcgggcaggtctccctggtgcagatccgggacctgtcaggtgatgcggaggcggccgacacaatatccctggacatttccgaggtggaccccgcctacctcaacctctcagacctgtacgatatcaagtacctcccattcgagtttatgatcttcaggaaagtccccaagtccgctcagccagagccgccctcccccatggctgaggaggagctggccgagttcccggagcccacgtggccctggccaggtgaactgggcccccacgcaggcctggagatcacagaggagtcagaggatgtggacgcgctgctggcagaggctgccgtgggcaggaagcgcaagtggtcctcgccgtcacgcagcctcttccacttccctgggaggcacctgccgctggatgagcctgcagagctggggctgcgtgagagagtgaaggcctccgtggagcacatctcccggatcctgaagggcaggccggaaggtctggagaaggaggggccccccaggaagaagccaggccttgcttccttccggctctcaggtctgaagagctgggaccgagcgccgacattcctaagggagctctcagatgagactgtggtcctgggccagtcagtgacactggcctgccaggtgtcagcccagccagctgcccaggccacctggagcaaagacggagcccccctggagagcagcagccgtgtcctcatctctgccaccctcaagaacttccagcttctgaccatcctggtggtggtggctgaggacctgggtgtgtacacctgcagcgtgagcaatgcgctggggacagtgaccaccacgggcgtcctccggaaggcagagcgcccctcatcttcgccatgcccggatatcggggaggtgtacgcggatggggtgctgctggtctggaagcccgtggaatcctacggccctgtgacctacattgtgcagtgcagcctagaaggcggcagctggaccacactggcctccgacatctttgactgctgctacctgaccagcaagctctcccggggtggcacctacaccttccgcacggcatgtgtcagcaaggcaggaatgggtccctacagcagcccctcggagcaagtcctcctgggagggcccagccacctggcctctgaggaggagagccaggggcggtcagcccaacccctgcccagcacaaagaccttcgcattccagacacagatccagaggggccgcttcagcgtggtgcggcaatgctgggagaaggccagcgggcgggcgctggccgccaagatcatcccctaccaccccaaggacaagacagcagtgctgcgcgaatacgaggccctcaagggcctgcgccacccgcacctggcccagctgcacgcagcctacctcagcccccggcacctggtgctcatcttggagctgtgctctgggcccgagctgctcccctgcctggccgagagggcctcctactcagaatccgaggtgaaggactacctgtggcagatgttgagtgccacccagtacctgcacaaccagcacatcctgcacctggacctgaggtccgagaacatgatcatcaccgaatacaacctgctcaaggtcgtggacctgggcaatgcacagagcctcagccaggagaaggtgctgccctcagacaagttcaaggactacctagagaccatggctccagagctcctggagggccagggggctgttccacagacagacatctgggccatcggtgtgacagccttcatcatgctgagcgccgagtacccggtgagcagcgagggtgcacgcgacctgcagagaggactgcgcaaggggctggtccggctgagccgctgctacgcggggctgtccgggggcgccgtggccttcctgcgcagcactctgtgcgcccagccctggggccggccctgcgcgtccagctgcctgcagtgcccgtggctaacagaggagggcccggcctgttcgcggcccgcgcccgtgaccttccctaccgcgcggctgcgcgtcttcgtgcgcaatcgcgagaagagacgcgcgctgctgtacaagaggcacaacctggcccaggtgcgctgagggtcgccccggccacacccttggtctccccgctgggggtcgctgcagacgcgccaataaaaacgcacagccgggcgaga

SEQ ID NO: 168136 - DNA, 328 bp, Homo sapiens
attcacccagatccttcaagacagtgtccaaccagaatcacatcagcaccttgttccccgttctaatttgacactgtaactacagctatttttaaagagtagaaaaaaaaaaacataaaaatgatacataggaactaggaaagtttctggatatttttctgtggaatgggaaggaacttgaaacttaacctttcaattcatgataaaactatagaacactgtgcacataaaacataagaagtaacagatacaatgcctgaccagccaaaggtcttgactgtagctaaatgaatcacgctggaacaaaagtcctgtgcatttgtgttgt

SEQ ID NO: 168137 - DNA, 905 bp, Homo sapiens
agcctaaggctctttgttctcagtaactacctgtttgtgttaggagtgagttttgtttttctttcagataacaacagttaactaacacagatggccactgccaataaccaagtgaacctaggatgaaccatgagtatataacaaatgatactaccaagtcctcctctataaggacaagttattgtttatcttgagaacatgtatgtaaaggattgtatgtacttggatatgtaaaagagtgaggtttctttctgtctctgcaatctcatgaatggatggcctgtgatgcacatctcagtctggtttaatgcctactcaataatacaactctttttttcccctacatttatgaagagaattttctgggttgacaggaggtttttttgctaactttttccccaacaggtgtttatgccttactcaactattaaaggctattacagaaatgtaccccctctgagactgaacagtgttgcttttttgatcgatcctcatctctaccaggcagggactgagctggtgcctatgtgcctagctcccttctcatactgatgacccaccacctccgcctccttcctgtactgtaccagctttggtggatgggagaagttcagaaggagatcaaattgggttaagtttagagctgaggaagaacgctagagtcccatctcacatagaggtcaggttctaaactcagggttttggacaaaagaaaaactcagaattaccctccattgtttttttcatcggagcaccacttgaagtctttagcatgtaggccccgtcatataaaaaatagcaatctttaaacaacagaatcacacttttcacagcctgatgctcctctccaaaaggtctcagttcacatcttactccatggtacaggtccagggagcaaaacaaca

SEQ ID NO: 168138 - DNA, 300 bp, Homo sapiens
tctgctgttcacggtctatcttctttggctagaatgtgcttctgttttttgggtttgcaccagctccagggatggcgggtagcacaggtgtgctgagggaagaggcctctctgaaaacgtgaacggttactttggagaatgcctgtgttctctgaatatcttctgccctcatcctcaaaactaaaatgaagcccttttccctatgattgctgggccgataggattgtcacaatcccaaagttcacagatacataactgaaaacgggaaagagtaaaagataaatgaatgagagacatggc

SEQ ID NO: 168139 - DNA, 263 bp, Homo sapiens
  misc_feature (16)..(16): n is a, c, g, or t
cctgaggatacggcangctatccggttcaattttacttgtcaattatgtctcaataaagcagggggcaatacaattttttttaatttagcatgcaaaaattttttaaaaacatcaaagctgagtccacagtgttgattttacttgtataaaatatttctgcaaaatttatcctatcaagatatttggttcactccagtcccaccctagaaacctgtcacactttcagttcaggacctacagacccattgaaccggatagcttg

SEQ ID NO: 168140 - DNA, 883 bp, Homo sapiens
cctttagaaattgaaagaggaggagaggaggagagacccacagttgatctctgagaagtgagtagctggaggcaccaggataccagccaagcctaaaggataaagcaaatccctggacatggcttttgattccaagctaagaagtgcaaggtttgaatggtgaagaaatgatggacgctgtttgtctcaaacaaggactctaatgatacaacagaacaagtcacaagaaagcttgcctggaaaaccatacactggcctcttcgtggtgaagtccttcacaatccttacaaacatagaaaatattcagcaattcgtttgtttgttttccagtccactcttacttgagaaaaatgcaaaacatcaaagacacagaaaaaccaccagtctatacagcttgcccatactaaattgttattcatttcagaagagtgtacagtttctttctgtaagactctattaaaccagttactctacaatagcaaacattttaggcaaacctaaccattgcttcccataaagatatttatatctttaagtggtatctgattcatccctaagaaatatgttatcaagatgtttgtttgtttgtttgtttgttcatttgtttttgagatggagtttcactcttgttgcccaggctggagtgcagtggcatgatctcggttcactgcaacctctgcctcccggttcaagcgattctcctgcctcagcctcccgagtagctgggattactggcacccaccaccactcccagctaattttttgtatttttaatagagacggggtttcaccatgttggccaggctggtctcaaactcctgacctcaggtgatccacttgcctcgacctcccaaagtgctgggataacaggcatgagccattg

SEQ ID NO: 168141 - DNA, 1083 bp, Homo sapiens
cctttagaaattgaaagaggaggagaggaggagagacccacagttgatctctgagaagtgagtagctggaggcaccaggataccagccaagcctaaaggataaagcaaatccctggacatggcttttgattccaagctaagaagtgcaagaagctcttccaaatacaactgcaactgccaagagattgatggaccagagaatggcctcttcattccaggcacttctaaagtccaagtggtcaaataccagcctctttttaccaatgttcccacctgtttcattcagccaaatttcattagatgaaggaaggtggtgcattcttgagattgagaatacagatgagaagcaggtttgaatggtgaagaaatgatggacgctgtttgtctcaaacaaggactctaatgatacaacagaacaagtcacaagaaagcttgcctggaaaaccatacactggcctcttcgtggtgaagtccttcacaatccttacaaacatagaaaatattcagcaattcgtttgtttgttttccagtccactcttacttgagaaaaatgcaaaacatcaaagacacagaaaaaccaccagtctatacagcttgcccatactaaattgttattcatttcagaagagtgtacagtttctttctgtaagactctattaaaccagttactctacaatagcaaacattttaggcaaacctaaccattgcttcccataaagatatttatatctttaagtggtatctgattcatccctaagaaatatgttatcaagatgtttgtttgtttgtttgtttgttcatttgtttttgagatggagtttcactcttgttgcccaggctggagtgcagtggcatgatctcggttcactgcaacctctgcctcccggttcaagcgattctcctgcctcagcctcccgagtagctgggattactggcacccaccaccactcccagctaattttttgtatttttaatagagacggggtttcaccatgttggccaggctggtctcaaactcctgacctcaggtgatccacttgcctcgacctcccaaagtgctgggataacaggcatgagccattg

SEQ ID NO: 168142 - DNA, 1039 bp, Homo sapiens
cctttagaaattgaaagaggaggagaggaggagagacccacagttgatctctgagaagtgagtagctggaggcaccaggataccagccaagcctaaaggataaagcaaatccctggacatggcttttgattccaagctaagaagtgcaagaagctcttccaaatacaactgcaactgccaagagattgatggaccagagaatggcctcttcattccaggcacttctaaagtccaagtggtcaaataccagcctctttttaccaatgttcccacctgtttcattcagccaaatttcattagatgaaggtttgaatggtgaagaaatgatggacgctgtttgtctcaaacaaggactctaatgatacaacagaacaagtcacaagaaagcttgcctggaaaaccatacactggcctcttcgtggtgaagtccttcacaatccttacaaacatagaaaatattcagcaattcgtttgtttgttttccagtccactcttacttgagaaaaatgcaaaacatcaaagacacagaaaaaccaccagtctatacagcttgcccatactaaattgttattcatttcagaagagtgtacagtttctttctgtaagactctattaaaccagttactctacaatagcaaacattttaggcaaacctaaccattgcttcccataaagatatttatatctttaagtggtatctgattcatccctaagaaatatgttatcaagatgtttgtttgtttgtttgtttgttcatttgtttttgagatggagtttcactcttgttgcccaggctggagtgcagtggcatgatctcggttcactgcaacctctgcctcccggttcaagcgattctcctgcctcagcctcccgagtagctgggattactggcacccaccaccactcccagctaattttttgtatttttaatagagacggggtttcaccatgttggccaggctggtctcaaactcctgacctcaggtgatccacttgcctcgacctcccaaagtgctgggataacaggcatgagccattg

SEQ ID NO: 168143 - DNA, 721 bp, Homo sapiens
aagaaaaggtctggctgttctgtcaaaactatttagttcaatattgttctcaatgtggcaccatagccctggacatgacacccagcacgtccaaacagacatgattatatatgagacagaaaggcacttacatcactgcgggttgttatgctttaaagggctttttcccccctcttcaaattaaaagttttcaaaaatgaaataaaaataaacctttgaagaaaccagattgagactgaatttggaaggccctcctgcctagtgtatactaaagaaacattttctgggtttgtccctgatgattttccttgtagttgagaaacacaatccactggaagcttttgtggcagaacaagaattttatgaacacgaactttacaaagacttccctaggagatttaaggtctggaaatcaatagatcaatcagcagcttttatcaatctataatggttctctctctttggatgtttggatgaaaatgggatcaacgtaaattgaacatggaatcacttattcttacaagttaaatttgtcaaactgtaaggcacataaatgacatgaaatgtaatcatttttgaatttgggaccctacagggtgcacgttgattgaagaaaaaacaagcagatgttgcttcagcataactcatagaggcaatctaaatgttcttcaatccctgacacttctgatcgtttcccaaataaaccagttcattagttaat

SEQ ID NO: 168144 - DNA, 187 bp, Homo sapiens
tgctctgagccttgtctatagaatgaagggtgggtgctgtgcatggcccctactattactcaaatatatgtagctactgcagggattgttaaaccagagtgttggtgaatttatcatagctttttgttacagaaggtttttttccttaacagatgacaaaaagagaactacattttttttagtgttg

SEQ ID NO: 168145 - DNA, 283 bp, Homo sapiens
tggtccaccaagctcaggataaagcagatttgtggaatttagctttgactccaaatcccgtgtcagttactgtcacggggaaggaaaaaggaagagtgaaaaggtctacaaagtaaccaattcagttacttagcaactggacaaaacttgcctcactacagagggtaaggaggcatctcacacccattcaaagagtaacagtctacaatttacatgcaaatagataaagaaaaaagggaacgggaaatctaaattagcaactggagtttagacagtgagactg

SEQ ID NO: 168146 - DNA, 306 bp, Homo sapiens
cctgaggacatgaaatattttgggttgtaccttgatagatagttaagggctattttattctctttaatattctctttaagcatacactgacttcgaattgaggcagtctctttcttgctcttattctttcctctctctctctctctctctctctctcacacacacacacacacacacacacacacacacatgcaactcacagatttctttaagagtgcagtgagtggagaattgtaaatgcagcagatactaaagaatgtgttatttggtattggactgcattatgttgcagatgtttgttactaa

SEQ ID NO: 168147 - DNA, 321 bp, Homo sapiens
atagaggacccgacggctcaacggaactttgtcgaatgttttctgcagtttatgatacctaaaaatgttttctcaagtataaaattttaacactgaatgtgctttttcaaataatgagtttctcttagagactctgatacaaacttcctcatcagaaatcttgagttaagacttcaagctcctccataataaaagagagcaaacacatacagaatttctctttggtctcttgcagttacgtcttcttttaagggtctcagaaaaataccgtcaaaaaagttaaagctgaaagttccgttgaagccgtgtaatcccagctac

SEQ ID NO: 168148 - DNA, 201 bp, Homo sapiens
gatatcctggtctccagacaatactttactaaatgaaatgacaattataaccaattaaaattcactttacatactacttcacctatttggtatgtattatgcatgaagacagagagtacattgcctcactgctcaggatttctgtgtgtctcagaaattgatggacagctccaagatcttccttttagtgcattttccccc

SEQ ID NO: 168149 - DNA, 524 bp, Homo sapiens
ttgagccccttgacatttacaatagctggaagagctactttggtgaaactccaaaaaatgtgaaattcttttcttgatgaaagagatccaaagcctgtgctagggctgacagcaaggcagagggagcctagaggagggttgttatggggctggaagcagggatgaggatgagacccagcaagcggacactaagtgcctgcactctgctttgcagagaagagaagggccagtagctgccttccaatgggcaaagaggacaactcagtgtgggtgtggggtctgtatctggtgctgctgagtgcagatgaagggggagcttccttccagttttccttgacatatataaatatgggacagacactcctactctggagatagctgaacaaaaatcaaggcgcatttagaactgacacgctcataattgcactgtattagtctgttttcatgctgctgataaagacatacccgcggctggataatttgtaaagagaaagaggtttaatggactcacagttccacatgac

SEQ ID NO: 168150 - DNA, 101 bp, Homo sapiens
tgaatttcttctcttattgcacttagaattttcagtgtgtctaaaaagagtggtaagaatggacttctcgtccttattcctgatcttaggggcaaaacatt

SEQ ID NO: 168151 - DNA, 163 bp, Homo sapiens
tgatcccaggcagagacaaaaccgtgtcttcaatgatcagggagcacatgtaagtcgccaacgcggtgacataaatcgcgttctcagagcctcgcaccaggacgcatggcctgggaaggcacgcaaagagttaaaagcagaacctttccaggaaggccagcct

SEQ ID NO: 168152 - DNA, 375 bp, Homo sapiens
taacatattttatcagagactgtgcacaaagggcacttttaggtagcttcattctccacaggttctatacataaatcatgaggtgttacgagaatattggtccaggaatcagaaaagtgtggaatttacaatcacctaaagcaatatgactttaagaaaatctgttacctcccatcatctccctttcccatctgttaacatttggtggtgatagatttagatgagttgacattgttagatactttctattataagaggttgtctttggtagaattctatgattctaaagtgctgtgactacaagtgtggacaggtgtaatcactttacctctacactgcccgctgcatgctgacactgcctttcatatggtgggc

SEQ ID NO: 168153 - DNA, 545 bp, Homo sapiens
gccaccatgcctggctaattttgcattttaagtagagacagggtttctccatgttgctcagactggtattgaactcccagcctcaggtgatccgcccaccttggcctcccaaagtgctgggattacaggcatgagccaccgtgcccggccaaagcctcgtcttttctccacgtctcccccggagacccctgcctgggacagctcctgcttctggtacctgctggagaccctggccagggcctggctctttgagaccactgtcactgtcccctcccgccccttgtcactgaaatgcccggcctgtgccaggagagagtgagggtgtgctgagggcatagggcaacctgtgggtgggatgactgcccccacgtcctaacaaagccagcccccaaagcactgtggccatctgagtgggcacagtgccctggcccccctgcctccccacacctgaaagcccaaagcctaagaccagagagtcctcaaaggaaggtctttgctgccacagccctaaatctcatcaaggtagatagtcagagtcagcacct

SEQ ID NO: 168154 - DNA, 607 bp, Homo sapiens
cgtcgcccatactctgtgtttgataagaaaagtcaatctttgagtggtaattgaatgggtaagaaacgtttctgaaagttttcacatccctaaaaacattttgagaatgcttatctgaggccatccctgaatttttagccccagagccaccaatttggaattttctgtgtatacttaagtttaccttaagaaatggtcacttcctttgaagtggaaaatctcttaagatctcctgcttctcatccataaatcctttctcagcagagactcatggatgggctagaagctatattcagtcatctttagaagcacatgggatattgatcaaaggggtggggtggtgggaaggtgaggggtggttgagtgtactccttgggtgtcatggctgggatctcagtgtcccttcttttctgcttatttgtacttattgagaagtctgtcttccattttctccttccccatgaacaagtgtgtgaattatttggaggcaagttgttttttttttaaatttttactgccctaactttgactgtggtgcttcacacatgtgaatgcgcttgggttgaaattttattcgttttaccattagtaattatttgaatcaaag

SEQ ID NO: 168155 - DNA, 420 bp, Homo sapiens
catattctctgaatcaatccattaacacagcataaggcatccaggaaataatggctgcaaacaagcctgggagccagaaagaacggctttggtgggtgtactggtgtggagggagccaagaccagtaagaagcctaaggtcacagagtctgcaccaggatctcggtggtgggagtaacagagaagagctgggtctaaaagatgtcaaggaatgaaagtccatgggatttaagcatgtgacctcacatgagttacttaactgctctttttttttcccatttgtaaagtgggatgtgggaggcagaataatgtccccccacataggtccatgtccttatccacagaaactgtgaatacgttaggttacccagtaaagtgttggataaaggaattaaacacttagggaaaataagaatataga

SEQ ID NO: 168156 - DNA, 611 bp, Homo sapiens
ctttaagtttcaggatacatgtgcagaatgtgcaggtttgttacataggtatatgggtgccatggtggtttgttacacagatatacctgtgccatggtggtttgctacacctattgacccatcctctaagttccttcccctcactcgccacccgctaacaagccctggtgtgtgttgttccctccctgtgcccatgtgttctcattgttcagctcccacttatgagtgagaacatgtggtgtttggttttctgttcctgtgttagtttgccgaggatgatggcttccagcttcatccatgacatagcaaaagacatgatctcattcctttttatgagtgcatggtattacacgtattttaatagctttgaaatttatcgatttcaatttacatttattgagtactcactatgggtcaaacaccatgcttctttaccaggggtacaataaacagagccaaaattttatttaacttgtatatacaactttactatcaacattagccattgaggtgtaaaaataaagaagcaatttgtattaaaagtcaatttccacataatcacgtcttataaatgccatttacttttattatacataactcaggaaggtgag

SEQ ID NO: 168157 - DNA, 556 bp, Homo sapiens
cagtcttgaactcctgggctcaggtgatcctcctgccttagcctcctgagtagctggtaccataggcacacaccaccatgcccagctatttttttgtatttttagtagagacggtgtttcaccttgttgcccagctgctctcgaactcctggagtcaagcagtctgccactttggcctcccaaagtgttgggattacaagtgtgcgccaccgcaccccctgcttgaaaggacttctgaatggacttagcagtgattatttgaataccacagttgctgtttcctctgaatccttgaagcctttgtagaattgacagtacaaaccatagttctcccattcacagttttcatttggtttccttgccgtgtgtgggttaggcatcttctgagggccctatgtaggtaggtgttgcaggggaatggatggccgtttttaataaagaaataggatctgggcttcattgttcctaagaaggggctgtcttctcaattcatttgtctcctgggtttatctgataattatttctttccttcagagaggctaattacttttcatct

SEQ ID NO: 168158 - DNA, 199 bp, Homo sapiens
ttgcaacctgccctgaggagtattctcagatctgtttagagtactcttgggaagaaatatcttagtccagatctcccatggcaataacctgcctataagatgtgcaggactggcaacatataatggggctgaaattgcatataacctacaactcagtgtttccactcctagactcacacatgtccatagggagacatgt

SEQ ID NO: 168159 - DNA, 285 bp, Homo sapiens
actccttaccatgctgccacatttaatatgctcctcagccttcttctgatggatcctaactcccccactgtcttccactgtactttgatcaagacgtctgacaaaagaacagttccctctctgaactctactaaaatatacacaccgtaatgaataatttctccaggaaaagaaaggaaataatagttcaggtgaagtttgtggtcacatatggaaaggaaagaaaaaccaggctcagttccagaatgtctgtgtgtcagagtgagatatgtatgtataacgcat

SEQ ID NO: 168160 - DNA, 1064 bp, Homo sapiens
ttcaagctatccggttcaattggttcagatcccttttgaatgagaaatatatgttaacgcattttttgagtgaataatgttttgtcgtggaatgtccatctactttaataggaccaactgttgtcaacagaattactttctacatctgtggaaaacaacatctatgctaacaaaaatcaaggtagcaagtctaacgaaatcgaggctaaataatttgagttctttatgtaaacatatttatgggaaaattttgttgtagattcttctgttaaaaagaatctaataaatttttataattgctattgaaccgggaagtgcacctctgattatgatccatgcattggagtcagctgcacatcaggaagttgcttatctggaggtttcattgcctgttacttggagatacgaccagtgtggcacctcctctgttggtcttcattgccctgtattaccttcaagcattttatatgacttcatggattatcttcttaattattcctatggcacatgttacacctaaccctctattttagtgacagctcttgctctgtctaaccttgtggcagtataattgtttttcatataattactttattcacagataatagaatttaatgtgatataattaaatcctttgacaattataacagtttttaaagtgaaaatattttatttaaatcttgggtctgcagtttattttctagatatctatgtattaatccaacaacgttattccattgaaactaaaagaggtgtgcagagtgtgccacttttaccatgtaatggtttttttcacaatttcttaatatctggtaatctctggttcatgcttttgcaaagaaacacattgcctaaaatacatatttttaaattattaacttcagtgatttaagcaccgggtaaattctatgcctttagacacctatgaactagattcttactgtctctctgtaaaatacatatagagtatttttgattttcagcagttctataactgcttgatgagtagatgttattcccataacatctgtctcatcttgtctttggtgattctaatgacacca

SEQ ID NO: 168161 - DNA, 431 bp, Homo sapiens
cgctgaggctgtcatgctgggcagctcacccaccaggagaggagctttccgactctttttggcattgtctcacgaattacagaagccccctttcgatcatgttttgaagccccttgtcctatcactaagataaatgaatgctggtgtttctaggtagcttctagctttatgttgctttgggtagtgtagtgattatttttatgtataagttcttaatgctagagctctcttgtgagcatgattaaggaatgtgctttcgccttaacaagttctatgttggagatgcaggttggaggttgatcctgaacaccttaagtggatgcttttttattctggaaggagaactgtctggaaataaaattccttatatctaatggtatttcttaaatgctgtttcaactaatggcatttggagcaatgactgtacaaaa

SEQ ID NO: 168162 - DNA, 439 bp, Homo sapiens
aaaatcattattttggaaaggaagaaaaaaatcaactgccttatctactattatattattacatcaagcaaagccatttccatagcaaaagctatgtatccacaaaaatatatcaaatgtttgaaagtataaatcaagaagaaaaattatatgtaagtctgcaaaatttaaaaaggaagtgcaggattgagggagcaaagaaaatatctcacaaatttggctcaaaatactttcctttggtatctgaagcatctgaaacctaatagaaaatcttggcttctagaaaaaaggtaaactaaaagtttaggatatctccgtgtatttttagctgtttgtcagtaaattatatagatgaatataaggcattccaaagcattggtgaaaagaattatatggatagttgtggggttttaaaattgaagaaaatctatctgctaag

SEQ ID NO: 168163 - DNA, 393 bp, Homo sapiens
tcaaaagaaaataagttatcaaaactatcacagacacatcccgagcaaagctattatgagataaataagaataaggagtagaataacatccatacagacagtaaaatgatgccagaaagtcaggctgaccaagcagatcaaattttatctatttcaaaatgagttaaaagactttgattaaatgacataagataggaaagaacaacaaaactcaaacttataaaaattcagaaatgaagtgacagaactcagtaaagaattagaaataaaagaaaaaaaattaataaagactattagaagacatataagaaaaattaagcacaatagataatgcagtaagagaaatagaaggggaaaagaagaaaaatattttaaaaccaaaaaagaagtgta

SEQ ID NO: 168164 - DNA, 262 bp, Homo sapiens
gggacacagaggtgccgccatggatcaccaagaggttcaggactggccagagggaggagaagaggtcaaggtacgtgtggggcacttggatgacgcatctgtgcctgcacacagctgaaatccccaggaaataagacgggagcagggtgggtttctgcagccgaggtgagaccaaaatgccagctcactgccaccctcagtaaagactaacttgccctttcccccaactcccctcccagaagtagctcactctcctctgcct

SEQ ID NO: 168165 - DNA, 151 bp, Homo sapiens
ggttttgagcagacaggaaactgactttgctgacccctctggctgccatgtggtgaaggaaccatggagtcgataagaagctgggagaccagtaaggaggctgttaggacaatacaggcaagaaatgatactggcttggaccaaataatag

SEQ ID NO: 168166 - DNA, 256 bp, Homo sapiens
ttcacataccataaaatgtacccctttacagtgtacaattcagtgatttttggtgtattcacaaagatgtgcaaatatcaccactaattccagaatatttaatcacctcaaaaagaacccccctgacacacacacccagtagcagtccatgccccacttccccctcctgccagcccttggcaaccaataatctactttatgttcaatggatttgcctattctgaacatatataaatggtttcgtgcaacgtatggc

SEQ ID NO: 168167 - DNA, 415 bp, Homo sapiens
tttaattgactcacagttccacatggctgggggagcctcaggaaacttacaatcatggcagaagggaaagcgggcatgtcttacatggcagcagactagaggtgaagtgcgaacataggaaaaactgccttgtataaaaccatcagatcttgtgagacttactatcacaagatcagcatgtgggagactgcccccataatccaagttcctccctagacacatgaggattacaattcaagatgagatttgggtgggtatacacagccaaactatatcaacagccatatcagaagtcttaaaaagtccatggaaattgtgtattatgaaaaactatgcatggatttcaaaatctttttgcaccaaaataaactggtactaattcattataaaatatctcaacaggatctagtttgag

SEQ ID NO: 168168 - DNA, 657 bp, Homo sapiens
  misc_feature (44)..(44): n is a, c, g, or t
tatctatcacctattggctctgtctctctgaagaacctgactgnaagagtgacatttaaaaatgtagtcttggcgggcgcggtggctcacgcctgtaatctcagcactttgggaggccaaggcgggcggatcacgaggtcaggagatcgagagcatcctggccaacatggtgaaaccctgtctctactaaaatacaaaaaaaattagccgggtgtggtggcgcgcgcctgtagtcccagctactcgggagcttgaggcaggggaatcgcttgagccctggagaccgaggttgcagtgagctgagatgacgccactgcactccagcccgaatcacatttttctttctaataaagagactaattctcgctagcatgaggtgggccacttttgaagaaccacagatgtaataaatgaataaataacagatgtctgatcccaccttcgtggttctgtccaccatgtgttttgtttgtccataatttcctatgtgtattagttgcgagctgatagaaatgtttcctcattgggcatgttcttcatacagcttgttttaagccatcagacacagctcgagattgatggagagcctgaaaatgacaacctcatgatttagttttacttgaatatcagtcttccaatattaaatgtattttctac

SEQ ID NO: 168169 - DNA, 210 bp, Homo sapiens
gggaaaaaaattatgactaagtcttcaaaagcaattgcaacaaaaacaaaaattgacaagtgggacctaattaaagagcttctggacagcaaaagaaaccatcaacagagtaaacagacaacctacaaaatattcacaaatgatgcatccaatcaaggtcgaatatccagaatctgtaaggaatttaaacaattgaacaagcaaaaacca

SEQ ID NO: 168170 - DNA, 535 bp, Homo sapiens
aattatggacaaggccgggcacggtggctcacgcctggaatcccagcactttgggaggctcaggcaggaggatcacttgaggtcgggagtttgagaccagtctgaccaacgtggtgaaaccctgtctctactaaaaatacaaaaattagctggtgtggtggcaggtgcctgtaatcccagctactcaggaggctgaggcaggagaatcgcttgaacctgggaggcagaggttgcagtgagccgagatcacacctctgcactccagcctaggtgacacagcaagaccccatctcaaaaaaaaataataataaaaacataaaaattatggacaagaaaaaacactattctggaagctttgttttggcaacaaattatatgacctgacctttcataagtcatttaaactttagggctaggccaggtgctatggcgcatgcctataatcccagcatttagggaagtagaagcaggaggatagcttgaggccaagaattccagaccagcccaggcaatatagcgagacccccgtctccac

SEQ ID NO: 168171 - DNA, 317 bp, Homo sapiens
tacacgatgcagggttagaaaaaaagacaccgctccaggtacagacagataaatacagtgaaaatgactgccgtggaagaccagtgaaatgtcaaaagagggtatgaaaagccctggcgacagcaacattttaaggataagaagccctcaaagggaattgggaagtcctaaatgtaacagagcaacagggcaaggaaatagctgaaatgacccatgctgaggtcacagctgcttatggaaagaaatgaaactaagaggaaactgacaatcagagataaaaggagaaggtcaagaaagcttctgcagaaaaccaaata

SEQ ID NO: 168172 - DNA, 187 bp, Homo sapiens
ggcaactacagaccaatatagatgcaaaaatctttaacaatatattatcaaattgaatccagcaatatataaaaaaggataataaccttttttaaaagatgtgaatacaggttggctaaatatttgaaaaaccatgtaatctattatatcagtaaactgaaaaggaaaataataacaagatatatga

SEQ ID NO: 168173 - DNA, 544 bp, Homo sapiens
caggagcacagaatgatgaaaaagagggtgaaggagtggccttagaaggatgaggaaaataccttgtctccctgtcttccctatcttctttacgtttctctccaaccgtggcctcttctctggacagactccctttgaggtatgggcagttctgaggcatattcacaagcaggagttcctgtggagggaactctaaatcaggcccttggggtaacaggttgggaatgtaaaagtattcagcccagaatgtgatactgtctttgatgcagggtaggcaggccccaaagtggagtttagcccactgggttcttggctttgtccaagaaagaactcaagggcaagccagaggtagaaggaaacagctttatcgaagagacagtgttacagctctatgactgctcctgcagagcagggctactgagtaggcagaaagtagcagctcagggcagttttgtagtcatatttatacccacttttaattgcatgcagattaaggggcagtttatgcagaaatgtctagggaagatgtagtaatcattgggtc

SEQ ID NO: 168174 - DNA, 306 bp, Homo sapiens
tcctgcttttagaagcacacagacagataaccactgtgcagcaaagtaagtgctgtcatggagttaaacggcacatgcttctgtaggagcataaaggagaaattgcttactgaagagcaagggagcagggtagaaagagatgtcagcagagctgagtcttgacatttgtataggtgttttcttagtttggaagtatattccaggtactgggaacatgtgtgttgtctccaaggaaggagatagcatggcagatttaagaagctagaaatattttaatgtagttggcagatgaaatacatttggggg

SEQ ID NO: 168175 - DNA, 276 bp, Homo sapiens
ttgcaagtccaaaatattgttatgaacagaatgcaaataaagtcttaaagttatgaggtgatatggtattgataattgactttaatttaaagagactggtaaaggataggtatgtgcttttctaattgagagtccagaaggtagatatatggttagagaatctcaagggagaaactagccagctcttctctgccttccccaaagttagatcaagagttcgtattaaattacatatgtgatgatattaagacattaataacttttggggtgtgtgtg

SEQ ID NO: 168176 - DNA, 499 bp, Homo sapiens
agaattttcaacttgcagtaccccaaggtaccttaagtcatgctttttcatcttagtgtccttgtactatgaactcttttctccttcttcacttaactgtctgctactcatcctttaagactcaatttatgccaaggatctggggagaggtagaaatgaataggtaaactacagaagatttttagggcagcgtaactattctatactataagggtggatatgtgtcatcacacatttgtcaaaatccatagaatgtacaatacaaagagagaaccataacgtaaactacagactttgtttgagatatcatttcctctgggaagcagttcctaaccatcccaaatttgtattacattctctttctctgtattccttgaatatcaagtacttacgttcccattcattcatccatggacgcttgggttgcttccctgttttagctattgtgagtaatgctgctgtgaacatagtgtacaatatctcttttgagccgcatatc

SEQ ID NO: 168177 - DNA, 652 bp, Homo sapiens
agaattttcaacttgcagtaccccaaggtaccttaagtcatgctttttcatcttagtgtccttgtactatgaactcttttctccttcttcacttaactgtctgctactcatcctttaagactcaatttatgccaaggatctggggagaggtagaaatgaataggtaaactacagaagatttttagggcagcgtaactattctatactataagggtggatatgtgtcatcacacatttgtcaaaatccatagaatgtacaatacaaagagagaaccataacgtaaactacagactttgtttgagatatcatttcctctgggaagcagttcctaaccatcccaaatttgtattacattctctttctctgtattccttgaatatcaagtacttacgttcccattcacttatcaaatggtactacttatgtttcttcctctctggacttgagctccctgaggtcagggactttcattcctctctctctcttttttttttttttgagacagtctctcactcccaggctcgagtgcagtggtgtgatctcagctcactgcaacatctgcccctagcgttcaagcaattctcctacctctgcctctcgagtagctgcgattacaggaaagtgccaccatgcccagctaatttttttttt

SEQ ID NO: 168178 - DNA, 437 bp, Homo sapiens
agagatgtgccagcaagggactcagcgagacggcgacacaaatgtgccgacaaacatatacagagacagacagagataacccaggcaaaggcgcggacttgaggcgacaagctcctggtgaatacccggacccagcctcgccgtcgcccccgtcgtccagcaggggtcgctgttacccagcgaccgcgccctccgggaccttggggccagatactggccaccaccccttgggaagcccttctgtcccccagtgccaagactgggagttcggagggctcggacactctcctctccaactttgggaagcatggtgggtttggcctcacctgtgtgaacatggaggagcggcgagggagctgaaaagcgctttaactgcccccctctccaactaccagctaatcgctcctataaatacagacggcctggcctggcattaa

SEQ ID NO: 168179 - DNA, 180 bp, Homo sapiens
catacatgtgcatgtgtctttagaacaatttatagttttttgggtatatacccagtaacaggattcctgggttgaatggtatattagtttgttttcacgctgctgataaagatatacctgagactgagactgggtaatttataaaggaaagagttttaattaactcatagttccacatgg

SEQ ID NO: 168180 - DNA, 273 bp, Homo sapiens
ttggtgactgttgaaagtgttatgcatataaatttgaaagtggaataggatagactgagattatgagggaagactgtcttaaaatgaagtcatgatcaatgaagtaaaagctggcagatagtaataccgctaaactcttgggtcagtccttgcctgaagcctgagaggaattctagaccttcagattcataagccaatgaatatgctatattctgtgtggcaattttagttatgtttttattacttttacaataaagtatcttaacacatatg

SEQ ID NO: 168181 - DNA, 522 bp, Homo sapiens
gccctgtaattattttgtatcatcttcattgaaataacacttattaggaccttatttcatttgcagcaacacaagtcagagtgttctccaaagtctcacattataactctcagttcaccatgctgtgtgtgagctccttgagagtagggcttacatctcagccatctttgcatacttcacactaggacgttgtctggcacacagtaggcatataatgtttgttgaataaataagtgaattaaatttgatacatatgactagctctgtagtagcttctgttgtataagttatgatataggggttacccaaactgcaaaaaaatgaaatgtacatttgtaagatattgtgtttaaatggtttataactaggatgatggaagttgtgaagtcacatgaaaagctaacagatgtttgagtggcttttaaaaatagatttgcaggctatggagggcacactgaagcctattttcacgagtatactggctagttttgttcccaagctttctactgcccccaggggact

SEQ ID NO: 168182 - DNA, 514 bp, Homo sapiens
tgcctcagcctcctgagtagctgggattacaagcatgcaccaccatgcctggctaatttttgtatttttagttaagacggggtttcaccatgttggtcaggctggtatcgaactcctgacctcgtgttccatccgcctcggcatcccaaagtgctgtgattacaggcgtgagccaccgcacccggtcaccctcaatttatttttaaactttatttttataaatatatgtggttcaaagataattttgttacatgtatacattgcataatggttaaatcatggccttagggtttccataacaagaataacaaatattgcatttactaattaatgtctaactcttaattccctcccacccactcactcttccaaggcttcagtgtctatagttctcccctctatatctatgtaaacacattttagcacctacttattagtgacaacatgttatacttgactttctgtatctggcctttgtcacatagcatattatctgtcacatccagttccattc

SEQ ID NO: 168183 - DNA, 107 bp, Homo sapiens
gtctggcgtttagcatctttgtacagagccagtctcagtggatgtagcctcaggactgtgcagagaaaatcacctggcttattcagaagggcattaaggacagcagt

SEQ ID NO: 168184 - DNA, 269 bp, Homo sapiens
ttctgctgacttcaggctcagtttgttcttctagttccagtttttcttaaaaggtctaggttactgatttgaggtcttttttaatatagcatttatcactataaattttctaagaattgctgtaattgtaccctccaaaacctttgatatgtttgtcttcattttcattcacctcaaagtattttctaattaacctcatgatttctttgacccattatttaggagtgttaatttcaacatatttgtaaatttctcaagtttctttttag

SEQ ID NO: 168185 - DNA, 120 bp, Homo sapiens
ataaaaacacaaaacaaaacaaaacataagagccagtgttcatcaatgatcagcaaattagtagattaggtaccttgttgaaattttagtttagccttaatggcgtctataaattaatag

SEQ ID NO: 168186 - DNA, 440 bp, Homo sapiens
tacacacctacatatacataccataacacacacacacacacacatatacacacaaacacacacatatatacacacaccatatatatacacacatatatacacatccacaccatatatacacacaccatacacacacatatatacacacaccatatatatacacacatatatacacatccacaccatatatacacacaccatgcacccacatatatacacacaccatatatatgcacatatatatatacacccacaccatatacacacacatacacatatataaacaccatatatatacagacacatatacacacccacagatagacacacatatacacaaacatacacacaattatatcacaaggtctgattgtattactgagacacagtgaaaggatgttccataacaggaaggttatgcctgatccagtgagacagag

SEQ ID NO: 168187 - DNA, 650 bp, Homo sapiens
atacacaccatacacacatatacacacacataccccatatatacacacatatacatacctacatatagagacacatatatacacaccatacatatacaaacacaccccgtatacacacatatacacacctacatatagagacacatatatacacaccatacatacacacacaccccatgtacacacacatatacacacctacatatatacacaccatacatatacaaacacaccccatgtacacacctacatatagagacacatatatacacaccatacatacacacaccccatgtacacacatatatacacatccacaccatatatacacacaccatacacacacatatatacacacaccatatatatacacacatatatacacatccacaccatatatacacacaccatgcacccacatatatacacacaccatatatatgcacatatatatatacacccacaccatatacacacacatacacatatataaacaccatatatatacagacacatatacacacccacagatagacacacatatacacaaacatacacacaattatatcacaaggtctgattgtattactgagacacagtgaaaggatgttccataacaggaaggttatgcctgatccagtgagacagag

SEQ ID NO: 168188 - DNA, 439 bp, Homo sapiens
taccccatatatacacacatataggcacctacatatatacacaccatacacacatatacacacacataccccatatatacacacatatacacacctacatatatacacaccatacatatacaaacacaccccgtatacacacatatacacacctacatatagagacacatatatacacaccatacatacacacacaccccatgtacacacacatatacacacctacatatatacacaccatacatatacaaacacaccccatgtacacacctacatatagagacacatatatacacaccatacatacacacaccccatgtacacacacatatacacaactacatatatacataccatacgtatacaaacacaccccatgtacacacctacatatagagacacacacatatacacaccatacacacatatacacacacac

SEQ ID NO: 168189 - DNA, 292 bp, Homo sapiens
  misc_feature (17)..(17): n is a, c, g, or t
gactgttatggtggtgngtcgtatggtggtgctgcactggtttttttcacttggatgtgcctcaagacccataaattcaggattgtcagatgagagctcatcatccctctccccaaccccaaattcttcctcctacctttccagtcacctaaagcttccaccatcatccagtgatgcaagctggaaatctggcagtcaccctagactctcctctccaatcatcaaaaccttattttaaggtttgaaaggcttcaaagatgtcctgaatcccagtttaagcaccaccaataca

SEQ ID NO: 168190 - DNA, 215 bp, Homo sapiens
aataattgtcatactttttgttttttgattcagcacttcctaacagtcactgagcttacaaagccatggttcatgatttccacaaacttactttttatttatctcctaaccaaactccagggaacctactgacttaccctttcctgagaacacaatatactttttaccccttgtcttttttatctttatgcgattgtttcttccacctaaactgg

SEQ ID NO: 168191 - DNA, 358 bp, Homo sapiens
tgggaggatggcctctgttaggagtttgagactagtctgtgtaaccctgcaaattcccatcactataaaaaatttaaaagttagccaggcatggtggcacgagattgtagtcccagctactcaggaggctgaggcaggagaatcacttgggcccagggggtcaaggctgccctgagccatgatcgtgccactgcactcgagcctgggtgacagaccaagaccctgtcactaaaataaaataaaataaatacagaaaaaaatgtactagacagggaaatgaacaccaaaatgttaagattaaaaattattaactcttttttattccttggtgaatttattgacttgtgttgaggatgtt

SEQ ID NO: 168192 - DNA, 757 bp, Homo sapiens
gatcatataggattgcctcgagccagattcgcacgagccatcaacagatcagacagcttgtactcacaggccaaggacacgtggaaagaggctcaattttctagatgggtggcaacagccatgatcttctgtcctctgggtccccacaagcctggatgaactcaagatctgactcagtggcacagtgaggagacctttgaggcctcagtgaccatccttggacttcacctctcacggctttcaggcagagaggccctcccatgcccacaacaggctgagcccagccttcctcggggtttgcttccaggcctgacttttactcccctttctaagtgaggcagccatgactggccacttcatgtgctcctggagaagggcttgcaccagccgttttcaggaaagtcaagcagctgttgactcctgagtctgggtgaatttgtgtgaagagcataaggcgctgtttcttaaccaaaacgcttcctcttgcagtgcagatgggatgtgcttctccacaggaggccccacggcttccccacccctcagaggagcgccgtgcgtgcgtctgtgtggaggattggcagctcctgcagtcggcccttggtcctatttggcgacgcctctgccttccccttaattatacagtcatgagccgccctggaatcacggcagctccggatggatcctggatgccagaatgcagcctcagcacggggctgcaggacaggagtgagcgaggggctgcagagccggcggccgc

SEQ ID NO: 168193 - DNA, 611 bp, Homo sapiens
acataaaccacttcccctaataaatcccctctcatatagcttcatctatctatctatctatctatctatctatctatctatctatctatctatctaactatccatccatccatcctattggttttgtctctctggagaatgctgactaatactccagattataacatggtgtcccagtacttccctccaccccaatggcagaggatgtcggagaaggctgagtaggaaaacccctgtcttcccacttcctagtgtcctagtgtcaagggagaacccacacccacccagtggtaatgagaaccccacccctgaatggggtagtgtcagagaaggattggttcaaccaggactttcaccaccactcagtggaactgaggcctcctcccatccggaccctgtcagtggagactgtgtggtgagcagtgagcagaggaggcattcctccctgtaccagccaggctggtatcagcgtaggcctaagggagagctcaaactcccaccccatccaccaataacgagatgtccctccaactgggtttcaatggaggcaagtagagatcctggacttccagcagtaatggggtggtgcccaccttcccccaccagaggag

SEQ ID NO: 168194 - DNA, 451 bp, Homo sapiens
tgtgccactgcacgctagcctgggcaacagagtgagactctgtctaaaaataacaaaaacacaaaaacaaaacaaaacaaaaaacctggaaagacaccaaaatgctaaattgtacacattttgtgagtaacaagactgtggataaatttttctcttctgttctctgttattttttaggtttttttaaagagtgtgtaaaaatttaaattagaaggcaattttaaaaagctctaaagcaatcttcaatctcctaagaatacttaaggtatttccttgtgtgaaaaactctagagtagtattaaaaaaatatacatattggctgggtgtggtggctcacacctgtaatcctagcactttgggaagtagaggtggaaggatcagctcagtcttgagctcaggagttcaagattagcctgggcaacataatgagacctcgtctctatttaaaaaa

SEQ ID NO: 168195 - DNA, 245 bp, Homo sapiens
ttggatgagggcctcaggaagcttctactcaaggcagacagcaaagggaagctaatttttccattttgtagatgagaaaactgggacaagaaatatttagcaatttgtctaaacctacaatataagaggtagatcccagattgaaacatacacagtctgactctaaagactctttgtatttcaaagaaagtagccccttggctctgatattagttgcagatattttaaattcttatttaaaaata

SEQ ID NO: 168196 - DNA, 438 bp, Homo sapiens
gctggaagtccagggtcaggtaagcagcacagtcaggttctggtgggagccctcacagggcggagagaaagctcagggttcttcatccccttatcagggcaccagtcccaacgtgggggctccacccctgtgacctcatccaaacgcagtcacctcccaaaggacccaccttgtaataacgtcacattgtggataatgggcttcaacatatggatttggggggatacaaatgttcagtccatagcaaagtgcttggcctgatggagtaagtgatgtttcctctttcctcctgggacagcttgacatcccagatgggaaagaactttattctcaacaatcataggagggaggagcatcatagaagggaaaagatacaccttcctggcctgaaaattgacatcaacaggacctctcaggggatacccaggaaatctattt

SEQ ID NO: 168197 - DNA, 525 bp, Homo sapiens
caacatggcacatgtatacatatgtaacaaacctgcacattgtgtacatgtaccctataacttaaagtataattttaaaaaataagtaaataaataaataaaaaaagaaacaattgctggctttgcaattctctttcctccaaaatcgccaaggcctcaatttactcattgctgaaaaaggacgactctgtatatttttaaatgaagagtgttgtttttacctaaatcaatctggcctggtatatgacaacataaaaaaactcaaggatagagtccaaaaacttgccaaccaagcaaataattatgctgaacccccttgggcactctcttaattggatgtcctgggtcctcccaattcttagtcctttaatacctgtttttctccttctcttattcggactgtgtgtcttctgtttagtttctcaattcatacaaaaccgtattcaggccatcaccaataattctatatgacaaatgctccttctaacaaccccacagtatcagcccttaccccaaaatctttct

SEQ ID NO: 168198 - DNA, 172 bp, Homo sapiens
caaatagacatgagctggggatttcccaggttctgagaaaagacaggaatataaatacattggacttgttgcacatgattatttggaaactatttgtatttacataagcaaaatattccatacttttacgagaagaatacttacttcatttttatatcacgtttttgcatac

SEQ ID NO: 168199 - DNA, 167 bp, Homo sapiens
gcaccaagcacagaaaggttaagtaacttgttgaaggtcccacagctactaagtaagtgatagattcaggctttgaatttaaataatctggctcactccagatttcatgatcttaattaccacaccacatttcatatagtaataatctgaaaacagaaggagaaaga

SEQ ID NO: 168200 - DNA, 349 bp, Homo sapiens
catctgcaaattactgccagaaaaaaaatctgcctttcatttctaaaaggcactctggctttggtcctacttctgctgattaagcagcatcttcttacagagaaggcagccaactcaaagagaaccctttcctctgtgtgccaggactcaactagcacagctaaagcatcatccaatttggctcttcagtggattccatctcagtatcagcttttacttaacaacccagagaaacacagtgacccactacctctaagcattgacagaataaatagaaaatgtttgtgtgtacataaagctaggaaggcactaaactaagatgctctaaacaggaacactcatacacagg

SEQ ID NO: 168201 - DNA, 313 bp, Homo sapiens
ttaagcacaatttttctttcttttaatgtttagcttgatgcagactctttgtaggatactaatgttgggatataaatgatgctttgtgaacacccccaaaatatttgagcaattttttttctcccttaataagttcacggtgaggtttcaaagagcaagagaacttagtttaagacatttcagtaactggaagatacttttatcatgctagggcagagcaaaagaactcggtacggtatacggactcatgcttgaatcatgcgcattaacgtgagtctttttttaaagtgttcattttcatttgttcagtttc

SEQ ID NO: 168202 - DNA, 921 bp, Homo sapiens
caaaaaaaccaaacaacaaccccatttctccttctggttgaatgattcatcaagaatcttggcccaagtacaatacagtttcagggaaaaaagactccagggaatgaagagggaacgtaatcatgccctttccgataaccccgttattaggcaacgcggcgcagatgaaattctccagggagcaagtgagtgaggcgtggcttacattttgtatactgagccctgttgagtgacttcacacctccactccctgttctatgccagcaaggtggggcagctggggtggcgggcgagctgagggtcacctcagagctgaggtcgaaagaaattcttacaagtaaaataatcactaacaatttttatcgtcatagatatggagttgttggtcttgagaggcagactgtgcaggaacaaaggctggcgggtggactgtggtgctcggatgctgcagtcccaggggaagagctgtcgtttcagtacccaccttcctttccctcctctggccacagaatactaataataataaagaaaggaaaagaaaagaaacttctcagagaggttcctagtggctaaaaaactcctggttctccaccccctgtgagtttacgacatctgcaaaacaagactgttaagatacagaaacaatataaaggcactgaaaaatgattcttttttttttctttttagagatggggtcttgctctgttgcctaggctggagtacagtggtgggatcgttgctcaccgcagccttgaacttatgggctcaagccaagctcccacgtagctaagacaacaggcatgggccaccacgcccggctcaaattactctaagacgctcagggaccctaccttacaaagcagttgatattccagtttgaataaatttaattgatttttttttgagtattgtcttttcata

SEQ ID NO: 168203 - DNA, 255 bp, Homo sapiens
tagtgagcatagtacccaacaggttttcagtgcttgcctccccctcctctagcactccccagtgtctcttgttgccatctttctgtcctctagaactttgttatcttgcctgactgaaactctgtatccacggaacaattccccacttcccctccctgaggcctctgggagccaccactccactgtctgcttctgtgattttgactactttagattcctcacgtacatagagttatgccgctcttgtccttcagt

SEQ ID NO: 168204 - DNA, 496 bp, Homo sapiens
gaagaggttgtatgtgtgaacctggatctgggccctaagaactgaaatatttggcacttgggcttgttaaaaatgattcttcctttattgagcataacatgaggggtcacattcaactttcagaaaagaggactcaggctccaattctatgttctgtttctatcctttaggggtagtttttcaacctcagaaaacattttctgagtttaggttgtattttgcttccttgaaatttgttttagttcagacatttcttagagaatttttgttgtaacaggatagagttggacttttcctgctaagaccctaatgataaggttgagtgtacagtcaaccttttatgttttaaggcataaattgaggactagactctgcacctgcttggggcttattaagaagtaaagaggctctgctgttcctaatcatcccatcagcaccaactttatcattctctctcctctcctccctcccagaagcagatcagaagactagggtg

SEQ ID NO: 168205 - DNA, 463 bp, Homo sapiens
tgttgggattacaggcatgagccactgtgtctgcccccaagtcctttttaaattaaatttcctttttatacatttcagtggcctgattatgtaattcttatcaatctagcagattcagtatattaatatggcaaacctaataatattcccttagatgtttcaatactattcataaactcagtaagatttcaatatagaagtacccatttcaaattagttataagaatgtacttaaaacagccacatactctaacacacttcaagtatatataagaccaaaaatatgcatagattccttattaatacagaaatataaatctatggctttgcttctttcaagcctttctatatgtaactcagttttactggattaggagatggatactgtacagttactgtcctagttaactgaggccactgtccagtcgacgcggccgcgaatttagtagtagtaggcggccgc

SEQ ID NO: 168206 - DNA, 448 bp, Homo sapiens
aggcaccccctagatccgtctgctgcattcccgggggtggagagctggatgagctcacctaatctgcaagcgtcatgacaaccaaggaaggagcccagacaagagctgagggaagatctgtgggttgaccaaagaatggagaccttgaatatcccattatggtgactgaagcggggaagggtatgatgaagatagtactttgggagaatcactccggcagcatcgaaggagggaccggaggcagagaagccaattaggatggcagctgtggcaatatctgggatgaggactcagataggggaagtagcagcgagaatgtgaatgcagaaaaatggctagaggctgagcacagtggccccagcattttgggaggccaaggcaggaggtctgcttgagtccaggagttccagaccatcctgggcaacatggcaagatgccatctcttaaa

SEQ ID NO: 168207 - DNA, 168 bp, Homo sapiens
gccacatagaagaggatgaatgggccctgggtagcagtggtggaggatgcgagggaagtcagaatccaggcagacctgggatggcgggacatgggagggggaggggaaggtgagtcaagaatgacctgaggcagagctgggcatgggctcacacctgccatgggctca

SEQ ID NO: 168208 - DNA, 604 bp, Homo sapiens
gtttatgtgtgctttgtttaaaaattagagacattttattttttcttaagtaacagaaatcagactttcaaaaaagctctttaaacctagactaacttatttatgacaattttgtcatatatttgaaagttaattttaggaaaattacagagccttttaaccaccctatggccagacttcagtgttgttctttttatttctacctcatttcatgttgagtcttaacttcgctgtctctctttatcatcccctacccctagtctgaatgttgaagaatgctaaagtatattttattgcttcattgactaaaactatgtttctaaaactatgaatttgcttaatgagtcagcaactgtaactataattaacagtatagtttttacaaccatagttttgtggtaaatgtgcagttctcagaatttaaatgtaaacgttcaatgaaattaaacaaaacccaaatcttcatgcaataggtagtatatatgtattcagtaagggtcaccaaacattaattgaggttctattatggttaacttttctactttgtacttagggataaaaagatgagtaaaattgtttcctgcatttttccccacccattccc

SEQ ID NO: 168209 - DNA, 650 bp, Homo sapiens
tcggtaccccattactttgtcacaggcaagtggcacaacttgccgagtggttggggctgtagaatcctgcacacccagaatcagaatccctgctctgcccctcactagagcaggtgtgctaactagacacatcatataacaggtcatctgtaaacacagggacaatcatagcacctgagtcaacaggccgtatcaccgtttaaatgataatgcgtgtcaagcatttagtccagtgcctgacacacaagtattcaaacatgatgactgctattatcactactgcaagcctagcactccccactccacactccacacggtaaaatctgttgacatttgtcacctgcgccagacaatgcactctttgagtttagactccacctaagtcaccttgacacccccagccccgaccatctcctaggtctaaacaacccatgttcaatatactggggaggaggtcatgagtcatgtgtcagaggcaaggtaggggccattcatgtcagattctctgctcgtcatatgaggctgagggggggacagaatggaaaacccttcactctcaacaaacattattaagcaaggacccatgacactcactgagctaggctagagtgcaagggtgcagagactgtgacaaagtgcatgggctgtat

SEQ ID NO: 168210 - DNA, 715 bp, Homo sapiens
catatattttattcctctgtgtaatgcaagtgtctcctaaacccaaacatactcaggtctctgtacattgaaatattgcagccctttatttctcctgggacacattcttttctctccactccctccactccttccatgctgttctcacctatggccaacactcaactcacttttatggagtttatcaaactaccaattcttccaagtgtttcccattttatgaaatatttcccaaaagacagcctctcctagcaccattgcctgacataccaagctctccactacaacttttttcacactagtgacacacacacacaaaatctgtattttattggcctcaccagccaaactcatgtgccatatttataaaataaacaaaatatcaaaattctgatgcctgctgctccttttctccttttaatatcttggagttttgtcctaaggatctcctacttgagaccacggaaagcagcactgttagtaatagaattctgatgttgatgccaagacattaaccatgtttccaacaggacactgacaaggccaacagaaacaaagtgtatttctaacaggatgtggccaagatcacactgaagctacttctgagttactgctgctttcttgcctagctgatctggcctcctgaacaaagattactgaaatgtccggtaactaaactgccccctcttcttgacacttgcatccagaggcttcc

SEQ ID NO: 168211 - DNA, 635 bp, Homo sapiens
gatcctgcggccatgctttgatctcccatctctctatccttcatgcttttcccgggtatggtggccgtgcccgggtctccatcgtctcggggtctcctcttacagtctgttctgcggggcttgccagtcttgagtgactgtctcgtccttttacaaacgtctctgactggcgaccatcctgtgcgcataccaagctctccactacaacttttttcacactagtgacacacacacacaaaatctgtattttattggcctcaccagccaaactcatgtgccatatttataaaataaacaaaatatcaaaattctgatgcctgctgctccttttctccttttaatatcttggagttttgtcctaaggatctcctacttgagaccacggaaagcagcactgttagtaatagaattctgatgttgatgccaagacattaaccatgtttccaacaggacactgacaaggccaacagaaacaaagtgtatttctaacaggatgtggccaagatcacactgaagctacttctgagttactgctgctttcttgcctagctgatctggcctcctgaacaaagattactgaaatgtccggtaactaaactgccccctcttcttgacacttgcatccagaggcttcc

SEQ ID NO: 168212 - DNA, 435 bp, Homo sapiens
cccagaagtggaattgctggatcatatggtaattctatttataattttctgcggaaccaccacactgttttccataacatagtggctgtgccattttacattcccaccagcagtgtgccagagtttccaatctcttcacatgcttgcgaacagttattttgtttgtatgtttgtttgtttttggtagtagccatcgtaatgagtataaggtgagatgtcatttggatttgcatttccctagtggcaagtgatgttgagcatctttttgggtgctggttggctattcgtatattgtctttggaaagacttgttattcaagtcctttgcccatttttaaattaaggaatttgtttttttgttgttgatttgtaggagttttttatagatccacatattaactcctcatcagatacatgatttgcaaatatttcctcc

SEQ ID NO: 168213 - DNA, 258 bp, Homo sapiens
atttctctagacaggattgcatttgcttctgtgggtatcttgattcagggttggaggtgggagggagttgtgtcccagtccagggccattgacttaaactgtagtcatgggttgaggttttggggaccacccagctaatataatttggggcagtaaatatgtattctttcctcagtcccaaggcaactctccttgggggctggagtgagggatagggtcccagcttaatggggagagactatctatcttggtggcttt

SEQ ID NO: 168214 - DNA, 1006 bp, Homo sapiens
ggagcgccgctggccaccgagcagtcatgctcttggaaatagccctgacagcgccctttgccgtccatctctgagtgacgcaccgtcagccgacctccagggtgggctgaacgacgtccaggacacgaccggagtcggggaccggaaacccccggccactgcgctgcctagcgcttttttctctgggcccttaggccctggactttcgaccgctgagggcacaggaagtggtggcacgctgctggcagatgcctcgcaagccctggtgtggtgggtgctggaggcacccgcaggcaccccggtggcatggtgaccttcgagcgggcacggacagatgggcctcaccctgggccatctgcttcctcccccagctctgtttgaaaggggacgcccaccggcaggtggtgggtttggcctcagtggaaatgcagtgagagccaaggccttttgcgataacatggagttatgggcaggggcctgtccctgacttgggccttaaggttagggccccactcccagcttcatctgcttgcctgaggttctgggggatagtgcacctgaacacctccctttctgctttcagaggtccccatagccggggaagaagtactgggtctggggggaccccatgtggtgctgggttctatcttttgttgtgacatgccagtctgacttccttctgccttttcccaacccgttcttatttctttcctctcaaggctgagttctctgtgaactaattaggtgacagaaaaaactcattaacgtggatctgagtaaatggcctgaatcaccgctgtggctggggactaggagatggcatttgtgcgagccctgggccccaaagacaggagatgaccaatttttcctcttagatctgaagagggtggaggcgggagagacatcgttgctgcagcttcactgtccttggaggaagtaaagacattcctgatttgctccaagcttaccttcccccagctccttctggagagcgacaagcctcgtg

SEQ ID NO: 168215 - DNA, 118 bp, Homo sapiens
tgtttcctttaagggaaagcattatagcagaaccacatccaactctagccccatagaaactattttgagacacacaaaacctaaaagctatttttgtcttgatctgggtagaatttat

SEQ ID NO: 168216 - DNA, 338 bp, Homo sapiens
  misc_feature (5)..(5): n is a, c, g, or t
gttanaatggtcaagtggaggggagaaattgatgatgtagggaaacgagagagagagagaaagagagagaagcagagtgagtttcttgagtaggcaagaggggatgggagtctgatggagaagtagagaggatgtccttagagaggagccctgacatctcagtcacttagctggtgggaaggcaaaggatgtgggtgcagatactggtaggtgtgcaggtgtggtggtgcgagcttgcaaaagttcccaatgcttctattttctttgtgaaataggaaccaagttcaccatggagagagtgagtgggttggggaaaaggtgttgtatgtttgaggagt

SEQ ID NO: 168217 - DNA, 164 bp, Homo sapiens
caagtttgattccaaccttgatctaacagacctggcttggttgagtatttgttggctgttagctacttttaccatcaaatcctgtgcttggccttcagcttgctctgcttggctacagcatgagatgaggattgttggcaagctaccacagagactctgcggct

SEQ ID NO: 168218 - DNA, 278 bp, Homo sapiens
tcagcagactaacaaaagctcattgtgacatgggagagaacaaacggaggagctgcagtacaatgtccaacagcgcaatacatagagagctgagtcccagaagagacagacacacggaagagctgtggtgcaatgtccaacagcacaaaacatagagagctgagtcccagaagagagagacacaatggaagagctgcggtacaatgtccaacaacacaatacatagacagctgagtcccagaagagagagacacatggaagagctgcggtacaatgtc

SEQ ID NO: 168219 - DNA, 319 bp, Homo sapiens
cagaacaatgatgattacctagctaatggtggaggggcgggggttacggaaagagaggaaaagcaaaacatcaaaattgcacagagggaaaacttagccaactaacacctgccagaagagactagagggtggggctggagtaagcaggttccgctagactcttccctagggaggctgctaaagcttcccaactctgaaggtctttgtgtgagaggtgaggggtgggtggaagtgagtgagtcctgcctgggaggcaaacaaagaaaggaaaagggaaaggcaagggtgcttccacttctcaaggtaacatacttgaatg

SEQ ID NO: 168220 - DNA, 399 bp, Homo sapiens
gcaaaacaaacctgactccttctcagattgacttgattctacccctacaaggctgcagcagtgaattgattctctaagaatttagataacttacttactatctgcaactttgtgagcttcccaatatctggcggcaggatttcaaaatcgttgtcacttagatagagtgcacacagggtggctgcaaattaaacagcaatatataaacagggtggcatggaacccaaccatttgaggtctgatcaatacgagggagtcagctttgattaataaccctggcttggtgaaaagcctttgacatacctagggctcccaataataacaagcaggtcaaacttacatttactggcttattgttgtggagctggtgtgtccaggaaaacatctatatccaagagg

SEQ ID NO: 168221 - DNA, 315 bp, Homo sapiens
ccgggggtcagggaccaggtggggatggggaggtgggtttggctataaaaggggtaacgagaaggattttgtgaggaggaaactcacttttgactgtatcaatgtcaatattccagttgtgataacacagtatagtttattaatataagttgttaccactgggggaaactgaataaagggtacacagcctgtttttttttcttttcactttttttttttttttgcagactctcttgctgttgcctaggctggagggcagtggtgtgatcacggctcactgcagcctcaacctcccaggctcaagcgatcctccca

SEQ ID NO: 168222 - DNA, 945 bp, Homo sapiens
agcggagcttggacagccacgcgtgcgcccaggccaggcggagggactgccccgccctggtccagtgattgatcagcagtgattactgaggctttaatggtccgcttggatgggaattaattctgggatggataaataatgcatcgaggtttatgtagtccaaggcgagccgtccgtccggagccaggagaggtagccgagggagcctgacgggtgacgccagcggccacggggccccgaacgagcaggacatgaggggcgactaggcgcgaggacgagcaaaagcaagtggatgacagcatgaacggccctgcggggctggccggacggctgcaagaacatgctgagcccaaagatcaggcaggccaggagggcccgctccaaaagcctagtgatgggggagcagagccggagccctgggcggatgccgtgccctcacaggctgggccccgtgctgaaggcgggctggctgaagaagcagaggagcatcatgaagaactggcagcagcgctggtttgtgctgcgtggggatcagcttttctactacaaggacaaagatgagatcaagccccagggatttatttctctacaagggacacaggtgactgaacttcctcctggccccgaggacccagggaagcacctctttgagatcagcccaggtgggtgctggggagcgggagaaggtgccggccaaaccccgaggcgctcctgctcatggccagctcccagcgtgacattggaggactgggtgcaggccatccgccgagtcatctgggccccgctgggcggagggatctttgggcagcgctagaggaaacaagtccaccacgagcggaagtatggcccccgcctggcgcccctgctggtggagcagtgtgtggacttcatccgggagcgcgggctcactgaggaggggctgttccgcatgccaggccaggccaa

SEQ ID NO: 168223 - DNA, 620 bp, Homo sapiens
atacagaagaaatttgcacagactgccagcttcattatgctgccgacagcttccagcaaaaggaggacgtttgcagccagatatttcacccgctccaaaagcctagtgatgggggagcagagccggagccctgggcggatgccgtgccctcacaggctgggccccgtgctgaaggcgggctggctgaagaagcagaggagcatcatgaagaactggcagcagcgctggtttgtgctgcgtggggatcagcttttctactacaaggacaaagatgagatcaagccccaggtgagaagtgcatgtccggtgtgccatgggcatcgtggcagggctccacaagagggaagaccatgcccaggagaagggaggaaggcacagagccactgactccatcacagtgatgttttgccaggatttccaaagtaattttcattcttatcccccatgttcctggtatcacagcctgttttactggaacatgtccacaacttctgcaatgaaaatgtttccttaaaatgttgatagagaatgtccttgtccaacttaagaaaacaacgtcttccatgttctttttggccccttcatgcttccaagaaggacatacatgcacgacatatacc

SEQ ID NO: 168224 - DNA, 874 bp, Homo sapiens
agcggagcttggacagccacgcgtgcgcccaggccaggcggagggactgccccgccctggtccagtgattgatcagcagtgattactgaggctttaatggtccgcttggatgggaattaattctgggatggataaataatgcatcgaggtttatgtagtccaaggcgagccgtccgtccggagccaggagaggtagccgagggagcctgacgggtgacgccagcggccacggggccccgaacgagcaggacatgaggggcgactaggcgcgaggacgagcaaaagcaagtggatgacagcatgaacggccctgcggggctggccggacggctgcaagaacatgctgagcccaaagatcaggcaggccaggagggccaaaccatatcacgctccttccctgagtccttgacctggagtagatgcctgggttgtctccatttctcaaatgaggaaactgaaggactgacatcaggccaagactaacaggtactcactctcagatagcgcctgaaagctgacacaagttcagtgagactgctaggacaaccccctgccgtgccattaatgtctgcccacaaaaacctcacacctttggctggctctatcttccatggccctcatctcagcaccacctgggggtacgatgaagatgccatcaggtgtcggagctcatcttgtgctcacagctcacaggaccgcccctgtgtcagatgcccttcacttctggacctcataacctccacccagctcaagttgacttagcaagccctaactgtgcatccttcataagctgtaaattgttactcaaaccagccaagaggatgtcactgctattattattgcattactgttttgatattgctgttgttattta

SEQ ID NO: 168225 - DNA, 742 bp, Homo sapiens
agcggagcttggacagccacgcgtgcgcccaggccaggcggagggactgccccgccctggtccagtgattgatcagcagtgattactgaggctttaatggtccgcttggatgggaattaattctgggatggataaataatgcatcgaggtttatgtagtccaaggcgagccgtccgtccggagccaggagaggtagccgagggagcctgacgggtgacgccagcggccacggggccccgaacgagcaggacatgaggggcgactaggcgcgaggacgagcaaaagcaagtggatgacagcatgaacggccctgcggggctggccggacggctgcaagaacatgctgagcccaaagatcaggcaggccaggagggggatttatttctctacaagggacacaggtgactgaacttcctcctggccccgaggacccagggaagcacctctttgagatcagcccagcacaacagacgtgcacacggtggcctccctgctgaagctgtacctgcgggagctccccgagcccgtggtccccttcgccaggtacgaggacttcctcagctgcgcccagctgctcaccaaggacgagggggagggcactctggagttggctaaacaagtgagcaaccttcctcaggcaaattacaacctgctcagatacatctgcaagtttctggatgaagttcaggcatactcaaatgtcaacaagatgagtgtccagaatctggcaaccgtttttgga

SEQ ID NO: 168226 - DNA, 915 bp, Homo sapiens
agcggagcttggacagccacgcgtgcgcccaggccaggcggagggactgccccgccctggtccagtgattgatcagcagtgattactgaggctttaatggtccgcttggatgggaattaattctgggatggataaataatgcatcgaggtttatgtagtccaaggcgagccgtccgtccggagccaggagaggtagccgagggagcctgacgggtgacgccagcggccacggggccccgaacgagcaggacatgaggggcgactaggcgcgaggacgagcaaaagcaagtggatgacagcatgaacggccctgcggggctggccggacggctgcaagaacatgctgagcccaaagatcaggcaggccaggagggcccgctccaaaagcctagtgatgggggagcagagccggagccctgggcggatgccgtgccctcacaggctgggccccgtgctgaaggcgggctggctgaagaagcagaggagcatcatgaagaactggcagcagcgctggtttgtgctgcgtggggatcagcttttctactacaaggacaaagatgagatcaagccccaggagaataagtgagggaagctcagcaataaggagccatagaagattgatttaaagtttgatgtgattgagtaaaagcttgagactggtggggagaaagtcaagatggatgggaaagcacatgcacttctaggagtggaacattaatattggacagtcggaaaccagaaatctttaagaaagaggaaacctcaggggaagaaagagaggccatcctatcccataacttgaaagtcacaggaatatttcagcctgcagggaatcttcatttcccagcccattgtttaccaaacttgcacgtcaaaaacaaaaacaaaaaataaaatgttgctttcatgaactct

SEQ ID NO: 168227 - DNA, 121 bp, Homo sapiens
atttggaaagcacagaaaaatttgctagtagttaacaaaaaagatgttagcattgtgctttataatgcactgaagagagactgtcttaatttatccatcccctggaacgtgaggcaagaat

SEQ ID NO: 168228 - DNA, 423 bp, Homo sapiens
acaagaatggagtaggtgtgggcaggcctcagtagggaaaaggaatggctccaaactcccacaccattgggtctttgtgagtaggcaggtgggtcttgtgcaccttggcggttccccagggtgtcctgcagggatggggcaccaaaaaggcctttaacccttcccctttaagcaggggacccatgtggatcctgaagttgtgcatcagctcactgtagctgctctgagctggaccccagccactctgaggggttcctaggacttgcaaagggcccctctcccccatccttctctgcctaccactctcctgctgatgacaagtccacttctatacactgcttaggcacagccccccaagaaagctctgcagggatgaggagctgaggcacccgcatagtccagccttaaggggtttctgtgatg

SEQ ID NO: 168229 - DNA, 112 bp, Homo sapiens
tcattttacttaattccatgggacattaattaaatagccacatgtagctttggtggatgtccgaatgggacagtagcatccattcgctaaatagccttgggtaagacaattt

SEQ ID NO: 168230 - DNA, 897 bp, Homo sapiens
ggcagacccagacagaaattttccttcaaccaagcaccacattgctccacattgctgttctccggcaatagactctcactttttcttccttattggctaaatggtcctctcaaaggtcacagttgctaagtatattgattgatagggtttttctgccccgcggggattacaacatggtaagcctagtgactgaacactgcacactgtccagttagaaggcagcagtcaaggaagacacagagatgggttttctgaagcatccccaccggctcctgctaacgggcacccttgccacaacccttggggacacaggacaggcacagtcccctctcttagtgctttagctctcattggcctgagtggttgtcattccggatagaggtcagtgacttctagcaacagcacaagtctagacagaacatttaaacaaaatatcatcaaactttggaattacaagtgacgtttttggtcatctagttcatttccctggctaatcttcagatatttttgaaaacattccctcaggagttgattcataactggggccaggagaatgtgctctcgtttgagatggtctgtttcctgagacagtcatgatgatggtaaaattattgcttgcattgggctgcccaggccggtgtagctccagccactgtgcattggtctgctctttctcactcaaatcatctctgtttctctaattgctccccatgggtggtgtgtcttactctcttgccatcctagatgttgtcccccaaatgcactgttgcttgtcaaactccatcttttgggaagcttttttgctatagtttccacttgtaatctcacccattaagcatataatagaccacaattggccccattatgtactttctaaaaattactttccctctatcc

SEQ ID NO: 168231 - DNA, 341 bp, Homo sapiens
agaggatctctaagaggtggtgtctcccaggcagttctagaaggcctggatgcaggctcaggagcggccgggtgactgtgacagcttcaagaagaaatgcacttcttggtttgtttttacatttttaaattctattaacttatttgtaaacaggtgatgcattcatgtatttcagtagccaaagatagaaaaggtgtatggtgaaaagtccccaggcaccctgctccctttcctggaggcatcagtttctcctgattccttctgtgtatccacctctgccctgcccccatccatacacagcctgcaacatgccctttgcctctcactcttctttttaacgt

SEQ ID NO: 168232 - DNA, 439 bp, Homo sapiens
aactccagccctaacctttcttctgagtttcaggtccttaaatatattatacatgtctaacattaattcattaaggctccatctgtccaaatccaagtctcaaattctctatttctgttcatggtaacaccattctttcagaaccaagacttgaaacctcaaaaatcaattttaactcctccttcactgtcacatccagacagtcctgctgataactcttttcaaaaaacctgagttattgaaaaagaactgaaatagaatctgaaagaatacacttcatccctaaacacagttatgtgtatcaaatgataaaactttttaaaaccattttgtcatccacacaatggaaagagtatagttgctctgcctactttacaataaacaaatgcatgacagcacactaaaaatcctgagccattatataaatatcatctactat

SEQ ID NO: 168233 - DNA, 272 bp, Homo sapiens
acatatgctagatgtaagttctttgtcagatacatggtatgcaaattatttctcccagtctgtaattcattttttcaacctctttacagggtctttctaagtaaaaaaaaaaaaaaataaaataaaaaaaaaaaagtgtttatttattttaatgaagtccagttttatcacttttcccttttgtagattttgttttcgacatcaagcctaaaaattatttgcctagcccaaggtctcaagagttttcttctgttttaaaaagtttaatgaat

SEQ ID NO: 168234 - DNA, 111 bp, Homo sapiens
atcattgcccagtgtctgcagatcccagcatgagaagtacaagttcactcaacatatccagtgtcctttacttagagctcagggactctaagagtgtgttctcttatttac

SEQ ID NO: 168235 - DNA, 159 bp, Homo sapiens
gcattacagacataagccacaacacccagctgaatttatcttttttacagatatctttttaggttgttttaatggcagttaatggggagagattagatgctagtatttaatacatcatcatgaactagacatgaacacattcttcagactgagtgtaat

SEQ ID NO: 168236 - DNA, 238 bp, Homo sapiens
gtgtctctccctggcccattttgaaagccaaggatgtgacctccgcctgttccctctctccgcccttctacctcctgacctccgtcccttctgtgtgtccagcaccatggcctgtaagcctcatattccctatagcaacccagcactgtgtatagggctttgaggatgtacagacagattcttaaagtgggaaatcgggccgggcgcggtggctcacgcctgtaatcccagcactttg

SEQ ID NO: 168237 - DNA, 251 bp, Homo sapiens
ggatggtggaatcaatggcccgctttgtgtcaatagacctcccaatggaggtgtgcacagttgagtctggagttccagggagaggtggggaatagagagattagctttatagtcattagtagcatcagagctcaagctgtgggactggatgagctccctggcagggaggtagagaagagtgctgaggactgaatcctgagcatcaaaccaccagcaaaggaggctgaacgggggaggccatggtgatttca

SEQ ID NO: 168238 - DNA, 773 bp, Homo sapiens
  misc_feature (678)..(678): n is a, c, g, or t
  misc_feature (702)..(702): n is a, c, g, or t
attgtaactccataatctccaagtgtcatgggagagacctggtggaaggtcattgaatcatggaggcaggtttttcccatgctgttctcatgacagtgagtaagtctcacgagatctgatggttttataaagggcagttcccctctgcatgctctcttgcctgacaccatgtaagatgtacctttgctcctcctttgccttccaccatgattgtgaggcctcccaagccatgtgaaactgtgagtccattaaacctctttactttataaattacccagtctcaggtatgtcttcacagcagtgtgaaaatggactaatacagctcccttccaggacagggcccttcaccaaagaaaaactactaggaatagaatcaaaattgagcaggacagaaacaatagagatgaatgaaacaaaagaccaaataaaagtgaaggagggaaacaaacccagaaaatcacagaaagcatgttactgtttttaacactaaatgaaaacaacacaaaatggagttctgaggagttgcaaaaaggtattttggacaatgtctccttgtaaggctgtggaaaaccaattttacattttaaaaaagcacagagaaagattaaggccaaaccccatactagaaagaaattttatataagagaagagtgagagagagaaaggcgatgagatgtnggaaggaggcatgagatgttggangcgcgatgagatgttggaaggagtgatgagatgttggaaggagagatgagatgttgaaggaggatgtatgt

SEQ ID NO: 168239 - DNA, 714 bp, Homo sapiens
attgtaactccataatctccaagtgtcatgggagagacctggtggaaggtcattgaatcatggaggcaggtttttcccatgctgttctcatgacagtgagtaagtctcacgagatctgatggttttataaagggcagttcccctctgcatgctctcttgcctgacaccatgtaagatgtacctttgctcctcctttgccttccaccatgattgtgaggcctcccaagccatgtgaaactgtgagtccattaaacctctttactttataaattacccagtctcaggtatgtcttcacagcagtgtgaaaatggactaatacagctcccttccaggacagggcccttcaccaaagaaaaactactaggaatagaatcaaaattgagcaggacagaaacaatagagatgaatgaaacaaaagaccaaataaaagtgaaggagggaaacaaacccagaaaatcacagaaagcatgttactgtttttaacactaaatgaaaacaacacaaaatggagttctgaggagttgcaaaaaggtattttggacaatgtctccttgtaaggctgtggaaaaccaattttacattttaaaaaagcacagagaaagattaaggccaaaccccatactagaaagaaattttatataagagaagagtgagagagagaaagggaataacatccctacctgcaatgaaagcacgtctgcaaacaggtgaaa

SEQ ID NO: 168240 - DNA, 545 bp, Homo sapiens
tcttctccattttcttatttatgaaaagaatatagcattacttcatgattatttgagggtaatgaatttatgaagtactcgaattaacatttatacccactttgtctatagtatgaaaacctctggactcacgtgattgccatcatgtgccacgttgatgaaattgagctcttagataatcagagtcaatgttgattaatatttttatattttatcacattgtaatttgttaacattgctgaagagtgttatacgtgatcagtaacttgcatgattaataagcattgatgtttatacatattcgtttgttttctaggtattccaactttattatatggacttggctcctggttatttgccagagtcacagagactgtgcataccagttatggacccataacagtttattttctcaataaagaagatgaaggtgccatgtattgaaagtgtgcgtcaaagaacataaatatcagtggattttctctgtgtatatgtgcagtatttatttttgatcctttaaaataaaacttttgcaaatacttttt

SEQ ID NO: 168241 - DNA, 274 bp, Homo sapiens
cccagaccaccgagctgcccttcagtctcagtgaagtacaatgtagccactaaaaagactgaggtcatgttttggaaagtccaggccggaggatcgcttgagcccaggagttcaaggccagactgaacaacacagcgagactccatctcttcagaaaatttaaaaattaaccaagagtggtggcacgcacctatagatctagctactaggaaggcagaaaaatcccttaagcccaggagtctgaggttacagtgaatgatgatggagccactgc

SEQ ID NO: 168242 - DNA, 585 bp, Homo sapiens
attctcagatggagacactggctcaagatggaaatgaatgataatgaaatgattccaggaaaacaaaaggaagaagaaagcttcttgagatagctgaacatgtgttggaaaaggaagaaatgtgggaaaagcgagttagtgactgtgactgtgtatacctcgtagtcaaagactgaaaaaatcagtctgggagtggaaagaggcagggagagaaagaatctggggcagggggtatacaatgtgcacgatgctactgatgctcttaagagaaaaagtgactatggtgcaacaggcactaatggtactatcacccaggggtcggccagcttagagcccagagccaatgaacctggagtagaggtggtgtagaaatgagatgcgtaggaactcatttgaaggcagatttaactagtcaattctagcacattgttcagcgtctgaccaggagttcaagaacagcctggccaaaatgttgaaacccagtctctactaaaaatacaaaaattagctgggcatggtggtgtgtgagcctttattcccagctactggggaggctgaggcaggagaattgcttgtacccaggag

SEQ ID NO: 168243 - DNA, 538 bp, Homo sapiens
tagccggtaccttccaccagcaagactgttccttgagagatatgtccactaaagtagcaatcttctatttcttcttcccactcccctttctccccctccattgaaagaaggtggtgagacaggaaaatgtagaggcaagtgatggagaagccacttcctcatatgcagagtgcattatttagttacctctcttctggagagagcctctgtaaccacagccttccttcttcctccagtccttacttggtatttattgctctgtgcttagccagatcctactcctatgctagagaattgcctgtagcaagctgcagccttctctatctttaaggaatttacaacccaaagcaagagacaggtaagcagttattaaagtcttccttcttgctaatgtaaatctcccctgctgtaatatatgctctttgtttctcattcatttggattaagagatctcagggccattaacccttacacacaggaaaacatttctctctgaaaaagcctagggagcgaccaaacagtggcggagatagggaaa

SEQ ID NO: 168244 - DNA, 195 bp, Homo sapiens
aagtgaaataagccagtcacctaaagacaaatgttgtatgattctgctttgatgacctggagtcatcaaactcagagagacaaaaagtcaaatggtggaggccaggagctggagaagggggaatgagtggttaatggagacagagtttctgttttgccagatgaaaagagttctggagatggagggaggtgatgg

SEQ ID NO: 168245 - DNA, 111 bp, Homo sapiens
acactcccaaatccttatattgagccctgacttctgcactgagcaccaggattgtagaccaacagcctccctgccatctccactcagaagcctaacagttacctcaaattt

SEQ ID NO: 168246 - DNA, 236 bp, Homo sapiens
tacaaggcatgtggtggatgctacgtaaatggtggtagctagtaataggaacaaaacgggtgctgaaaactcttaagtgttgggtcctgggttgataagggaggtgagatctaaagatacaagtaggaggtgccaggtaggtgtccaggaaaaaactgaaagagttgttgttcacactctgttaaaaggccttgaaggccataacgaagctttgggtggggggaagtcagaaatcc

SEQ ID NO: 168247 - DNA, 539 bp, Homo sapiens
attccatttgctgtctttcttagcaatgtcttagcaaaagtcttctatttgccacacgggtccaagcttccgcttactaagcacccaagtgccagacaaccccggaggcaggtactcccattgtccccactgtacagatgaagaaactgaactcagggtcacacaagtgataaggggtggcagagatctgaagctgtgcgcggaggcgtggccagcgtgtgcgctccgacttctaaatccctactctggatattgaagacgggaaagaccgagccgctcattctacagatggggaaaagcgaggcctgaggagtcccagagcgggtgccagatcgtagggagcagccagcaccccgggtcccctccacgacacaaccacgtccctcggccacttctgggtcccgcgcgcgtctcggacgcggcaggacagctctaggacgcacggccaccagggggccgaagggaagggcgggggcggaggctcggagctgacccaccgcctcgccccggaagctccgaggccccgccccggcggccgc

SEQ ID NO: 168248 - DNA, 398 bp, Homo sapiens
ggccctactaatttacttatattccacttccttttaaaaatggcatagaggcaagttcaaatactacacatgaatattgtctaaagttgtgtatattaggttaaaatgttgcagcttttactcagaggtgaacacggttagtcaggttataggaagtgatctcatttctacagacaccctaactgaactactggcaaggaactgtggacgatgcaaggttgtcattccttctctctacagtcctgggtagcgctgcagcttagccacatgtacctagaggagctgctttcacattctgtgcaagtttgtgaacttctgcagaggctgtaggcaacaagcacactgaaaatccagcacaaagatatatactttttttttttttttttttaaacaaaggc

SEQ ID NO: 168249 - DNA, 640 bp, Homo sapiens
gaacctcagatgagctctatgtttatttacaatgtttggcactcagaaatcaccaggcagatgaggatttaagacaatgttactgaacgccaagagaaacaacagactatggaagtggatcgacagggatccagatagtgaagttattagaaaagggtaaggtatgtagtatgtttacggagttaaaagattaagaatagggaaattggaaccacaccaccccctccccagtagaaaaaccaaatgtaaactgtagagttaaaggactgtaaatgaaattaagatgtcagttaatgggtttagcagtacattagtaataagtagaaaacaaatgttcagaatgaaatatggaaataaaaatggtctggacatacattatagagtgagtcttagggattctgtggaaaggtctaaccaacatgtaattgaaatcctagtaggaaaggaaggaggagtgctgcataagcagtatttggagtgatgatagctgagaattgttcataacaggcaaaagccatctcatcacagatttaaaaaatactaccagaaatctaagataaggagaacattttaatagtaaccagaggccaggtgcggtggctcactcctgtgatcccagctctttgggagactgaggcgg

SEQ ID NO: 168250 - DNA, 546 bp, Homo sapiens
gaacctcagatgagctctatgtttatttacaatgtttggcactcagaaatcaccaggcagatgaggatttaagacaatgttactgaacgccaagagaaacaacagactatggaagtggatcgacagggatccagatagtgaagttattagaaaagggtaaggtatgtagtatgtttacggagttaaaagattaagaatagggaaattggaaccacaccaccccctccccagtagaaaaaccaaatgtaaactgtagagttaaaggactgtaaatgaaattaagatgtcagttaatgggtttagcagtacattagtaataagtagaaaacaaatgttcagaatgaaatatggaaataaaaatggtctggacatacattatagagtgagtcttagggattctgtggaaaggtctaaccaacatgtaattgaaatcctagtaggaaaggaaggaggagtgctgcataagcagtatttggagtgatgatagctgtaaaatgtttattatgggcatagcccctcttctgatttatttaaaaatatcttccc

SEQ ID NO: 168251 - DNA, 458 bp, Homo sapiens
ttcttcccacatggacctctgtgtgtggcatgtatatgtgagtccagacacaagcgcgctctctcacagcacctgtgctgggcaggtagcaaaacctccgaggaatgcgcaaatgccttttttcagctcctgctctgctgactacgattcaatatccatgtccaaatagagcaatgcagttttcccttccttccagccctcctctgaagaagaaagctctttttcctcttcctccctcctcaccattgcttccctcctacgtttaataagctagtgggttacttactgcaaccaccttttgtttcctaaccagaatcaattttctttgcttttctctgttcccattaattgtgattcataggaacttaaaaggctctcatagcagcatttatatttggaagctgtaaatctcagaaagtaactttctcttgggatacatagacacacacacatcctcc

SEQ ID NO: 168252 - DNA, 239 bp, Homo sapiens
tactccattaatcttctaattagtcaacctgctttaagcttcttgccctccaataatttgttgcacacaatatggccagaattagccatcaaaaaacaagataactgggtcactatgctactgtaaaaccttcaataataataataataataagcaggcatccttgaagtgtttctcagaaaggggacacaaaacttactgccatgaaactggcagaggaagggtagtatggcatattg

SEQ ID NO: 168253 - DNA, 416 bp, Homo sapiens
gccagcaaggtgggactgcagcgggggcatgaaggagctgtgaagaggctagagccaagtaaggggctaccggaggtggctcaggggtctggctctgtcatcaggtctccttggagagcggtgagttcaccagggctgccctgggcagagtgagctggtgctgagagaactgcaactgtgacagcctaggggccagacgctggacacgtggctgtgatgaatggcatagatgagaggtaacagcctggggctggggcagggagtgcgcctgggtgcgcacccaggcgcacttctagctcttaggctcaagcaatcttcccatctcagcctcccaaagtattgggtcaactttctccagcgcctctcctttcccagaagtgcgcctgggtgcagaagtgcgcctgggtgcagaagtg

SEQ ID NO: 168254 - DNA, 311 bp, Homo sapiens
ccccaccatccgcaaactagattaactatcactgttaccgtcttagagcattgatatgggataaatcctccaaagggcttttgagggaaatgttttatatgtaataatgtgggatgaggaatatgaggaattacactcattttagtcttgttactataaagttatcaaacagaatatgacaagttacactcaatgccaaccatacctataaatactttttttcccattagtacacataatatattctcattgtagaatattagaaaacaattaggaatggaagacaagaacatttctaattacaatgccca

SEQ ID NO: 168255 - DNA, 491 bp, Homo sapiens
ctacaaagaacatattggtaccgtatttctgttccgcagatggagagggtgaggctcagagaattcaacggacttggccaggatcatggaatcagtgagtggcagaggcaggactcaacttgagaaagcctggctctgcagccactccagaccaatgtggtagtggaggagctggaagcagacaagggtccttgcaccccaaccacataccgaatgcagggccacccagaagtcagttgagtgcgcttgaggctactctgtcggtgtatcctctacgaaggcgaacaaaaccccagtctcgcgttgaaggagcctctgtctaatgaggagacacctgactctaaacccaggggcaataaagggcattcattcaaagcactggaaataagcagagaggagagagtgacggattggaggatatgctttctggagtaggaagcactcagaccaggccttgaaggacagaaagcaggatttaacagctggaagga

SEQ ID NO: 168256 - DNA, 350 bp, Homo sapiens
gtatgaagtgtctggagactccgttgggaggtctcagtcagaaggagcggggtcagagaaccacttaaataagcagtctgtctgccccttgacagggtgggtgtgctacactggggggaatccccctcatctggactgccttgactctccagagccagcaggcagagaagactaagatcactgatccatgatacttcagccatccttcctcctaggggctcctcttggggttatcagcgttttgtccataaacccctggctggggatgctgagattcccacagggaggccctgtccagtgaagaggagtgaatctgggttccaccccatctcgtgagcaccaccaataca

SEQ ID NO: 168257 - DNA, 209 bp, Homo sapiens
aggacagtctgttcaataagtggtgataggaaaactggatatccatatgcaaaagaataaatttggacccttatctcaccccatatacaaaaatttaactaaaaatggattatagatttaaacataaaacctgaaaaccactggaaaaaaacataggggaaaaaactacatgatatttctccagcctacgatttttttttttgggtttg

SEQ ID NO: 168258 - DNA, 165 bp, Homo sapiens
caggagaatcatccaggtaagcaaagctatagaataggtagaaataataaataattattattttaaattactaaatatattacatcaaaagaataactaaaacattacagatttcagtttccatctggtatgtcatcgtctttcatcctgaagaattttttttag

SEQ ID NO: 168259 - DNA, 243 bp, Homo sapiens
tgcctgttatccagttccaaagtcacttccacattttcaggaatcttcacggcagcatcctacttccagtaccaatatactatattagtctgtttttactctgctgataaagacacacctggggctgggtaatttataaagaaaaaaattaaagttccacatggctgaggaggcttcacactcatgctggaaggcaaaaggcacctcttacatggtggcagacaagagaaatgagagtgaatc

SEQ ID NO: 168260 - DNA, 194 bp, Homo sapiens
agcgacaggacagcacctgtctgccatgcacttcagtgtcctctgatgagccaggccagcactgagggcctcccacgccctcttgctgaatctttggggacctgtaccatcatccttcctttacagataaggaaactgaggcagaccacaggacggggtcgacgcggccgcgaatttagtagtagtagtcgacc

SEQ ID NO: 168261 - DNA, 503 bp, Homo sapiens
ggcagcatggcaggaaaaaatactggagacccactggattacaggtgaaaaggtgaaggggagaagtctcaacatttgtcagaggaggagatctgagcaccaagccaccctgtgttgtctgaagaattacacttgagaaagcttgcacatacatgtgctatcttgggttgagtaaataattaaagaaaacgggaggtttagaagaaagaaggatgtggctgaaataataaaggcaggcatagccccaggtacctaataactgggggtttgaatgcccacaggaatcaggcaaacaataaagatggtggcagtgggttcagtacattacacataggaaaaggtgggaaagaggtcacctggagatgtcccatcccatcagctttatcatccgatgcttgattagtggaaatgcaggcccaatattgccaggacttccaagtcttcaagagaagttgcaatctagagtttatataaaaactcctgaatttttttttttttttttt

SEQ ID NO: 168262 - DNA, 107 bp, Homo sapiens
ggcccagcccatgcttctctgcagaagtggacgtgcttttctgtttatttttcttatttaaaaattttaaatccaactatcttgaaatagttggaggtacagagctg

SEQ ID NO: 168263 - DNA, 242 bp, Homo sapiens
ggaattgatgtaccttgtattacctgtggtaattaataatcatgttttagaagattgtttagaggcaacacttttataataagacaaaaaaattataaagtcatatttaaagcatggtcccaattatgaaagaaatatacatccacaggtatatatgtaaacacagataacatatctgagagaaaatgaaacaataaataagtggatgaataaatacctgcattatgggccaggtgcagtgg

SEQ ID NO: 168264 - DNA, 337 bp, Homo sapiens
tcatggctagaagcttgtcggtgactctgactgtggactattgtgagctttcagtcattagctttggaccttagctgtgattccaggtcaggaggaaagttccactcaacttgctatttctcatctagctcggcagtgttgagaggcctggctcttttcctgaagctattttccccaagctggatatcttaggacttctcttcctttcctgcctgcccagatcccatgcagggcagctccctttctcacagacccctgcaaacccctccctccactatctttcctatgtcttctgccaacctcaggccctggagccctctaacatctgtcttctctg

SEQ ID NO: 168265 - DNA, 264 bp, Homo sapiens
tgctgggattacaggcgtgagccaccgcgccaggctaactcatttaattcttaacagtacagatgaagtaacattgtgtgactaacttgctccaaaatcacacagctattaagtggtggggtggagtttaaattaaagcagccaaagtgcagagtgtatattcttaaccgttgcactctttcaagtaggcatgtaatgtgctttgcttgggtgacttcagaaggggagatgtgttttgataagcttactatgtgttttgctaca

SEQ ID NO: 168266 - DNA, 469 bp, Homo sapiens
aaaccaccatggcacatgtatacctatgtaacaaaactgcactttctgcacatgtaacccagaacttaaagtataaaaaaaaaaaaacagaaaaagaagtaataataaagtactgagttgatttatataaagataataaaaatattgttattcttaacaataactaaatccaaactattcttggaccagaaatattttattggttctatttttttgataacggagattactgggtcaattggtaaactttgtttaaatgggatctgtggatcagacagtaatattaataatttattgtatcaatgtttccttgtatttaatcagtatactaaggttatataggagtgttcttgtgtttaggaaatatacaccaggtatccagggataatagtgcatcatgtctgtaacctactgtcaaaggattcagaaaaaatattaacataagagataaagacaaaaggagacagaa

SEQ ID NO: 168267 - DNA, 229 bp, Homo sapiens
aggagatgcaagaaggggtcatgagaataaggagacaggacccaggcagaagcctcctatccgggaccccaagccgtgcccctcttcacctaagtatgggaactcttaacccagaaagatccaggcctgggctgaagtcctgccctgactgttcccagctgtgtgactgtgggcaggtggctttacctctctggctttacctccatctcggagccttgggttttctgaa

SEQ ID NO: 168268 - DNA, 146 bp, Homo sapiens
ctggattactttcaaattcagaaatactttctatctttagagacaaaagaatgcacagaagtttgtttcctttagtagagtgctagaatattattcatacttgggttctcggataggattccaaactttaattttgcacactttta

SEQ ID NO: 168269 - DNA, 307 bp, Homo sapiens
agacaggggtctcgctatgttgcccgagctggtctcgaactcttgggctcaagcgatcctgcttcttcagcctgtccactagctaggcttacaagcgtgggaccccgcgcctggctgaagagaggtatcattaaggacgagacccccttggccagggaagccctgcgtaagcaacgcccctctcttcaaagggatgccccgctccctccgcccactcccagccttccagccttggctcccgaggacacgactccgggccctgccaccttctgataggctcgcgagaccgaggctgcaaagagagccg

SEQ ID NO: 168270 - DNA, 323 bp, Homo sapiens
agctcaaagaactacaagtagtttgatatggttgaaccaaggaattcaagtgaggataatgtggctagaagaataagctgggcccactccattaagaactttaatgggctaggcacagtggctcacacctgtaatcccagcactttgggaggccgaggtcgggggggatcacttgaggtcaggagttcgaaaccagcctggccaacatggcaaaaccccgtctctactaaacagacaaaaattagccgggtgtggttacgcacacctgtaatcccaactcctcaggaggctgaggcaggagaattgcttgaatccaggaggca

SEQ ID NO: 168271 - DNA, 558 bp, Homo sapiens
cgctggagtgcaatggtgcaatcttagctgaccgctacctccgcctcctgggttcaagtgattcccctgcctcagcctcccgagtagctggaatatggacatgtgccaccaaacccagctcattttgtgtttttagtagagacggggtttctctgtgttgatcaggctggtctcgaacgcccaacctcaggtgatccgcccacctcggcctcccaaagtgctgggattacaggcgtgagtcaccgcgcctagcctccggccagacttttaaatgttagccttgcaggtagttgtgcagtagtatctcccagccttaatttgctcttctttgatgactcatgaggttaagcaccttttcatatgtttactggccatttggaatatatgtgtacctatgtatctcttgccagttcacctcttttgtccatttttctatttatgtttattcctcattgatttttaggagttatttatattttttttcctttttttttctttgtttgaggcagagtcttattctgttgcccaggctggagtccagtggcacagtctcggctc

SEQ ID NO: 168272 - DNA, 355 bp, Homo sapiens
aagaatccaatctaagtgaattgcattcctaggccaaacatcctcatcatcaaaaaataattattcaatgcctgccttatatagagaatcggaaacagttatctcagtgtccttgttgttttgagtgcattaacaggccttagtaacagcatttgggtgcattcctaattttgtatagactatgaaagtgacctgtcatttataatactactgagaggctttgccatttatgctcattttcctgcactagctattgtcaacacttagaaacttgtcttctattgcaagatgccagtttactcctctccctggcaagcaaaccacacacgtgcctaaaagaatccttcatacatct

SEQ ID NO: 168273 - DNA, 553 bp, Homo sapiens
cattcagtctatcacaagaaggaagaaaatccagtagctttgttttcctctttcttatagatctctgctctagagccaatctaaaaactgaattctggtttctagtttttctaagtctgtatccactgacatacaatcaaataaaatgtctttaagtaaacagagatcttcatctcatcagctttaactggtgaatctggccagggacatttatcactcaatcccactgctttttctttaagaagaattgccattgtcattacctctgaagatgcaagcagcatttaagtgatagccacttaccatggggaatgttccagccacaattaacttcccattacgatacccatccccatttttgtatgcaattattttcactgccttttggtgtgtggctgccatgccactgtgagatgcagcttgcgtgcaggtcttcatccgtaaagacaatagacgtgcttggtagtaacttagagttttttcagccttgtcacacgacaaatcaacctaattttttaaaaaataaattgtacatttactcaaactttcttgt

SEQ ID NO: 168274 - DNA, 343 bp, Homo sapiens
gacactttgcactgaagtcaaaaataaatagagatgtggctagattctaccggtgggacacaaacagcttaacccaaagtgggtctgctgtaaaaaccaatacatttgcattttagcaatttgatctggaccaagtctgtgatgcattacaatgctgggatcaaatcaagcttttctggaggtaatccaaacacaacaggaggctatgggaaccctactgcatggggttcctctactgctgtttaactgtgctaacctcctgaaccataaagggtaattaaaagtcatctgcacatgaagcactgaaagtgtaaatgggaagcacaaccgtggcttctagcag

SEQ ID NO: 168275 - DNA, 158 bp, Homo sapiens
ggatcaataaagcatgatgtagtcatgtggtagagtactatacagtactgaaaaggaagaacaagaactcatgtatcaatatggatggccctctcaaaccatgttgatcaaaaccacaattgcagaagtatatacagtatgatgccgcctgtataaaa

SEQ ID NO: 168276 - DNA, 648 bp, Homo sapiens
ccagaactgagaccaaatcaagaattggtaacgtgtgccctgctgaatttcagaatgcaaatggatgagaaactactgtgcctcctgtttcctcttttctcgctcagatattgcccgccacatctgacccagaccaagtatctctcccatagaagtcatccttgggtactaacactactattgtgtcccagagctggttccttctcgtgggttctcggtctcgctgacttcaagaatgaagccgcagaccttcgcagtaagtgttacagctcttaaaggtggtgtggacccaaagagtgagcagcagcaagatttattgtgaagagcgaaagaacaaagcttccacagcgtggaaggggacccgagcgggttgcccccattccatctttccaaccatccacccacatttaccaacttctactctgacctttagctattcactaaagaagcagaagaatcaaactcagcccctaaccttgtgaggctctccatcttgtagaggagacccacagaaaacagataaattatgaaccttcctagtaaggactattgaagaggccaaaacaataggtttgggggatttagggaaaggaaggccaaataggggtaggtcaaacacaatcgctgtctctgggcatgactttgcac

SEQ ID NO: 168277 - DNA, 195 bp, Homo sapiens
taaattttaagtggagatggagtctccctgtgtggcccaactggtctccaactcctgggctcaagccatcctcccgcctcagcctcctgagtagctgggactacaggtgtgcactaccagcccaactattttattttatcttattattttatctgagacagcatctcggtatgtgacccagggtggtatcaaagt

SEQ ID NO: 168278 - DNA, 113 bp, Homo sapiens
gcagaaggtaaaggagggcaggggaaggtgaaacttagcagagggaaaaggaagagaataaggcctagtatttacctgttaggggattttccatagtcactcagttcagtgtt

SEQ ID NO: 168279 - DNA, 226 bp, Homo sapiens
aaccttacttcagactttgctttttgggaccacctgagttcatggtcagtgtttccttctagtcctatctgcatattagtggctaatcaacctgtatactccttactgaaaaaggtgaatttggctacacttagaactgattctttcagatactcccagttaggaaaacaggacagtagctacattacttccatattttccatgagaaagtagtgatcagttagct

SEQ ID NO: 168280 - DNA, 377 bp, Homo sapiens
gtgtgcccctctgcccccacagctggcccacgcgtgtgcccctctgcccccacagctggcccacgcgtgtgcccctctgcccccacagctggcccatgcgtgtgcccctctgcccccacagctggcccatgcgtgtgcccctctgcccccacagctggcctttgtgaaggtgaccaactacatgggtttttgaaaggggcacttggagggccccctgaaatacctaccacctgcaatggagcctgaaatctgactaaaggagatttgtgtctttggattaagcactaacctttacttaaaataggaatattgttcaggggtatgcagataaaccatttcctctattgaaaataaaatccatcactatctacatcatg

SEQ ID NO: 168281 - DNA, 509 bp, Homo sapiens
ccaacacttgtgggaccgcaggacggtgccgggagcaaggttgaggctgcagcagaggctctgggtctgggaatgggtcctgcctggccatgcaagggtggaggtggtgcagttgatggccttggggactgccacttttgctcccacagctgctcctgccattaccactcatgcctctctactgcagctggtgtgatggcagcagctgctctgggtgggtatatacccagaaggatataaatcattctaccataaagactcatgtacatgaattttcattgcagtactattcacaatatcaaagacatggaatcaacctaaatgcccatcagtgacagattggataaagaaaacatggtacatagacactgtggaatactatgcagccataaaaaagaatgagatcacatcttttgcaggaacacggttggagctggaggctgttatccttagcaaactaatgcaggaatagaaaaccaaatactgcatgttctcacttataagtggga

SEQ ID NO: 168282 - DNA, 441 bp, Homo sapiens
ctgttgttcttgcttaatactgcccatggacaatcttgtctacactggtgggcttaatttccgtgtatgtgtgcaggttcccttgcctttgggcatgttatgatcctgaaaatatgtctaaaagctgggtgaaaagtagattggagatgtactttcctgataatcaggaccaaatatctttctaaaggtaactggacaaactacaaaaaataaaacttctctggttgaaggcattgtatatctaagaagatactgaagaactaccaggccagtatctgcatgagaacaaaggcctagggtgatgattttggtattttgagtctgtttttagtcataggggcaactgagaggctgcatttgatagctttgtggggctaggaagacaggaattggagttctaagcaaagggtgggcagagtcaatcacttatttgggattgag

SEQ ID NO: 168283 - DNA, 335 bp, Homo sapiens
cagagttttggagcactgactccagaagtttcttttaggcaaatctccattcactattcagctcacccctagattactgcagtgtatggcactcagactgcctcttgctgctgccatgaccatgacagataaggctaatggattacagcattctgtcacccttagcctgatgtaatcttagagttcttctgcataaagcagccattcctgatggaatagaatcctcacttgtgtttaaagctacttatcagctgggtgtgatggctcacacctgtaaccccagcactttgggaggccaaggctggtggatcatttgaggtcaagagttcgagacc

SEQ ID NO: 168284 - DNA, 594 bp, Homo sapiens
caagatcgcgccactgcacaccagccttgtgacagagcgagactctgtctcaaaaataaaaataaaaataaagaatgaagtgggacccttaccttcataacacatacaaagattagctcaaaatggatcaaacacctaaacctaagagtaaaactataatgtttgaggagaaaacataggagaaagatttcatgacattggatttgacagtgatttcttggctatgataccaaaagctcaggcgacaaaaataaaaatagatagattggactacataaaaatttaaaacatctctgcattaaagggcccagtcaacaagaaaaggcaggccacagaatgggaggagatatttgaaaaatcatataactgataaggagttaatatccagaatatctaaagaactcctacaactgagcaaaacagcttgattttttaaatgtgtgaaatacttaaatagacgtttctccaaagaatataatatctgcaaatgaccaataaatgcatgaaaagatcctcaacatctctgtcattaggaaaatgaaaatcaaaattacagtgagatacttcacacccactaggatggctactatttaa

SEQ ID NO: 168285 - DNA, 500 bp, Homo sapiens
gggctcaagcagtcctcctccctcgacctcccaaagtgctgggattacaggcgtgagctgccttgctcagcctcagcacctcttaaaaaggagttaatttcaagagttattcaaagtgcaggaaatttaagaatgaatgaataatcgttatcccataagcaattattttaaacttcaaaattataagagtactatgagggttttgttcgttttgcttagtatttgaaattgtacatatttccatatattttctggccataacctgtacaagtatttgtattttctctgagtttcaagccttctctttggaaaagggaaccctgacttagagtgccctgtgattttttttttcaacctgtgtacatttaaaactatagattatagccatctgtttttaaaatagactgacaggactataaatacatttttctttctgttgtattgcttgtcttaaaaataacttatacccttccttttctccttcttacccccaaccaaaa

SEQ ID NO: 168286 - DNA, 794 bp, Homo sapiens
gccagttccctggacaatcccagctgcttcatcttggactgacatggacaccaggcagtaacaccagctcttgggagttggtgggaacaggtgtaatatcaaagctcccagctctgcactctcctgtcacataggaagacctcagaaaatggaggttccttcctttccacctgcactgggggagtgcaatgagcagaagaaaagcgaaggtccctccaccttctgagatcagctgacacctgagcttaggtgcatccctagccctgcagcctgttgcttcccttgaccgccacccccacctccatcttcaaggctgtgctgggcactccaggctgggcctgacgcgttccaaatctgcagctcccctcactctgcatcctgggcctccaccactctccaggagagtgggagacgcctgagccatgggtggcgagaagcggcagtcctgtgccgcctcagtgccccacttgcctccttcgtggaatggacttgacatccctgcctcgctggccagggcgtggccgaaacctacccaggatgtaggagcacctggcacagcgcttggccagtgaggcggtggttgcaataataataaccatcccttgttgaacattcaccagataaccaaattctccacaccgcatttcacttaggcctccctacctaagagctgggtcctaattcactggttctgtacatcaggaaggcaaagcacagacagagcacaccacactgcagctgtctcctgcctcccagtgcatcagagtctggagcgcgtgcttctctggagggac

SEQ ID NO: 168287 - DNA, 963 bp, Homo sapiens
gccagttccctggacaatcccagctgcttcatcttggactgacatggacaccaggcagtaacaccagctcttgggagttggtgggaacaggtgtaatatcaaagctcccagctctgcactctcctgtcacataggaagacctcagaaaatggaggttccttcctttccacctgcactgggggagtgcaatgagcagaagaaaagcgaaggtccctccaccttctgagatcagctgacacctgagcttaggtgcatccctagccctgcagcctgttgcttcccttgaccgccacccccacctccatcttcaaggctgtgctgggcactccaggctgggcctgacgcgttccaaatctgcagctcccctcactctgcatcctgggcctccaccactctccaggagagtgggagacgcctgagccatgggtggcgagaagcggcagtcctgtgccgcctcagtgccccacttgcctccttcgtggaatggacttgacatccctgcctcgctggccagggcgtggccgaaacctacccaggatgtaggagcacctggcacagcgcttggccagtgaggcggtggttgcaataataataaccatcccttgttgaacattcaccagataaccaaattctccacaccgcatttcacttaggcctccctacctaagagctgggtcctaattcactggttctgtacatcaggaaggcaaagcacagacagataagtagcttgcccaaggtcgcagagctgtaagggatggggggctgggattgggaacccctggaatccactttcagagccaggtttcttcccctttgccctgtacagcaggtgcccatgagcaggtgttccttccctacaggcctccctcctctcccctgctggaaagggcagatggggagggctgagaggaaaacaggggcatggtggagatgcagaggatctgcctcaggctccgctgc

SEQ ID NO: 168288 - DNA, 267 bp, Homo sapiens
attttagaacgatggtgattttggagtattatctgtgcagcaaaggaggaaaaacaaaacacatacaaatgaaaagtgcttctagatgatgctgagggcttggctgaggttggtgagtataaattagtattgttgctactttataattctgtgatttccttcagtatcctgcagtcaccctagtataacagcagagatagtacttgaagtatttggtccagagttagagctttacttggcagacgtggaagcagtaaggttaaagga

SEQ ID NO: 168289 - DNA, 1778 bp, Homo sapiens
gagtaggctaggtacgaggctggtttgaatctaacggccgcatggtaactcaggcgccgggcgcactgtcctagctgctggttttccacgctggttttagctcccggcgtctgcaaaatgaagattgaggaggtgaagagcactacgaagacgcagcgcatcgcctcccacagccacgtgaaagggctggggctggacgagagcggcttggccaagcaggcggcctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacagatcattaaaatccgtgcccagacggaaggaatcaacatcagtgaggaggcactgaaccacctgggggagattggcaccaagaccacactgaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagtaagagactccccaggtgtgcctggcctgggtccagcctgtgggcgcttgcccctgggcttggggctgccgtccccactcaggcgtggtctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaacagtt

SEQ ID NO: 168290 - DNA, 1777 bp, Homo sapiens
agcatcgagtcggccttgttggcctactggtaacggccgcatggtaactcaggcgccgggcgcactgtcctagctgctggttttccacgctggttttagctcccggcgtctgcaaaatgaagattgaggaggtgaagagcactacgaagacgcagcgcatcgcctcccacagccacgtgaaagggctggggctggacgagagcggcttggccaagcaggcggcctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacagatcattaaaatccgtgcccagacggaaggaatcaacatcagtgaggaggcactgaaccacctgggggagattggcaccaagaccacactgaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagtaagagactccccaggtgtgcctggcctgggtccagcctgtgggcgcttgcccctgggcttggggctgccgtccccactcaggcgtggtctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaacagtt

SEQ ID NO: 168291 - DNA, 1746 bp, Homo sapiens
caaccttacggcttaggtacgagtgctggcgttttgtcctagctgctggttttccacgctggttttagctcccggcgtctgcaaaatgaagattgaggaggtgaagagcactacgaagacgcagcgcatcgcctcccacagccacgtgaaagggctggggctggacgagagcggcttggccaagcaggcggcctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacagatcattaaaatccgtgcccagacggaaggaatcaacatcagtgaggaggcactgaaccacctgggggagattggcaccaagaccacactgaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagtaagagactccccaggtgtgcctggcctgggtccagcctgtgggcgcttgcccctgggcttggggctgccgtccccactcaggcgtggtctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaacagtt

SEQ ID NO: 168292 - DNA, 1728 bp, Homo sapiens
taggcatagtaggagccggtgttaatcaggcagaggcacgctggttttagctcccggcgtctgcaaaatgaagattgaggaggtgaagagcactacgaagacgcagcgcatcgcctcccacagccacgtgaaagggctggggctggacgagagcggcttggccaagcaggcggcctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacagatcattaaaatccgtgcccagacggaaggaatcaacatcagtgaggaggcactgaaccacctgggggagattggcaccaagaccacactgaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagtaagagactccccaggtgtgcctggcctgggtccagcctgtgggcgcttgcccctgggcttggggctgccgtccccactcaggcgtggtctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaacagtt

SEQ ID NO: 168293 - DNA, 1900 bp, Homo sapiens
agcatcgagtcggccttgttggcctactggtaacggccgcatggtaactcaggcgccgggcgcactgtcctagctgctggttttccacgctggttttagctcccggcgtctgcaaaatgaagattgaggaggtgaagagcactacgaagacgcagcgcatcgcctcccacagccacgtgaaagggctggggctggacgagagcggcttggccaagcaggcggcctcagggcttgtgggccaggagaacgcgcgagaggtgtggccagtggaccagggagttgggggctgcaagcagggctgctgcggcgagagagctgctgaagtcggtggctcggggcgggatgcgcgcgccaggggtctcccgccattatttcctcaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacagatcattaaaatccgtgcccagacggaaggaatcaacatcagtgaggaggcactgaaccacctgggggagattggcaccaagaccacactgaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagtaagagactccccaggtgtgcctggcctgggtccagcctgtgggcgcttgcccctgggcttggggctgccgtccccactcaggcgtggtctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaacagtt

SEQ ID NO: 168294 - DNA, 1780 bp, Homo sapiens
  misc_feature (24)..(24): n is a, c, g, or t
cccctgagcgctttttacatcggncgaggctagtaacggccgcatggtaactcaggcgccgggcgcactgtcctagctgctggttttccacgctggttttagctcccggcgtctgcaaaatgaagattgaggaggtgaagagcactacgaagacgcagcgcatcgcctcccacagccacgtgaaagggctggggctggacgagagcggcttggccaagcaggcggcctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacagatcattaaaatccgtgcccagacggaaggaatcaacatcagtgaggaggcactgaaccacctgggggagattggcaccaagaccacactgaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagtaagagactccccaggtgtgcctggcctgggtccagcctgtgggcgcttgcccctgggcttggggctgccgtccccactcaggcgtggtctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaacagtt

SEQ ID NO: 168295 - DNA, 1780 bp, Homo sapiens
cactagctagtacagccggtgttaatcggcagataacggccgcatggtaactcaggcgccgggcgcactgtcctagctgctggttttccacgctggttttagctcccggcgtctgcaaaatgaagattgaggaggtgaagagcactacgaagacgcagcgcatcgcctcccacagccacgtgaaagggctggggctggacgagagcggcttggccaagcaggcggcctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccccttgccaaaaggggatgtgcacaaaaagaaagaaatcatccaagatgtgaccttgcatgacttggatgtggctaatgcgcggccccaggggggacaagatatcctgtccatgatgggccagctaatgaagccaaagaagacagaaatcacagacaaacttcgaggggagattaataaggtggtgaacaagtacatcgaccagggcattgctgagctggtcccgggtgtgctgtttgttgatgaggtccacatgctggacattgagtgcttcacctacctgcaccgcgccctggagtcttctatcgctcccatcgtcatctttgcatccaaccgaggcaactgtgtcatcagaggcactgaggacatcacatcccctcacggcatccctcttgaccttctggaccgagtgatgataatccggaccatgctgtatactccacaggaaatgaaacagatcattaaaatccgtgcccagacggaaggaatcaacatcagtgaggaggcactgaaccacctgggggagattggcaccaagaccacactgaggtactcagtgcagctgctgaccccggccaacttgcttgctaaaatcaacgggaaggacagcattgagaaagagcatgtcgaagagatcagtgaacttttctatgatgccaagtcctccgccaaaatcctggctgaccagcaggataagtacatgaagtgagatggctgaggttttcagcagtaagagactccccaggtgtgcctggcctgggtccagcctgtgggcgcttgcccctgggcttggggctgccgtccccactcaggcgtggtctgcagcgctgtcagttcagtgtggaaagcatttctttttaagttatcgtaactgttcctgtggttgctttgaaagaacccttccttacctggtgtgttttctataaatcttcataggttattttgattctctctctctctctctctaagttttttaaaaataaacttttcagaacagtt

SEQ ID NO: 168296 - DNA, 983 bp, Homo sapiens
  misc_feature (24)..(24): n is a, c, g, or t
  misc_feature (830)..(830): n is a, c, g, or t
  misc_feature (833)..(833): n is a, c, g, or t
  misc_feature (836)..(836): n is a, c, g, or t
  misc_feature (843)..(843): n is a, c, g, or t
  misc_feature (846)..(847): n is a, c, g, or t
cccctgagcgctttttacatcggncgaggctagtaacggccgcatggtaactcaggcgccgggcgcactgtcctagctgctggttttccacgctggttttagctcccggcgtctgcaaaatgaagattgaggaggtgaagagcactacgaagacgcagcgcatcgcctcccacagccacgtgaaagggctggggctggacgagagcggcttggccaagcaggcggcctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcaagaagacagaggtgctgatggagaacttccgcagggccattgggctgcgaataaaggagaccaaggaagtttatgaaggtgaagtcacagagctaactccgtgtgagacagagaatcccatgggaggatatggcaaaaccattagccatgtgatcataggactcaaaacagccaaaggaaccaaacagttgaaactggaccccagcatttttgaaagtttgcagaaagagcgagtagaagctggagatgtgatttacattgaagccaacagtggggccgtgaagaggcagggcaggtgtgatacctatgccacagaattcgaccttgaagctgaagagtatgtccctgccaaggggatgtgccaacaagaagaaatcatccagatgtgactngangantggatgnggnnatgcgcgggccccgggggaacaagaaaccgagccatcgagggcggcctaagagcaagcaacagacgccaggccacatccgagcgagtaacacgggcgacaacctgccaggcaagagcggcaggggcaggcggaacg

SEQ ID NO: 168297 - DNA, 800 bp, Homo sapiens
  misc_feature (551)..(551): n is a, c, g, or t
  misc_feature (554)..(554): n is a, c, g, or t
agcatcgagtcggccttgttggcctactggtaacggccgcatggtaactcaggcgccgggcgcactgtcctagctgctggttttccacgctggttttagctcccggcgtctgcaaaatgaagattgaggaggtgaagagcactacgaagacgcagcgcatcgcctcccacagccacgtgaaagggctggggctggacgagagcggcttggccaagcaggcggcctcagggcttgtgggccaggagaacgcgcgagaggcatgtggcgtcatagtagaattaatcaaaagcaagaaaatggctggaagagctgtcttgttggcaggacctcctggaactggcaagacagctctggctctggctattgctcaggagctgggtagtaaggtccccttctgcccaatggtggggagtgaagtttactcaactgagatcatcaagactttatccaaggaggaagagaccaagaaataaaacctcccactttgtctgtacatactggcctctgtgattacatagatcagccattaaaataaaacaagcctttaaaanaanaaaaaaaaacaaaataacaaataaacatactaaaaacaaaaaaaaaaaaagaaaaaaaaataccccggggggtcttcattgttggggtggggggaacacaagggtatatcataggcgccgccaggtgtgcatatggtgtctcccgagcacacctttttttggtcaccaggggggggaaactacggggggcccccccaaaggggggggggcgcattaaatccacacacgccgggttcacctgttaat

SEQ ID NO: 168298 - DNA, 532 bp, Homo sapiens
ttttagtgagtttcttgtaagagaacgtcagcatgacttttattaatgtcagagaatgcatttttttccttttgataaaagaagaaaggacctttcacattcaaaattcaatttttcccctaacatttccaatatgacacaagcatatggtaaataaaattattctagtaaatattagaaccagtggaccagtgagggagacttggagtatgctgtgaatatattgaatactaaagagcatctgaaatataaaaatcattgaacttttaataaaaactgaataattcaatagtttttcattaaagaaaaaagaaatgtaaacaataacaatcattaactcaggtctgtctatgtatcagagacagctgacaaatgtgatgagaaagttttcaagagttttacacagtggactatactgggtagaaaagtctgctttctattttctcggccaagaatataaataaggttaggtttacaaataaaactttcactgaagtaaaggaataagacacatcaaataactgcaattaaa

SEQ ID NO: 168299 - DNA, 115 bp, Homo sapiens
caccaggtccccactgatgaggcctttactgaggaggccacaactaaccaggtcccaactgactaggtcctgatgaccaggccccctgaccatggtccactgaccaggcccctga

SEQ ID NO: 168300 - DNA, 1647 bp, Homo sapiens
  misc_feature (518)..(518): n is a, c, g, or t
gcgaccaaggcgcctgcgcgaccccaggtccggcccatccctccattccctgtaaccgccagcctccgcccctcttgacaaccacccgctacgcttacccggttacaaggaacccaggctgcaaccaggaaaaactgccatcagaaagtttatctaagccggagcaaacttggctggaccggcccctgacccgccttggcgctgccgcccctgtcttctgcggtccccggccaggcgaggaccagagttttgttctcggagattcttgcctttcttgttttagcacaaacgcgcacgcacccctttcccataacgagcccctccgcccaactacagatcccgggatctgttgcaggggctggaaaggccccactcgagaggcctgagctggctgcggctcttggttccggggcaggttctccagggttggatacgctctggacgcctgggcgggttgttttgcttcggcctcgctggccaggggcccgcccaccccgcctggaacgcggtttggatcngcgctgggagccctccgtaaccccagctgaaggccgcgcaggcaggcggggacgccggagctgcggggccggttcccagccagcatccagccttttcggaatcaggcgggtccctggtgattcgctgggttttcccacttcccacggggacctcacctttgggaattaattgctgacagtgttagagttacaaagtagccagtgtcacggagggaacctcaaagagacaaagggacacctcgaaggtgtcagagagacggttgtttcggacagaaacagaacagcgaagcggaaagaaaacagaccttatttctgttctgttccacttcagatagtagcagaggagacttggatttcattggtgttggttttcgtgattcctgccttctaaaatcccaagacttatttatcatttatcatcagctcagatcccaggaaaacagtccactgcacttcggtttctgctccaagtcacccattaaataaataattgaacacctgctggtgccaggcgcagttctaatgcttgggatatgtcggtgaacaaagcaaaggtctccctcacctgggggagctgaaggcctgcggggaagaagtgggagacagagggtaaaccatggccatccctaagtaaattatttggggtgttggaagaggtcggtgatagggaaaacaagaaaaagaatatgggggcccagagtgcttgtgtctggagcaggtcacagaattaaatagatggtgtgtgtcaggcctctgagcccaagccaagccatcgcatcccctgtgacttgcacgtatacatccagatggtctgaagtaactgaagatccacaaaagaagtaaacatagccttaactgatgacattccaccattgtgatttgttcctgccccaccctaactaatcaatgtactttgtaatctcccccacccttaagaaggttctttgtaattctccccacccttgagaatgtactttgtgagatccacccctgcccacaaaacattgctcttaacttcaccgcctatcccaaaacctataagaactaataataatccaccactctttgctgactctctgtttggactcagcccacctgcacccaggtgaaataaacagccatgttgctc

SEQ ID NO: 168301 - DNA, 464 bp, Homo sapiens
cataaaattgcatctcattgttgctttaatttgtattttcctgattactggagagaatgaacatcttttttattgttattggctaagctggtatcctcttctgtattgcctatgtgtacattagccaattttgaccattttagttatggttttggggtgggctcttcttaatgaattttagaatcaaagttagatatttctttaagtgactggtaagattgattttatccttctgtatatacaggcacctttatacctatgatttatctcaagagaatgtttacagatattccatggttgggggatgagacaaggataaacagaggagaatgatgcttttagtttactctcacagccttcgtggctacgaatgggcagccaagtaggttggagagaagcttctaaggaattgcaagatataagaaagcagtgccctgaagataactggcatcagaaataacatg

SEQ ID NO: 168302 - DNA, 151 bp, Homo sapiens
aaactcctgagctcatgtgttaatgtccatcttcacctcccaaagtgctgggattgtaggagtgagccaccacacctggccaaaagtttgataatttagttgtattaattatttccgtgttgtcacagagaaaatttttaaagcaatttaa

SEQ ID NO: 168303 - DNA, 535 bp, Homo sapiens
cctgtagaaaccattaaccccttcagtttctaactggtggttcatttctcctcagcatttatttataatgataattataaattattcctttttatgatgtgtcgaaatctggccctaaaagcttttcctgtattgtcttatttaatcctcatacaatgctatgcagtaagttatttttgcagctaggaaaactgaatgtctggtgtcatgtgacttgtctaaggtcacagacagcaagtagtagcaccaggattcatacccagatctctcaagaaggcaaaaaacaaattgcatacacacctaagtataacactctatattattcacccttccctcttcacaggcatcttcttgagaaagtactcactatgcttggtaatctccacctttacctctccttccctccatggctcagcatagtttacactccatagtttgccaccccatccacactttcacttccctcaccaggactatcagtgtcctatttctcaatgcagtagacattgtgctgtctgtcctcttttgtatttga

SEQ ID NO: 168304 - DNA, 315 bp, Homo sapiens
caagctatccggttcaatccctgttcgtagtaggagactattttatctctgctccattgcgttgacatttgcaccagcctacacttcctgtttctctaatcctttgaacctatgaaacaatgcatatacatagccctgctttcttaaacagaggccgggcacttccaggctgaaaaatttcccaccgcgcctggcagtaactgattcttaagggaaatgagctcccgagaaagctggaagcctgtcctacatttttttttaacctatttgcagattcgcaattgaaccggatagctgccgggatctctagagcta

SEQ ID NO: 168305 - DNA, 281 bp, Homo sapiens
cagaacctaagccaactggccatgcccactctcaggccattcctcaaccccagtggccctccatgttcataccactccctcctttctgatgggtctgtgttgatctctctgggctcatggtggtgggggtggcatccttgactagttcttgttttattctgaaagtgacatactggcattaaaaaaagaaaaatcacatcacagaggtcacaggcagggtgcggtggctcacgcctgcaatcctagtgctttgggaggccgaggtgggtggatcatctgag

SEQ ID NO: 168306 - DNA, 166 bp, Homo sapiens
taattgtgtctaataaaaaatgaggtttatctaataataaaaatggggttggattttctatgtctttttttttttttccaagatggagtcttgctctgttacccatgctagagtgcagtggcattatctcggctcactgcaacctctgcctcccgggttcaattct

SEQ ID NO: 168307 - DNA, 334 bp, Homo sapiens
ttttcttagagaattaatcacatcttcttttaggagtgaactttcatttagaggcagatcttgaaaatcttcaactttttgatttattgtaccttttgcggctccagttacatgtaagtttttttatttgtaattttttcccatcaataagcatttcagattactagttttttgacaaacatgaggtagacattcattaccaactcttaatagctggcattttagattataaagaatccaatataagaatcaagtatattttattcaggaaaataatcttacatcaacaacatacttttcttttgagcgggagatgtaatatgctctatagatt

SEQ ID NO: 168308 - DNA, 172 bp, Homo sapiens
gcacaggtggctgctcgtggcccacgaggggttctccccagaagagacaggaagggcccaccgtgtttcccacagcaatgtcctcatgcacgctgaggcacacatcttacgtggatgctgttagtattcagtacactgcgtctaaaatgcacgtgtgtgcaaatgcgtgtct

SEQ ID NO: 168309 - DNA, 415 bp, Homo sapiens
cagggaggctgaggtgggaggatctcttgagcccaggaggtccaggatgcagttaacgatgatcctaagaccacgaggcaattggaggatcctcaaataccagggagaaactagctagcagacatagtatggtgggaggggaagatcaaggcaaatgccttgggagtgggtgagaattgcgacttcatattggatctcctgacctgtgaaggcccttttctaggctcctctggacctgtcctctgcccaggttcaaccagaaaaggatggagtttgttgcatggtatcatcagggtgaggttgggagatgatgcgggaacgctcatccctggtcttaggaacgggagaacaaaggaaaaatggcatcatttccacctaaaaagttacaagcacttcaccagaaggaacagcccag

SEQ ID NO: 168310 - DNA, 386 bp, Homo sapiens
aataaaaatccctatggaaacagcatctttgtattttagttatgttgatatgtaattaaatacattctacaatttgaatcctgatttcataggcaacaaaggaggaacatgttaactatttttcactctaaacttcctgaaaaggtagccttgttttctgtctctcttcctcccttcccttgcacaatccagcccataacaatttggttgagcttcacctgctgatgagaccatccttgccaaggttatcagcgatgtccagattgttaggattaacggccttcatctcaggtccttctgcagcagcttacctgagcatctggcactctctctagcatttgtctttgaaactctctccctccctgactctggcaggacagttctta

SEQ ID NO: 168311 - DNA, 152 bp, Homo sapiens
catcatctttcccctcccactgatttccagtccatagttctggactgaacccctaatttgagatcttcctggaaaaacttgagacaaattggtcataattttatttctaaattttttctttttgtagatttgtagagatggggtctcgctat

SEQ ID NO: 168312 - DNA, 370 bp, Homo sapiens
ccctcatatatttttctaataaaagtagtatcatttacaatatgagaactacaatcatactttgtatttgtctcttttagtcaaaaatttacggttttgttcacataaggaaaaaaggtaagacaaagaaaccatttttaaagctcttcacacatcaaacactgaattaagacctttgtgtttttaattgttttgctgcctggaaccatcctattctgtctgatttctctacagttttcagtgtgtttccttcatctcagacacacaaacatgcccaaacacagtaaatcacagttaattgcatgtcttaaattaaaagacaaaaaaaatcacacaattaattgggggaacttgtcagttggtgaatgaa

SEQ ID NO: 168313 - DNA, 275 bp, Homo sapiens
gcttatccattgcactccggatgtgctgacccctgccgtttccccaaatgtgggaaactcgactgcataatttgtggtagtgggggactgcgttcgcgctgtcctctgaattttgtgctggaaaacgcagattgtatgtgaagggatacttttagtagtgcataatatgggtggtgtcatgttatttttacagttggatggctggggaacagaagtggcatgtcgttgtcctcgctggagaaggaacaagcgtcagccgttgtgagcctgtttat

SEQ ID NO: 168314 - DNA, 147 bp, Homo sapiens
tttgtaagttacttgggggccagcacctcctcttaatcaccttactgttgcccacacactgaccattgagccgtcagcacaagatgatcaatagagatgcgttgatgatttgagaggccaatgactagttccactattctgagtcag

SEQ ID NO: 168315 - DNA, 610 bp, Homo sapiens
  misc_feature (453)..(453): n is a, c, g, or t
  misc_feature (544)..(544): n is a, c, g, or t
  misc_feature (549)..(549): n is a, c, g, or t
gtcttattgaactggataatccaatattatggatacaatgtcatacagtattatggaggcatatgtgtaattatcaatataaataatactggagaaatttccggacgtcagaagtcggaaatggctctcactgagttcaaatcaaggtgttgggaaggctccactcctttggggggctgtggaggaggatccatttctttgccttccccaacttatggactctgcattccctggcttgtggccccttcctccatcttcaaagccagcagcgtagcttcttcccatctccctcatattcctctaacgctgacctgccttcctcttacgaagaccctggcatgacatcggcccaccagataatccagcctgagcaacagagcgagactttgtctcagaaaaaaaaaaatcagcttataataagtgccataaagaaaataaaactgggagacatgnaagagactgactagggtggtagtctaacagatggggcagtcaggaagtctttcctgaggaggtgacatctgagctgagatctgaatgaggntaggntccagccacagattgatcttggggagaggcattctaggcagaagacgtggctagtgcaaag

SEQ ID NO: 168316 - DNA, 335 bp, Homo sapiens
gatcatgttgtttctggaaagtctggggaaggatctgcttccaaattcatctaggtggtggacagtgtcgctctgtgatgtttgggactgaagcctctgcttcaccattggctatcagtcctgctcatcctcagcttcaagaaatcacccgtatttcttgaatcatggttttttccttttttttttttttttttttttttttgaggcggagtctcactctgtcgcccaggctggagtgcagtggcgcgatctcagctcactgaaagctccgcctccttggttcacgccattctcctgcctcagcctcctgagtagctgggactacaggctcccgc

SEQ ID NO: 168317 - DNA, 348 bp, Homo sapiens
caggagactttttaaaaaatctttggagtagttgacataaatcaacttaaatgaaatggaaaaaagaagtttacatacaattttatggtttgtgatgtggtattggaacctcttttttgcccatgccaaagttatatacacacgcattgatacttattcagcagctgtttcattatatattttatgctaaggatggtgctaagaattggtccccttcctcaagaagtttatagttcagtgaagagacaaccaaactgcttttgcttggttgtgtctcatctttaccacctcaaaacattagagagccctgaggctcagtcttcaaatttcttttctatatttgctccc

SEQ ID NO: 168318 - DNA, 467 bp, Homo sapiens
ggcaactatcaatctatccaaacataactcagacctagagcatagttttctctgcaccacaaaaacagaagcaagcactgccaattagagatatatgtctacctcccaaggccacaaagtcattttagagctacctctgcctttcctttctcttcccaattaagcagcacatctcccttcctttatcactatattcaactgcagtctagttctttaacccctaacaggtataactgcatgagctggcactcttgtacttcctgagagtgacttaatacacttttcctcatcccagacgtttttaatggaaatggatatacttcctaataatctcctttcaaagatgggaaaggactcccttgaaaagtactaagttcctacatgctagccatgttcaagcaaagaccaccagggtattgtagaaagaataaagtaaggacctttaagttccattcctggccttgacc

SEQ ID NO: 168319 - DNA, 230 bp, Homo sapiens
tgatactttctttatctttcaagtaatcaatcagagcccctgctgaacttctctttcttctcccttcccccacatggtttctctgcattcctgtgggtatgccattctggagatgtcagattttctgagccctcaagaggtgaagaaaatattgtgaagtgtaagatgtagtagacagagcacttagcttgaggtcaggggactctaggctcagctctggcaccagatag

SEQ ID NO: 168320 - DNA, 234 bp, Homo sapiens
gagacagtagtagtgaccagagaaataggaggcgactgagatagccaagtgtcatggaagccaaagaggagggctagatgagcagtgtcaaatggtgctgagaaaccacggttatacctgagaagtgtctgttggatttactggattggagatattggcaaactcagcaggaacagtttcagtggagttcagtatagcagatgtggacaaagtcagactgcatagatgggaagt

SEQ ID NO: 168321 - DNA, 184 bp, Homo sapiens
attattttatttctatcattgtatttttcattacaaaattttcattttttttcaatagcttctattttctttgctgaaagtgtccatcttttcatttgtttcactattcactaatgttctctcccacttcatggagcttaattatatttgtgtgtgtgtggaggaggtgtgtatgtgtgtgtgt

SEQ ID NO: 168322 - DNA, 397 bp, Homo sapiens
cctgaggccaggagtttaagaccaggctcggcaacttatccagacctcatctccacaaaaaacaataattaaaaagtagccagacatggtgcatgcctgtagtcctagctactcattaggctgagtcaagaggaatgtttaaattcaggagtttgaggttacagtgagctatgatgggtccaaggcactccagcctaggtgacagagcaagaatctgtctcttaaagaaacaaaaaaacaataacaataaaactactacatgatccagcaatttaactagtttatccaaaggtaaataaatcagtatatcaaagggacacctgcactcccatgtttcttgcagggctattcaaaaagtaaagatataaaatcaacctaagtgtctatctgtgggtaa

SEQ ID NO: 168323 - DNA, 272 bp, Homo sapiens
accatgacataccactccctttttcctctgctgatttgagttaaaacccttatggatctcacccttaaatccttgcaatggcctcctacctgatctctgcctgcaccacgtcttcccagcagtcctataccggggtaatcttccttcagctcctgctcagaaaccatcaatagctcccagctgactactcaacagagtcagcaatcctgtctgttctaccttcaaaataaatccaaaatctgaccacttctctccgcctctactgcttcccc

SEQ ID NO: 168324 - DNA, 384 bp, Homo sapiens
gatgacaggtatgagccaccatgcccaccttgctcccttttttcccccaatttttattttattgtggcaaataaaacataaagctggagaggcatggtggctcacgcctgcgattccagaattttgggaggccaaatcaggcgaatcgcttgagctcaggagttcgaggccagttgggaggccaagtcaggtggatctcttgagcccaggagttcgaggccagcctaggtagcatggtgaaactcttgtctctacaaaagatacaaaattggctggatgtgggggctcacacctgtaatcctagcactttgggaggctgaggcaggcggatcacttgaggccaggaattcgagactaacttggccaacatggcaaaaccctctc

SEQ ID NO: 168325 - DNA, 312 bp, Homo sapiens
tggaaccatcatgcactgttggaaagtgatggctgcagtgggaaactggcagttcctcaatatgttaaaaataataggtcagacgcagtggctcacgcctgtaatcccaacactttgggaggccaaggcgggcagatcacttgaactcctgatctcagggaatccacctgcctcggcctcccaaagtgctgggattacaggtgtcagtcaccgtgtccaaccccaagtgcctactgacaatgtattgataagcaaaatgtggaatatatacacacaatggaatattactcagccttaacaaaggagggaaat

SEQ ID NO: 168326 - DNA, 108 bp, Homo sapiens
caaaactgtacccatttttccctgaagcacctcggatagttcacatcatctttctgatttttagtttctgatctataaaatgcaattattaaaaaactgtctttccta

SEQ ID NO: 168327 - DNA, 381 bp, Homo sapiens
tcaacccagtcaacccctgaacacatacctgtgattcatctcttaatgttcactgaccaaacctgggacttcagcatacccatgagacaaactgttttaaaattttgctttcaggatttccagtagcaagtgatatataaagatattaggtaggtatttaacagttatcacatccaggcctggcacggtggctcacgcctgtaatcccagcactttgggaggccgaggcgggcggatcacaaggtcaggagatcgagaccatcctggctaacatcatctctactaaaaatacaaaaaattagctgggcgtggtggcaggcacctgtaatcccagctactcgggaggctgaggcatgagaatggcgtgaacctgggaggcag

SEQ ID NO: 168328 - DNA, 281 bp, Homo sapiens
tatattgagttgtccggtgccatgttctacggatgtctgtgaggtccatttggcttatggtggtgttcacaccttctgtttccttgactctcctgtgtacttgttctacccattattgaaagtgcagtattaattagctgggcacagtggtgcaagcctgtagtcccagctactcaggaggctgaggcaggagaatcacttgaacctgggaggcagaggttgcagtgagtcgagatcgcaacactgcactccagcctggatgacagagcaagactccgtct

SEQ ID NO: 168329 - DNA, 703 bp, Homo sapiens
tcatttggctaaaagaaagaatttccaatattcataaagaaaacacaacttgtgggttctccaagcaggagaggaaaaatcatgttccagtctattcctgtaactaatgaagggctcaggtttcaaaggtaagttaattgtcagacccactttattgtacccagtgtccttgggaaacataattatttattggaaatatgtcacaactaacataagtcttaaaaatttgttaaattagaaacaaaatattgtatttgctgatatgttaaaacataagggcctaacatttagaattgcacttctcatactcacaacatgtactcaaaatgctgttaacatctactttgatgattgttttgggtttacttgaatctaatgtttccatttaataattccttttttttcccctttccttttttcaatcaatcctttctcttttctatgttctatattcatgttatcttagaattccattttggccttctaggttctttacttcttcctccagcctgtcattttcatgtcttcagtgatttctcagacttctcacagaaagttaaccatttttgtgcatcttgaaacttttaacctttgatttgaagataaatgctaataaataaatataattcttatgaatacattatgcacaatgttaaattcaaaatgactgacatgtttcatgctgtgtgctatagatatgcta

SEQ ID NO: 168330 - DNA, 456 bp, Homo sapiens
gatgggctgagtgccctccccgggacacacctggatgggctgagttccctcccaggaaaactggtcccagatccgcctcggcttcccgggctgggccaaatgcaatccacttccaacccctctgttcccagggccaggaggagctgtgggaggcccctgatgcccccaggctgggcctgtggcctttggagggggatcaccacactctcccagtgcccaggactctctcctcatatcctagccctgaagtcaggttcagaaatcctgcccctgcccctgcctgctgctctgtttgccaggcggtcctggtctccacccaggctccaccctaccagggtggaatggagttggggagttgggcctaacagcacgggtcctgtcctctttcagggctgtcccggggctccctcccagctgcagccccaggtacttcctcgtctgcactccaacccccat

SEQ ID NO: 168331 - DNA, 441 bp, Homo sapiens
gacgcatttctcacacaattcatttactctctccttatttcttcatcactcccttgtctttgcagaattattcaactcagactgccatgcagaagaaaaaccatgaacccgtaagtgttacattttgaagcaaaagtttattttttcaaagtccattttcccccttagaaagaaatatcagagtgagaaatagcgagtctcacattatctaaaaagcgactctctccggtttttgttccatttattgaaaactccaatttctttgcctcgggttctaatttattttgcaattcgcacagtgcactgtaaacataatgtaaagttttcaaagcttaattaacagctacaggataacggcaggccaagattttaaaggcatttaagcttggctccaagaaatgaagagacttccattcaggaagctgtgaacttgtacctctt

SEQ ID NO: 168332 - DNA, 294 bp, Homo sapiens
gaggggtggtggtggggggagataataacaaactcttctgtagcctgaactcattacttcttataacccataggtgtaggtaccattttctttattttatgaatgagaaaattgaggtccagcttcttggaaggtaagagaaatgagtcccatttcccctaatattaaccgagcaccatttatgtgccggccatttggacccatctaaggggcacaaaaccattgttttttgttgttgtcgttgttgttgaaaccactgtaatggcagcatctttttttgtttgttttagatga

SEQ ID NO: 168333 - DNA, 676 bp, Homo sapiens
gcattatgcagctctcgtctgggaaagctatataagactttcaatctgtgagagcttcttgggggactgagcccagcaaagccaaagaagccaggctgcctgaggccttgggggcccaactgctgttccagtgtgtcaggatgtgggatgtggaagcaaaggagattattcttcagctttaagacttaatgttgttttcccttttggattttggacttacttggaaccacttattcctttcttcttgcctagttttccctttgggaatgggaatgtttatcctgtgcttgtcccaccattgtattttggaagcatgtaactcgttaatttcacaggcacaactggagaggaatttgaatcaggatgaattgtgccttgagtcttatccgtatctgatttagttcacactctggacttggactttagagttgatcctggaaagagttaaaacttttaggggctattgggatggaatgaatgtattctgtatgtgagaagaacatgcatttggaggctatgggcagaatgctgtagtttgaatgtcccctccaaaactaatgttgaaatgtaattgccattgggacagtattaagaggtgggactcttaaaaggtgattaggccatgaggattccaccctcatgagtggataatgtgattatacaggaatgggctcct

SEQ ID NO: 168334 - DNA, 422 bp, Homo sapiens
taaaatcctcactaagacttttgtgaaaaataaatcagaaagagaaagactgaattctgcaaaaccagtcagaaggctgtagcagaaatgtatacaatatttatactgggagtctgggagatggtagtctggaagacaggggtggcagtggggctgaagaaatgtaactggatttgagctgggtttagagaaaaaaaatggacaggatttagtaaatgcagagtcaaagcaagagttaaagatgacacccaattctgactatataacaaagagaataaattgattggaatagggataaaaaagtaccagcagaaattctaaggaaaataaaatcaattgggtttgaatgtgttgagtttgagccatcttagagacattcaggtggagatatcaactaagttactgaatatataaatctggag

SEQ ID NO: 168335 - DNA, 182 bp, Homo sapiens
ggaacacacatttgaataatcagaggaagacagagctctaaaaatgaaactcattggtatccctaaagatgctgtttggtaccacctttgaataaagccatgcagagaattcttaagatgcaaaaagacggatgtgattgaaaaagactgatattataggcaaaaatattttttaatgctta

SEQ ID NO: 168336 - DNA, 335 bp, Homo sapiens
gttacatttcatactgtatacccaaacatactgtattgtgtgtatcaattattacataacaaaaaacttttcaccaataaaaatacatggatataatacagaagaaactcaaatggtggataaacacagattttcaatcttattagtaatacgaaatgcaaattaagaccccaataagataatatcttacacccatttgattggctagtgaattaagaagtctgagaatttcaagtttttgttgaagagctaaaagttaagaatctcatctattgctggtggaagtgtaaatttattttgctggaaaataatctgtcacttgtaatgtagtctac

SEQ ID NO: 168337 - DNA, 281 bp, Homo sapiens
aagtagttctattgtcagcatccatgcccggccgagagaagaatgacaagtctccagcatgcgagggcttcagctgtgacaaagaaggtccctggggccgagtggcaggtgctgcagaggcccaggaaggcagcacacacctggaggcacaggcagctacagagacagtaacatgtgtctccttgggacagccatgccaccaagaacaactggcccgggatcgggactcacagctcgtgccaagggctcaggaaaaccaagcccagcatatagtctggctg

SEQ ID NO: 168338 - DNA, 381 bp, Homo sapiens
cagaaatagtccaaaaaaagaataggtatcatcataaccctacgatcataatgatgaaacagcttgattctatgcattattaattaattggttaatttgtattctaccttattcaaaagatttgtggatacttacaaatatgcatgtagtgcaatagaatataataactgagaaatgagagcaaagggttaaatcgttgatcaaagccagtataaagttaatgtgcagaaatgcgtattagtacaactactcttataaattggtatatttcttcttagcctaagtctgtatattttccgtagctaattctgctccctgccccttaatcttatagcaacattttccacgtttctttcttaaccctgatagttaaggactgaa

SEQ ID NO: 168339 - DNA, 443 bp, Homo sapiens
ccacccccacctggctgcgggtcttggcaatgctgattcacctctctgagcctcgctttgctcatatgaaagagaaactggagtgctaagaggacctcatggggttgtcaccatgcctgggcgggatgaggcgtggaaagtgctccctcaacgcctggccctgtagggaatgggctgcggggctgtggtgctcgtttttatgattttcctgtcccccatggggaagctctctgccccaagcctctcttgtatgtggccttgggcgaagcagttttcccacttgtcaaggagattccggattctatctgggggctgttggagggacccaaggggcgctcagatagctgggaaggagctggttgggacttattcattgaacaaatatatatgaagcacctactgtgtgctggcccttttctaggcatttaatataatttgatgaa

SEQ ID NO: 168340 - DNA, 335 bp, Homo sapiens
aatatcatatatacccaactatgtaaaactttgtggtaaaaggctggaaagaaaaaggcaaaggtcaacatagttgtaatcagagtggtggaattatgccttaaaaatcctcttttaaaagaaaaaaacctaatgaaaagctgaagaagtactattataaaccatacctacactctggtcacctctctgctacagcactttggacaaactaccgttcttttacatatatgtctctccaacaggacaaggggcacagcttacgcatcttcacgtcaagggtctagcttggtgctggcagccagcaagcaccaaaaaaaattaaaaactgccccagt

SEQ ID NO: 168341 - DNA, 305 bp, Homo sapiens
cctgggttggtgccggctgtggtgggaggcctgcggtgggagcctccgggggccactggacctttcctgggtggcctgtggcctgggagctgcacttggttcggtgcagggaggttgtgacatccactctgtctgcagggatggccggggccctgcggctgggtgatgaggtgggatggaggtgtccggggctgccctgcctccttttgccaaaataacaaaaattatcttgtttgttgtgaaaaaacctgttttcccacattggggcatggagggtattaactgtgatgaccttctgagttcct

SEQ ID NO: 168342 - DNA, 550 bp, Homo sapiens
cccccaggaaacagtatgactagaaataggaggggagcaggaagtagggcacagggacacggacatacacacaacacacacaacacacacacacagacacacacatacagggacacagacacacacagggacacatacacacagaaacatggacacacacacacacacacacacacacacacaattttaggattgtctcttgcataatcattacccaatatacccaggttatttagatcccacataatgaagggcaggtcaccggtgattacattcaaaacaagacaaagactgcagcatgattaactttcacttccctgaatacagatggatatttaacaaaagctggctcatgattttttctttttctttcttcttcttcttctttttttttttttttttgagacagagtctgtctctgtcacctaggctggagtgcagtggcacgatctcagctcactgcaacctccgcctcccaggatcaagctattctcatagctgagattacaggtgtgtgccaccacgcctggctaacatttgtatttttagt

SEQ ID NO: 168343 - DNA, 125 bp, Homo sapiens
agagtgaaattataggaatgggaaagaatatgtctcctattctttttcaggagaagtgactatgtcagtttgtttggagtgcaaagttcatcacagtagatgaatgaatggttagaaaagaaagg

SEQ ID NO: 168344 - DNA, 270 bp, Homo sapiens
gttcagggataggttcaggaaactcattcaagtttcatatagcacttattatttctttttaaaaaacattttatttggctattaagaacactatgtacaaaagagctgtcaaaatgttgagtaaaagtggctacatcaaaacagccatgtcagagtatcatgtttcctattagacagatatttgttagtgacatatcctagtttaagagttaacagaaatgggacttcgtctttccttactataaatctggtaacttactagttgaaagg

SEQ ID NO: 168345 - DNA, 423 bp, Homo sapiens
ggagggagggagaagggggagggacagggagaagaaagagaaagaatagtattagtcgtggccaggcgtggtggtgggcgcctgtaatcccagctacttgggaggctgaggcaggagaatcacttgaacccaagaggtggaggttgtagtgagccaagattgtgccactgcactccagcctggcgatagagcaagactctgtctccaaaaaaaaaaaaaaaaaaaaaaaaattgggggctgggctagaaaagaattcctccaaatccatggctcagtgggataattttctcttcgttttgagtatgtgggtcatagacaagtattactattattttttattccgtgcgaggaagtgtataaatgtagagcatttggtgaccgtatgtcagggaagggctgtttacttttgcacctttgccaca

SEQ ID NO: 168346 - DNA, 984 bp, Homo sapiens
agaccagtaggagaggaggagattgactgcgaagaatcctgaggggaaaagctctaagtctggattgtagggggggttatgactgtgcatttgtcaaaactcatcaaacacttcaaagggagaaatgttgctatatgtcagttataccttaataaacctgactttttaaaaaatggagatttccaagccagagagagagagagagatcgtgtgactacaggattgctcctgcatctcttcctaatggcacagctttgaggtgcttaattgcttatttgcgataagtcaatcaagagaaatctggtatacaaaatgtctagtgattttggttttctgcttcctcatataagcagataccagaaactaggcctttttcttttcattcttattcaaaaattcatccaagggctgaagttgtcatcctccaagattccttatttgggtatttctgacaactcagggaaatttatctcagatcattggcagctttccagaacgcttttgtttggcagccttgtgacagctcacccatgtcattattagactgggtggcacaaagtccactgtctcaatcctcatgggctgtcatgcccagcaaggtcacatggagcactactctgtcccaggactgagcttagcatctttgtggttcaccttggctgagtaggggcagtaagaacccttagcctcccaacctgtttagcaagtccctcctttttgtttactcaccacccagctgacttcatgaagcctcattgccagtacatttcaagatcgatataattatagtgaaaggtatgtatttgcttatttttaagaccaatgccttagcaaaacagtctgaaagaccagaagtctctcccttgttggtgatgtggccaggcatacttttccttaacaatgccaagtggagatactaaaaccattggtagtgaaaaacataatcttaaaattgtaatgtattagcaacgacaaatacatagg

SEQ ID NO: 168347 - DNA, 217 bp, Homo sapiens
ccaccacgcccggcctctcttttcttctcattaaaatataactcttacagaaataataagaaaagtaatgaagtaatgagtctattattttgagcccatccaaaaaaaattgcttaactggcaacagatagaaaaataagatattgaattatccaaaagctgattagccaaattatttcttttttcaccatttttttgcttatagagaattcgagta

SEQ ID NO: 168348 - DNA, 409 bp, Homo sapiens
acaccttcaagtgttagatacgcactatcaccgtgcatcacgaggaaagagaagggcccacatggttttcatacttaggaaaattcagctttaatcaaactcagttaattattgactcaacaaggatgaaactacaataaaaccatttttgccagaggccaaactattaagaaacctcgtgtacttcatagacaaaaagccttcagaagtattccttgagccttcataatattccatcttaacaatcattattgtgcttatctctcaatgccaataaaggagagacaatcgaggaagttgcctatgtatttaaggaaaaaaaacagaccagtaacagtggctcctgcctgtattcctagcattttgggaggccaaggcaggaagactacttgaaaccaggagttcgaga

SEQ ID NO: 168349 - DNA, 358 bp, Homo sapiens
tgttatcatttattctagattgtatatagtgagtgatcatataacttatcacccaaaccagcacattgaagcagaaaggcgcaattaaatttataccagggcaacagaactaacaggcaaatgaagaggtatggtccctacatataatataaaggtcaaatggcttgttcaaagtaatgacagatgagtgccagagccaaagcacattgatattgtagcctaattagatgtcactcacagctttgctttccacagaactagttatatactttacatggctccttgcaatacgtaattctctttgcaaattagatcctaaaggcatttacggattctgagattatgagctgaaaattgc

SEQ ID NO: 168350 - DNA, 489 bp, Homo sapiens
caagcccctaacgatgctggatgtgctggccacactcaccagtgctgcctcctctgagactgtcagctttatatctgcttctttttatcaatacgggcaaataattctctagacatttatcattttaaactgtcacagtccagtgcctttcccgaggaccacaatcaatactgatctcggtttgaatacttttctgacaaggttcctatttgtagattcacaagtagaactaatgtgtgttaaagctattcagtttggcattttgcagctccattgacacattaaatataggcgttcaccacgacgattaaccttacaactattaagtaataaaaatcccacatacatatttattagctgaacatcctattccggcatgatgccttccccgacgaggtctttccatgatgggaaaccagagaaggtggaggtgctgctggagagatgagctcactctttgcagagaatgtcaggagggatgtgggatct

SEQ ID NO: 168351 - DNA, 121 bp, Homo sapiens
ctgttgtagctccaatagcttgaacgatagctaaagggcactgaatgtttactgtatgtgaacgcatgggagagacacttgaggataccatctcatagagtcctcccagtgattctaagag

SEQ ID NO: 168352 - DNA, 440 bp, Homo sapiens
acaggatcagaatcggaagaggtagagtttgtaataataagcatgtattacttttcttcctgacatagaaggttccactccacttctaccttcgatgagcttataaatcaatttaggaaattaagagaaaaccaaagaagttatgggttgcacaggatgcctaagtagattagaaaaatgaataaactgtcacttcaaaaaccattaggagggccatgacacaaggggacgtgggattctttatactgtggctaaaaaaaatagttaatagctcttagttccattctttttcctcctaaagttcctgaatgtggagactaaatgctgctgcagaagttaggcttcacacagtttgaaactgatcactttttacatgcatgtataatctcagagttgttattacacttaactggtgatgacgagaatactgataatgatgg

SEQ ID NO: 168353 - DNA, 550 bp, Homo sapiens
ctggaacttcaatacatacatctaaacttatgcaaacattaaatcaatatgaaccatagactgaaatctaaaatttaaaactataattcatgaattatataatatatagagaaaaatattcacagccatatattagaaaaaaggtctgttttgtgccacagtacccattacaagaaaaatatagataaattggacttattcaaaattagaacctattttttcatgaataagtgaactaaatcctgctaagtgaatgaaaagacaaaccatgcattgtctaataaaaggaatcaaagattcttgaagtggttgattcacctgatgattaggagtatcttctgctgtcggagaataaggaaatatccaaaaaagtctggagatatgcttaaatggcacagaaaacaacctaaaaaagctcctaagggctaacattagaacattttaagtaaaaataaataaataaataaatacattggattatgacccagaaatgttcattaggtagtgaatgaaaaaacaaattgtagaatacctaaataataaaatatta

SEQ ID NO: 168354 - DNA, 281 bp, Homo sapiens
gctaaacttcgaagaggaatttattgtttcctacagatgacaattaataatcaatcttgcaatgtttactgaggtcactatcctcagtgctatacgtgttctgtgtcccatagacttcagggtaactacatggtccttaaacttacaatctaaagtatttccatgagaccttccttaatagacgtttgttctcagccttctttcaatagcaacatcctttgttcacatgaggatgcataaagaaatacaatacgtaaaaacatgttatcaggaccgctctc

SEQ ID NO: 168355 - DNA, 397 bp, Homo sapiens
tgattttaaattcttagaatggttcaaagtttttcacattgagatccagctccccatctttcacctggaggaagaagctctgtggggggttagaaacagggggatggctgtgcatgctttgcttctgtttaaaaagggaattcagtctccagaagggaggggattgcactggatgcttggagcaggcatcagaacatgtagatggttttggataatcttcatatgaggttatcttcaataactcaaagagttgattgacaaaaaatagttgattagccaggcacagtagttcatcccctgtaatcctagcattttgggaggccgaggtagcaagattgcttgatcccagtagttcaagaccagcctgggcaacaaagtgagaccccatctctattta

SEQ ID NO: 168356 - DNA, 251 bp, Homo sapiens
aatttttcctcttagtaaaagtgttatcataaaaataattctgagatgggagccatgcctaggagaaaattaattcattgtcctatccaatgggcttacttagcttttacagctaggaatgtcactaaggacttcacagaggagctgatattgagctgagtctagaggatgaatgacagacctgaaaatccaagcagagtagaagggccagagatatgacaggatgtggaatatgagaaattgtgttcaaa

SEQ ID NO: 168357 - DNA, 207 bp, Homo sapiens
atgtgaaaaagataaaacaacttattagaggactgtaacctatataaacaaacatataaaaaaatgagaacttaaaagtacaataactcaaataatttaatatatgcattaaaggcatttgtatatgtccagaaagtggtttagtattccaaaagataaaaatttaatacgtgtaaaacaatacaatttgtagtgcatagaaaaaag

SEQ ID NO: 168358 - DNA, 463 bp, Homo sapiens
gagaccaaacaatgactcagacaagtccagtttggcaagtagatgagtttattaggacttatataggaggtactcccggacagcagcaggacagctttagaggcccatgctgcctcccatccctatgctgcttttaaactaattttctggctctttgcctactgtgtgtgttatgggacttttttcccaggtaggttctcagatactctctggaatgtttgggttctcagggacacctgctccttgacaggacagaacaagaccccatctctaaaaaaagaataaaaaggagtacctaaaataaggattttaactaacatttaataccatatgtttactttgtaacttttctaaattctaaatttcataaagttaaagaaagttgtttatttgaagaaacattgcctttccacttaggggaacatcatcttctcagctggctgagtttactctgaccaaacac

SEQ ID NO: 168359 - DNA, 307 bp, Homo sapiens
gtacaaacagaagtgttcctcacttgcgtaggctaggtgccacagtacaatgtgaagggtgcctccatatgtgtttatggttggctaacaatcactttactctctctctggaaatggactgtgcctgcacaaccttccagatgaaacaggcataaactaaatgatgatgggttaaaaaaatgctttaaagttgtaatcaccagggaaagaattccataaccatccattggttaatggacgggatattattgcatcgaatctcttggtatcagaaaactgggctggatttgagaggtgaccccatata

SEQ ID NO: 168360 - DNA, 386 bp, Homo sapiens
tgaggtttattttcctgtctcaactgtcaggcttctagagattaaggactaacaatacattgaaaaaaatgataacttactttattcttacgtgttgcatttgaggctgtttactattttatgcaatcatagaaatatgtatgattttgaatctgtttacaagtataattctctcagatttggaactattaccccagttttctaattggggaaacagaggcttactgtgcatatataacttgcccaagttctcactgctgatctgtagtgaggccaggattagaagccagagtttcactccagagcctgtattctttcctccatcacacactccctctgtaagctctacactttctcccctagcctcaacaacctcaacatttaac

SEQ ID NO: 168361 - DNA, 102 bp, Homo sapiens
tgtaggaccgtcgcacatcgcagcgggtcaaccccccggacactcctgcttggcccccattcacccaggagcacctttccactgggaaaagcaaaatgtcct

SEQ ID NO: 168362 - DNA, 493 bp, Homo sapiens
gaccattgctggcacacattcagagctgatataagtgtcttgctcttgcattgaataagatgcactttttcttgtcagccttcctttcttttcttatgaacaggttgcaacccagcgtggacagagattctgaaagtcagacagtctactgtgacgctgctttggagactgatggagcaacctgtgcttctgtggatggtgtcgggaggtcccggctcctcctggagctcagctgcatgctgtgtgctttggtaatttgcttcactccttgcaggatacaagggcaccatttagaaaattattactggtacagtcactggatggcaggaacctggaagaatgaatgcagtttccaaggctcctaattacaattccaagagtagctttctacagtacactagaacttattcctcctacccagctgtaattttatagttgttaactaactccagggtaagtattaagtatggttaacaataacttattgtgtatt

SEQ ID NO: 168363 - DNA, 444 bp, Homo sapiens
acctggcaggatgctgagagggctcggaaagtcagacttaacttttaaaatgccaaaaaaaccctcagagtaggcagttttcaagtttatcctggagctaatacagaaggtggaggtgtaaagctgtcttccctcaacctggagggccctgagaaggaaagaaggcacaaatcaggcatgagcctgacccgaaggtgtgctctgggggggtgaggccctggccacacaggggtaacaggttgtaactgggtcatgtggtcaaataacagttactcctgggaggcaagaccagcggggaaatggcaagtcaccctttaccagttattctcaagctgcctctttacaaccggagttcctcttcccatgggggtagaaatcaaactgatttgatgtctaacatcttgggaagaggtcattatacagggccatgtggcctctacagcc

SEQ ID NO: 168364 - DNA, 298 bp, Homo sapiens
tccagcctgggcaacaaaagcgaaacttagtctccaaaaaaaaaacaccaaaaaacaaaaattagctgggcgtggtggtgcatgcctgtaatctcagctactcagggaggctgaggcaggagaatcacctgaacccgggaggtggaggttgcagtgagccgagatcgtgccactgcgctccagcctgggcgacagagcaagactccatttcaaaaacaaacaaacaaacaaacaaaccaacaaacaaaccgaaatttgttttctggcctgggttcaagtgactctcatgtctcagcct

SEQ ID NO: 168365 - DNA, 354 bp, Homo sapiens
gacctgctggaggaggtgaggcgtcgggggggcaggcagtccagggtggacctgctggaggagatgaggcgtcggggggggaggcaggcagtccagggtggacctgctggaggaggtgagacgtcggcagggggcaggtcttcacaacagcagaggcccaggcccgggtacaggctccgtagtctcctgggacatggtcccgacccacggatggctgggggtggtctgaaaaggtcctggccctggggaggtggcttcctcgctgctgactgccgagggggccctggcctggatccatgctgggcagaagcagctggacactgaccaggaccccccagggccggaggaaccaag

SEQ ID NO: 168366 - DNA, 111 bp, Homo sapiens
aaaagaaaagaaaaagaaaaagaaaagccagaaactctggagacaaaaacataaataaggagaactggccctaccatctattaaaatatagaagttcaataattaaaacta

SEQ ID NO: 168367 - DNA, 519 bp, Homo sapiens
tttctccagtggggacaacagagtcatcagaagtgaatggacaatagcaagtcctataaataactgaaataacaaaggattttgaataagcagtaattgatggttaagctgctagtcagttcttagactttgaaatgccagtttgaagtttgtcccagcgaaatggacttggaaactttgtgtgagagaagagggactacaaatcctaccagaaattatttggttgccactcaggaaaagatacacctcctctgggtcttacgtcattcttcaaaatgctctgcaaaaataaaagctcaatctcagtgaattttacccctactccacttacataatgtcctgtccgctactcccactcttagtagaagtaaggaaaaatcatggacatacttggtaaggaaagaaacgcagtttttaataaaagctccaaaagtgattgatgcgcagccaagatgcagttcactggtcctcgggtgtatgagaatgatgcccacgactgtagtcaactctgatctctcc

SEQ ID NO: 168368 - DNA, 149 bp, Homo sapiens
tataaatttttttagcctgtttccttatctttagaatggcacctactatttatggtgcttcaaagactgattaagaaaatcttaaaacaggccagatacaatggctcacaccagtaatcccagcactttgggaagccaaagcaggcaga

SEQ ID NO: 168369 - DNA, 274 bp, Homo sapiens
tgaagaaacttgtgcacaaagaagttaaatgactcatccaagatctcataattaggttaacctatcatccagagcttttgcttcctagtccaaaatcattttgttttgttttgtttgagatggagttttgctcttgttgcccaggctggagtgcagtggtgcagtcttggctcactgcaatctctgcctcccaggttcaagcagttctcctgcttcagcctgctaagtagctgggattacaggcacttgccaccatgcacggctaatttttgta

SEQ ID NO: 168370 - DNA, 624 bp, Homo sapiens
caagaaagaaggacttgatgatgttttcctctgttttaatataaatctgctttcctgattataaaatatgtgcactgacaaaaatttagaaaatgtagaaaaacacataaaagaagaaaatcaacttaaagttactacccagggataacattgttattaacatagtggagtgttttttctagtcatttttctttcttgtttttgtttctcatcaatacaaataaacacgttatcgacactgagtatatgattctaattgaatcagaattgaaagacatttaaagggaaacataattggggtgagtttattcaatattttatacaatttttaatgcatctggtaattcaggcaggagccagcttcttcattgatttatctggtactttcatattttacaaatttgggttcattgtacatacaggttatcatgcttttaaatttaacattttaatgattattttccccatatgtaatcttcaaaatttgacttaactgctgtgtactatcccatcaaagagagagattgttatttattcaaccattcttctattgttacatatttagatcgtttccatttttattatcatcctgtattgcagttgactaaacatctagctataaat

SEQ ID NO: 168371 - DNA, 387 bp, Homo sapiens
tggcattccttgtagatgcatcactttaatctctgcctctgtcttcacacagcattctcctccatgtgtctctgtctctgtccaaattttcctcttctaaggacaccagtcatattggacttaggtttcaccccaatccagtatgatctcattttaacttgattacatctgcaaagaccctgtttccaagtaaggtcacattcacagattctaggtggacatgaatttggtgaggggagggggtaggggactggatactgtgcaacactatgtaccaggcactgtgctaagtactttgcatacattgtctcatttaaccttcacaatactcccctgagattcctttattattattattcccatttcacagatgaaactgaggcttag

SEQ ID NO: 168372 - DNA, 107 bp, Homo sapiens
ttgcttttcaatcctatcctttctagatggcaaaaagttctccacctaaggaatggtttctgggaaaaagataaaatccatggtggaattataaagtcatttgttaa

SEQ ID NO: 168373 - DNA, 217 bp, Homo sapiens
atccaaagaattcggcacgaggagagaactagtctcgagtttttgaaattttaatttgtgacatctgtttttaagtatttctgtagatacaaaattttcctcagttgaacacaaatactaattattttttccatgaagcaagaaaaactttcaattctttatgtactatgtgtatgtatatatgataaaatgtttagatattactaaatatacactt

SEQ ID NO: 168374 - DNA, 663 bp, Homo sapiens
gaaaggtgtaagagaacatgtggtgacttgagttgacaaaagaacatactggtgaaaacgtggcaccagagttctgaagagattggcactccgagctgtgcattaggaaatcatgttgccatagaggtggtaactgaagtcttgggatttttaagaacacgcttactgcctatatagaaactgaaaaggtaggtggtggataaatgtgtgtctggagttgtttaagaatgagttaacaaaaagacaacatgcttttgttcaagagtcaatatttcacagttttccagctcatggaaaagactgaaataaatagaaaaaggaatctagaaagaagtactccttattctcttgaatactctttgaagatgcagaaaatattctatctaagaacactcttacaccttaatgtatactttaaaattttaatctatgctgattagaaacacattcacactggaatcattgatttgcctttttttccctccacactatagtacatgctatattttgaagtttctttgagggccaagggcttttatttttagaccagaagacatgaaaactctcaagaaggaaatgcatagaagtgtagccacacatttggccatataaaacagtgtaaacagttttcctgttaagaactgctgtcaggaaaaccaaatc

SEQ ID NO: 168375 - DNA, 328 bp, Homo sapiens
ctgaccaacctctagaagtgatgggcctaaagaactcttggagctaaaattctttgtcacctgtaatgccagcgctttgggaggccaaggcaggcagattgcttaagcccaggagttcttgaccagcctgggcaacatggcgaaaccccggctctacaaaaaattagccaagcgtggtggtgtgtgcctatagtcccagctatttaggaggctgaggtgggaggatcacctgagtccaggaggtcgaggctgcagtgaactgtgatcatgccactgcaatccagcctggatgacagagcaagaccctgtcactaaataaataaataaa

SEQ ID NO: 168376 - DNA, 399 bp, Homo sapiens
gctggctggaacgcaacttccaaggatggagggaaagaggagggaggttcagttagtgggagtgctctttattatctggtattctctccctgttgaatgctccctccccctacacacacacacacacacacacacacacacacacacacagtgcacacaaatgctacacagtgaccgtgtcccagacgtttcaacaataggcagctgtctttctctggattcctgttcagacccgctcttactggctctctgggcccttccagttctatctcagacccttaaacaatcaggcatgaggattgtgaaaccagccatgtctctggggataagtggtaccagtgaactgcgtttctccagtaccccggcaggtgagatgtgatgaacagacctttggcttga

SEQ ID NO: 168377 - DNA, 332 bp, Homo sapiens
gccacatgtgactatcaaatgcttgaaatatggctagttcaaattgagataataaatcaagataagtgaaaaatacgcaccagattttgaaggcttattgtgaataaaagaataaaatatttcactagtaatttttatattgcttacatggagacagtattttttatcttttaggataaacaaaatatattaaaaataatttcactttttctttacttttttaatgtggttaccacaatatataaaatgacatatgtggcccccattgtttctactagacagcattgctctaaatttaaaactaaactagcagtcaattaattaaaaaggat

SEQ ID NO: 168378 - DNA, 266 bp, Homo sapiens
gaagcttcccctctgagccctgcacggtgctgtgctgatcgtttcagcgtgtcatctccctggagaggacagacagccttgtggttacacctgttatcatcctgccactgaaatctaagcttgggaggccagggcaccacctgtcttgttccatattctattcctagtgcccagcacggcacggcacatatagaagatgctcatgtgtacatcacaacggaatgaatccacatttcactgaggaggaaactgaggctcagagacag

SEQ ID NO: 168379 - DNA, 564 bp, Homo sapiens
ggtcattcatctgcaaaacgggtaaaataatcattctgccacattgactttttggaaggattaatacacataagctttcatcaaatggtagctacgtatatgatgattattattatgtttcagtctacctgtgaaccaagatttgctttctccttccctgtaagaccttcatcttcataaaaggaaaacacatcagtgtccgttaaactgtatgtttcagcccttccagaaaataatcaggaacacacggcagtcccggctaaatgagtagagaatgaactcctggtggatgggcgggggcgggggggtgcgggtgacacacctaattcaatgttgatttttctggccaccgaaaatattcctttttacggacctgctggagctccttagattaacaacctcggccggcactcatcgcccccaccctggcaaagcttcccagccagggagaaggtgtgacttcagacttcgtggtaaggatgggggttggggaggcggaatgcaggccggtgtgtgaggtgattgtaaccagaaacgcctaggcaggcatctcgcttctgtcct

SEQ ID NO: 168380 - DNA, 149 bp, Homo sapiens
ggagacaaacattgaatgccctaaagcaaaaactcaaaaactgcctagaactatgtccctatagagatgtatgatgttggagttggcctcctctgtcactctcagggtaagatgcttttgttagatatgcattcaaacaggtggattag

SEQ ID NO: 168381 - DNA, 178 bp, Homo sapiens
ccctcccttgcaaaaggaaccagctgccatgttgctgaaagtgggcccacacacaaccctcatttctcacgagagctaacagatgaaagctcagctatgcagtgttaaaattcatctctttctctgtggtttttaaaaaaatgcatttctaatcttacacttcacgtggcctccaaca

SEQ ID NO: 168382 - DNA, 405 bp, Homo sapiens
ctgttgaaactattctaggaaaacagctatggaaatatgcatgtttcagcattgttttcttagaaacaaactaaatgccaaacaataggaatcctagttaaataaattatagtttgggcatataatggaatactattttgccactaaaatatatactgtagatacatttttattgccatgaaaagctattaacagtacattaagttttaaaaggaaggttagtatagtatgagacttttttttataaaaactatatatcatatatagagaaagggcatgaaaagacatatatcaaaatgttgacagtaattgcgtctgggtgggaaaattacaggctttgtttttctttttgcttatttttattgcctactctttttgtcatgtccatgtattattttcataaaa

SEQ ID NO: 168383 - DNA, 555 bp, Homo sapiens
ttcaacccaggtcaactaccattctactttacttctctctgaatttgacttctatagataggtaccggggtataaatgaaatcatatagtatttatacttttgtgactggcttatttcacttagaatagtatcttcaaggtcattcatactgtagcattatgtcagactccttccttaaggctaaataatattctactatatgtacataccacattttgttgatccattcatccatccatggacacttgggttgcttccactgccatttttaagtatacattcagtagtgttaagtatgtcgccattgttgtacaaccaatctccagaactttttcatcttgcaaaacaaactctgtacccattaaataacattaaacattccattccctccagcctcagcaaccccattctactttctgtttctgtgagtttgactattccaagcacttcatatcagttaaatcatgaagtatttgtctgtctgtgactggcttatttctctgagcacagtgtcctcaagatgcgtctatgttgtagcatatgtcagaatttcc

SEQ ID NO: 168384 - DNA, 337 bp, Homo sapiens
agacggaggtttgctctgttgcccaggctggagtgcagtggcaccatctctactcactgtaacctccgtctcccgggttcaagtgattctcctgcctcagcctcctgagtagttgggattacaagtgcgtgccatcacgtccagctaatttttgtatatagagatgggttttcaccatgttggctaggctggtcttgaactcctggcctcaagtgatctgcacgccttggcctcccaaaatgctgggattgtatacaggcatgagccactgcacccggccttattgttattttaaatatttatttgaccatttttgtgttcttggggtaactactgt

SEQ ID NO: 168385 - DNA, 461 bp, Homo sapiens
cgtactggacatcacaggtctaaaataattattataatctggatgaaaaatatgtcacattcattctgtcacttttccttcttttgcctatggcaaaaaccactatgatcacaggactctttttcctttgaacatgggcaggctttcagaattctccatgcaaggcgaggcacggtggctcacacctgccaccctagcaccttgggaggctgaagtgggaggatccttggagcccaggagttggggaccagcttgggcaacatagtgagacctgtctctacaaaaagcaaacaaaattagctgggcatgggggtgcatgcgtgtagtcccagctactcagaaattgaggcaggaggactgtttgagccctggaggtagaagctacagtgagccatgatcgcggcagtgcgctccagcctgggtgacagagtaagactctgggaataaataaataaaataga

SEQ ID NO: 168386 - DNA, 321 bp, Homo sapiens
gttaggagttcagactttgggtctgaattccagccccactatgagactttgggcagtcacttggcctctctaagcttcagtctcctcttccacgtaccgtatttagctctatgctcagtaaatatccccaccattcagagtgtgaggcatgaggcctggtgctggccagacatgaaagaaccacactgctcttcactgtggttcttaaagtccactgaaagaactcaacagcctagcacaagggttggcaaactttacctgtaaagagatgggtagtaaatattttgggccttatagaccatacagtacccatctcaactt

SEQ ID NO: 168387 - DNA, 413 bp, Homo sapiens
agggtggttaagggaaggcttccttgaagaggtggcatttatgcggacacatgaattagttgagggagcaaatgatgtgtatatataggggaatattttttcagacaaaaggaaaagcaactggaaagaccctgaggcaaacatgagtttcacataatgcaaatatacatatttagctttttgaatctgcttagaatgtcttttccccccattttaagtagaatgtagaaaccttacatataggtctacttaacctgtaccccttacgttagagttgtcatgaattacgtctacatatgtttaaaaccccattagacaatggtacagttattttcaaccatcaaatatatttttaaagaacttagtacctgtcaatgatagactagatgtggcacatatacaccatggaacac

SEQ ID NO: 168388 - DNA, 287 bp, Homo sapiens
tcacaaagaccacacacggtatgattccatttatatgatgtaagttatatctcaataacgctatttttaaaagactagtcatctttaattgggtaggctggggggaggagtagagtgaagggtacatactctctcgtcataaagttaatctaagggagccaataaacatgtttcccaagagggcactatacaggcaaaataagtgatggctcatattactgctgggtgacaaggagcatccttcttacatccacatatgcacagtcttgcattgcagaatggtattt

SEQ ID NO: 168389 - DNA, 340 bp, Homo sapiens
ctttcttcatatgatgtcccttttgcagcaaatccccaactccaccccaggcaaccactgaccagcttcttgtcactataaattaagacttttatagaagctaaataattttaatcaactgaaggctaaaccaaaacagctgacatatagtgtcattatcaatataaataaaaatagtgaaaaaatatgacctcttctaaaggaaagataaaatgtttgtggagttgactattcatctttgaaatggaactgttacttcagaagtaacagcagagttgttaaccacgtcccagctgagtgacaaaatcattctgttgcaaaaatgaaataaaattcattt

SEQ ID NO: 168390 - DNA, 191 bp, Homo sapiens
cgtccacccggaccgcaggggagtaacaagtgcctgacttgtcccaaactcccagtcctgaccccccagggacgccccttcccgaggtccaaggaaggacccgggcttgcgaggggcagcaggagggagactctcccggccaagggaggaggcaccttccaaagcccttcctagcagcagccccggcgcgg

SEQ ID NO: 168391 - DNA, 402 bp, Homo sapiens
aatagctttcctcctctcccccaccccttatttcccaatgctggggtagccactgaaggctttgtgtcttatttaccatgaaggaatattttgaagctattaaaagtgatccttgattgttaccaaggttatatagagatctcgaaaatatttatgttatcatgttataaacgtggcaaaatataaaatgcactgtctgcaaccatgtagaaaatacatgtacatatggaaagcaacatgtaaaacaattatatagctatgttaggctaagtatattaatgtgagatgattttcaaaattacaaactaaagttttcacttactcattatttttgcattgataaattctgaagaaaatattatacatacaatagcgaaaatagtactcactgtaagtatactt

SEQ ID NO: 168392 - DNA, 126 bp, Homo sapiens
cctccctgccccctaccacagcctctttgaccttgtctcatactactgtctctctactaccgccgcccagctctgctggcctccttgctgttctttgaacatgtcaggcacattctcacctcaagg

SEQ ID NO: 168393 - DNA, 257 bp, Homo sapiens
tgtttttcatatttggtttgcccagagaatgtacattttggttcacatatggaaatcagccctttgtagatagttacagataggaatttccagatgatcctgtctaccttagtcttgtcttaatggaataaccatatttctgtttaggagtgggttaattcagctgcctttccaaggtaccatggaaaaattctctaagcctggattccaagaaatactactattgatgagaattagagcactggtgtttttcaaat

SEQ ID NO: 168394 - DNA, 733 bp, Homo sapiens
cagtggcacaatcaaggctcactgcaacctcaaccttctggtttcaagcgatcctcccacttcagcctttcgagtagctgggatgactacaggcatgggccaccacacccagctgatttttttttttctttttagtagaaatgaggtctcgccatattgctcagactggtcttgaaccaacacatttttagctttttaaaagacagccttggccagccatggcagctcacacttgtaatcactgcactttgggaagctgaggtgggcagatagcttgagctgaggagttcaagaccagcctgggcaacatggtgaaaccccatctctacaaaaaatacaaaaattagctgggtgtgatggtgcacatctgtggtcccagctactggggaggctgaggtgggaggattgcttgagcctgggaggtcgaggctgcagtgagctgtgattacctcactgcattccggcctgggcaacagagaccctgtctctatttaaaaaaaaaaagaaagaaagaaacctaaaaacagactggcacttaaaagagttgtgcttcattttttgactttctgtattaattttgtttgttcctttccttaaacaagctgccactgctgctgattcaacatgtttcattttatactttttttttttttttgagacagtttcgctcttgttgcccaggctgcagtacaatggcgtgacctcggctcactgcaacctctgcctcccaggt

SEQ ID NO: 168395 - DNA, 489 bp, Homo sapiens
tggcagtagtctccccaagcacttgaaatgtagcccttcggaaataatgtcagtactatgccacttgtcctaagacgtactcctctgaagtccctcactgcctgccatactcgatagggataaccagtaggcttgtaaccagcacagaaactgatacactgtgccgtgtttggaactcggaaaaacccagcttagaaacccgggaaaatcccaacattttttttcccatgctatctggaggccagggcctgctaaaagtgcaaagcacaagggaggcccaaatgggttcaactccgacactcgagaacgcaaaatcgagatgacgccactgcactccggcttgggcgacgcgacgccttagtcaaaaatagctccggagacacacaaaatcccactcctctccccgactttgttcccgggagacccgcccctgcttagcagcgttttcccgagccacgccccctaatagtgcaacagctcttttactga

SEQ ID NO: 168396 - DNA, 371 bp, Homo sapiens
ttataaatgaaattgctaggcatggttgtcacacctgtaatcccaacatttgagaggctgaggtggaaggattatttgaacgcctaggagtttgaggccagcctaggcaaggtctgtagagactcggtctctttaaaaaaataattaaaaaataaagatgctctaagaagtcaaaggcaacactcagaacgaacagtgtgagtggcagaatcctacactgcccctctccccaagatttcctgccctaatctctgggactataaattatcacacgctgattatgtcattgcctggaaaagaggattctgtagatgtaattaaggttactaaccagctgactcaagagttaatcaaaaggagtttatccaggt

SEQ ID NO: 168397 - DNA, 666 bp, Homo sapiens
ttttatgtcacgctgctcctactaggcaggacatttattgaattgaatggagttcactgagtttaatctcctacctgaggggtgataagacatgaccttcatttaaagatgaggaacttgagatccaaagaagtgaagagcttcactaagtgcaacagagactcagagcttaacttctttagaaccttttgatccagccatgctagggtgattgcatcctcgctcaaacagaagggttttccaggctgtgtttgaaaacctccaggagccaggaactcagtgttcccagaaccacacagcataccttggacagttagaaagcttctctttttggcttctctttaaccttcttatgggttctagctccgttaactgtgatcatggtgagcttgcctatttatttcacccacatgatgttccttcaggtatatacagctagagttctttgtctcctgtgagtgatgacggtggcaagatcatcattgctgtcatttacaagtactttcagtggctcaggccttgtgcttagaatggctgagtaactggctccatgtcaccagctgctaagtggcacagctaggtttgcaaaccaggtctggctgctctagaccagggattcatacattggcatttgctgcctgttctttatgtaaactttcatcagca

SEQ ID NO: 168398 - DNA, 428 bp, Homo sapiens
  misc_feature (22)..(22): n is a, c, g, or t
  misc_feature (64)..(65): n is a, c, g, or t
  misc_feature (78)..(78): n is a, c, g, or t
  misc_feature (135)..(135): n is a, c, g, or t
  misc_feature (138)..(138): n is a, c, g, or t
ttaccggcagctatccggtcanaggtattgaagtatggtatctactgcaaaaaataacttctgnnacaaggtaaagtngtagaaaaaaatatatatatatttttttgaaacacagtctcgctctgtcacccaggntgnagtgcagtggcataatctcggcttactgcaagctccatctccctgatctcaagcaatcctcctgtcctctcctcccaaagtgctgagattataggcgtgagcgtctgcacctggccagaatgctttctttatcaatttttgtgttagtcctgtaaaacctctccatcctctaaatgtatgtcatcatattaatagatgaattaatttacttacatttttggggccatatgctgtgtcatttttggaaagtgaggcattccagatgattgaaccggatagcttcctggagc

SEQ ID NO: 168399 - DNA, 166 bp, Homo sapiens
agattctagtcacacatggaattattattttgtacataataaaaataaaagactgtcaacagtactgggcttatcattgtggtttccctctcggtggaaggtgttacagtccaatagaagtaatcattgcctggacccagacaagagaagtcagtgacccagggat

SEQ ID NO: 168400 - DNA, 400 bp, Homo sapiens
taagtttagcccaagctaattgagtaatatgagactggatgtttgttacatctgaaggaaattctgctttaactccagtggcataggaaggcacagaaaagaaagcaagaaatgactagtacaaggctttgccaaccaaacaaggtagaggactttttcataaaagtcattgttcttatctttcctctaattttgcctgaatcagtggcaatgttgtcagggataaacacctgtccagggcccacacacaacacttggagcaaatgctgccactcacaaaatatggggtattacagtgctctcagtaggcccttggtggaaactagtgtctttcttctatcctgcgagggaaaggcagattttttttttatctctcccgtatatccccagaaaataaaaa

SEQ ID NO: 168401 - DNA, 645 bp, Homo sapiens
tttttcctctatgtaccttgcccatcttgataaataatacaactaaactcttaaatcaaaatcctgggagctatctttaactttttctgacatccaatcaataatcaactcctgttcatcctaactcataaatcctttccaaatccatgcttccttattaccattaccactgttcttattcgggcctaatcattttttttctggactttataaaaggcttgttttccccttgtctctagttgttccttctactcatctatttttcacagatattttcctaaagtatacacctgatcatgtcattcctcctctcaaatgttaactgaacctacgggatacaaaatatcaaaatttcttggcattgcacacacataactgtttatgataaggggcttagcttgttatgcattctccacccaaaatgaaaacaatgtactttaaaaatatcaaataacttacactttcccatagatgtcaagtgccttctcccatctccattttaaaaaatgtaatgctccctctaattgaatgcattctcctatcactattactcctaacaccatgaccaccaccaccacaatgtaagctattagaagcattaaaaaaaaaaagatagtagtaggcttaatcaaagacttgttaaga

SEQ ID NO: 168402 - DNA, 226 bp, Homo sapiens
taacacctgctggtgcccccatccccaagcaggaaccctggtgcctggtgcctgaggactgctgtccaccgtcccaccatccttcaggtttcttcccagcctctgactcggggcaaggttcagatatccagaacattcttggctggctcttggagctggggtgaggcagaacctccctcccatatttacagcaccagccaaggcttcggggtttggacaccatccc

SEQ ID NO: 168403 - DNA, 280 bp, Homo sapiens
tgctgggattacaggcgtgagccacagcacccggctgttaaaaagattttttagaggatggggtgggtgaagtggcttactattacattattacatacttggttcttaatgcatttcttatgacttcctctcaaatttggatttcctgagtgtgcattttgagaagaaacttaatatcattatatatatgaaaggtcattttaattttatgtagtaagtttatggctttttatacagttggtttcattctctgtcgtttttttttcaacaagtatttatt

SEQ ID NO: 168404 - DNA, 471 bp, Homo sapiens
ttgaaaaggctatccatatctgcaactgatgctaaatgcatagaacgtttctggaagaatccataacaaacttttaatgatggctgcctcttttggagagaggtctgggaatgaaagaaattttactatcttactgaaaggtctgaaacgtttatcctgagcttctattcctttgatgggttattttcccccaagtgagtagggagctggtggcaagcaaaacaagcagaaacaacacaaataaacagtaaacacttttgcaggaccaggaggccctgagttgttttgtgaattctctgaaaaaaagacagaaggagctttgaatgttactcattatatgcccaccccagctcctctcccactggcaactgaaaaatgaaagctgtgttaagtggccccttccacctctcaggaagcatatcaatgtctccaatttccttctgtttccccaagcccacaacatacctcctc

SEQ ID NO: 168405 - DNA, 547 bp, Homo sapiens
agtgcagtggtgcgatctccgctcactgcaacctccgtctcctgggttcaagcagttctacctcagcctcccgagtagctcggattacaggcgtccgccaccaggcccagctattttttgcatttttagtaaagacgggatttcactacgttggccacgatggtctggaactcctgacctcaggcgatctgcccaactcggcctcccaaaattctgggattacaggcgtgagccaccgcgcccagccgcacacattttctatttacagtcatacagaggagtttctccccccaagcccccattgggatcgcattttcttactattctgaaacttgctttttcagtttagagtacacatttggcggtcttgtattcctagaagatggacttcgatttaccggttgatggtcttctccactcttccgtggggtcagccccacttgtcccgtctccagtccaatgtcagtttgtgacttaatcttttacatcgtgtacagtctgagccctcagaccccctcacacatgcacaaattgagtttatgcacag

SEQ ID NO: 168406 - DNA, 384 bp, Homo sapiens
gttttattcattctctgaacataatacgacaaaactacaagcttttcatttaaaaaataagattactttaaattaatatttgggaatatttgctttaaagaaattgtatattaaaattcagtttcttttatacatctctaacaagtgccatttcctgcataataattacatttctagtcaattgaaaacaggagttttacctaaaataaccaagtaacaagaaaaacattcttttttttttctaggaaggatcatgtatcctttcttttcataatactgtatcattcagaaaataaaatcatcattttgactccctgttccatgcaaatgtcattttgtctttgatttgcaaagtatgtaagatttttccacactaggtaacga

SEQ ID NO: 168407 - DNA, 586 bp, Homo sapiens
tctggttgcaagtgtctagattttctatggcaaatgtctagctcatccagcccccatggtcccctaacggacattgggatgtctttctcctgtcagcacgtggagaaagcttctgaaactgagctccttttaataatagtttgtgctggaaagaatcagaaaaagcaactcatatatcctgatatattctgaagttggacagaacttatttacagattttacccttttttggattatctacaattgtgctccccatcttgaaaaaggacagcatttgctctgaatacaaaaacaaataatgaagatgaagtattatctcagaggtagatctgcttgtactctaaatgtctccattggagaaaggttgaggggcatggcaagcgactatgccatccccaacttcccagagcaatcatggggaaaaagaaagcagagtgaccccctggggcagaggctaaacaatggttactaactagattgttgcttcaagccaagaaccttacggctgggtgaaaattcaagactctgaagactctctgggttagcgttactgggaaaggtatgtgtattttggccaccaaatact

SEQ ID NO: 168408 - DNA, 180 bp, Homo sapiens
agaaagaaagaatcccgctaacacctcacaaagcacttttcaattggttcatagccaacacctcagttactgatgataagtaaatacagagaaacagagagagagagactgagacacaggggtgtttttaaaaggcagagcaagcctcagacagatgccatggcgtggactttctgacac

SEQ ID NO: 168409 - DNA, 382 bp, Homo sapiens
gggaagtagataaatagaacctacccaagccaaaacaagcagaaaaaatgctgaagaaaaatgaacagtatttcaatgaaatacactatattagtggcctaaaacaaactatcatcatatcactaaatacagaaaaggtatttgacaaaattttacatatatttctgataaaaacaaaaacaaaaaaacttgctggaaattagaaagaaactttctcaggtggacaaagtgcctttatgaaaaacttatagctacaccatgctaatgttaaagatttttttttcccctaaggttggaaacaaggcaaggatgtccactatcatccttctattaaacttctattcacgttattctaggagattctaatcagtgtaataagtca

SEQ ID NO: 168410 - DNA, 451 bp, Homo sapiens
tgccttggcttagcatggagtaggttgctcagacacacttctcccattgcctcagactcctgagcagagcacaggaagcaagggtctgcgaggctggctgggcttcctggtggtccttcttgggcctggccccagtctaggcttgctccttctccaaacccaacatgtatgcttatgctggtgtctctgtatctgggtcaagcacattgtcttccacagcaaatataaagaagaaaaaatagaaagatggaaaaagaagcagaaaaaatatctgcccacagggagagaccatactccagttgtccctgatcttcaaccctgggctcccttccattccaatatggttccttgaggaagaccctaggcacagcagtcacggtaacatgccttcagtgggcaccaaagactccttgcatttctatatttttacgtttataattgattaacatca

SEQ ID NO: 168411 - DNA, 184 bp, Homo sapiens
gctgtgccttgcaggtgcgtcccatttattacctggcagcattttccaggctgcaaggagggggatcccaaaatggcctggcagtcttaccattttgaactagaatttgcggggctgaataccagagaggatgatcctatattgacagttccagaggtctgcagaggggtccctttggctgaat

SEQ ID NO: 168412 - DNA, 191 bp, Homo sapiens
ttatgcccctttttagggctgtcttcaacagtatcgtttgaatacagggtatcccattgtagtgcagcagcagatgaaaggattcatgggctgtggactttttggaggattaacttctctgtgcagctctccacacatacaccaatgcagtgcttacaatgctaggttgtcacatgctccttggagtccat

SEQ ID NO: 168413 - DNA, 216 bp, Homo sapiens
cagacaccacaaatgacgtattcctgtctatcccacagacaccacgtgtaacgtggccacggaacctcagacagaccgcgttaagggcactgatacactctcaggacctctaatatatgaacactcttctctctattgagaatcactatattctgttgatgagagggattcctttgcactcctcctgatttctctctcctccccactaggaccatg

SEQ ID NO: 168414 - DNA, 346 bp, Homo sapiens
ctgctgctttaataaatctatttaaaacaataaaggatttttttgctgtccttggttgctgtatatttgtcttgttcatttatacatctcacacacggaatgtaacaggcacttatcaaatatttgttgaaaaaaagaattaaaaacactaacatagccagtggtgtgctaggtaatgtttcacagtgacttctctgggagaaggggcttacttgtaggatttgctggccaatttctgatttttgtggtataaaattcaccatgacagatatcaagctaccaaggcgacatcaattggctcacatttctgaaaatttatcgatcaactgtcataaactggtctaaa

SEQ ID NO: 168415 - DNA, 546 bp, Homo sapiens
aaaaaaaaaaaaaaaaaaaaggacctgggtttgagataaagaggctaaactgcttaattagccaaccctggagtctccacactctttcaaaccaccagggagggctctggtacatgcacttgaaggcacccgatgtgctggccacgcccctcactgtgattttatattcccactgccagctgatgctcttccctccacgcggaaagagcttctgtggaaatcccgtcatccttcaaacccacgtcaagcctctcctccaagaagctgcattcccatccctctcctgatggacctcatctacttctggacccaaacccggcaactggagctgctgtagagactgctctttctcagcctcgagttcaggaccacttgtcgtgtatgcggtccatcactgaacaaacttgttatacggcgcatgactaattacaaatgacctgcttcctttggctgtacagggctgctccagagccagttggcctgggtttgaaaactggccccaccacttgtgagctgtaccgctttgggcaaactactgaccttgcc

SEQ ID NO: 168416 - DNA, 521 bp, Homo sapiens
gtcaaaaaaaaaaaaaaaagtgatttgataaataatggcttcccatgaaaatgaagtagatcactaacatattttactgaagtcaacatgaattgatagttattgcatcctcataaatgggtgagagagaattccattcattttaattgagataaataacaacaggctttaaaacataaaattatggaaaatctaaaaactacaaaattatggaaaatctaaaaactacaaaaagcagacagaagagtataatgaaccctccagacacccatcagccagattcaacaatgctcaactcatggcctgtcagattttgtctttacccccaagtacttctcatcctttattacagtggagcaaatctcagacatatcatttcatccactaattttcctgtataaatctataaaaaaaaccatcactacatgaccattatatccgaaaattttaacaataatgccttaatatagtgtaaggagtaaggagtaagtgtttaagatccagacttacaatattgccaa

SEQ ID NO: 168417 - DNA, 236 bp, Homo sapiens
catcctgcagtctgtttcctggtcagcctgtccagctgccattgcgtgattggttacaatgacaggagaggataaacaggaccattcagacatactcagaactatcagaggtatcaataagaatggcttataaaaaaccaatcagtttgtttacataaatggttacttgtaggttaaggacatttgtaaatcacttattctctagataatttcaaaattttcccttggacacttgc

SEQ ID NO: 168418 - DNA, 396 bp, Homo sapiens
actccgaggatccccgacgagttgtccgagttacttgggaggctgaggtgggaggatggcttgagctggggaggcagacgttgcagtgagccaagatcatgccagtgtactccagcctgggccacagagtgagaccctgtctcaaaaagaaaaaaaaacagatctaggtaataaaaataactcaatagaaatactgaaagaacatgatggacaatattttcataatctaggaatgggaagatcttaggaagacaggaaactcagaaaccataaaggaagactgacatttatctacatataacaaaaaaatagatcagaactaaaatatggaccatactataaacaatggcaaatgattaactcggacaactcgtcgggaatcctgagagttaccac

SEQ ID NO: 168419 - DNA, 326 bp, Homo sapiens
ccacagctgtgccacattttttgtttgttttacctccagtggcatctcttttaatttgtttatgtcttgattgctcatcctggtttaccatgttctcatatgcttatataagccattttttaaattacctgttgatattatttgctcatttttctattacattatctttttcttgattacagtagtttgctaatgtacttgtttttggttttcaaaaaaaagcatgtgcatattgcttaagaagttagctaatgttaaactgcttgtaacaaaaagtaccacctccacctcccttcaaatattttagctctttcttctggtatttt

SEQ ID NO: 168420 - DNA, 493 bp, Homo sapiens
ttctgcttgtgcttcatctgcaggactgacccctttaggcagaaggagtgggtctgcattgggggttggaatcctcatgggcctcagaagtcttggcgccttctgccttgtggatggcctccctcctagccagctccccagaggggtctgggcagctctgctccacccgaaggctctggatgctcctatttctggtattcttggcacctttgattcccaagaccattagggaccttggcgcccatctcatctgatgcctgtcatacggatgacttatgccccatctacgctatccccatagagcaccttcccatgtgggcttgcatgcctccacggacaggctgctccctgcctccccagcagctccctctgtctagaaagttccacatcgtatggagcccagaaggatacctctcccctagttctcttctcaggaccttgcagaatgtggtgaattggtcctcaggaagtctcttccattctctgcctcaga

SEQ ID NO: 168421 - DNA, 309 bp, Homo sapiens
aaaggtttttctgttccctttcacataaaacttttagaaatagaaatagaagttagaaagcaagaaaaaaatgttggaaaacacataataatttgtttaaaaaatatggaactgtctctgataggatttactgacttgagccttttgcccaatttttttaaacaatcatatttaacttagagcaataaaaaatattttcaaagggaagaaaatgtttttaaaggttatttctatctatctatacagcacaaatcttacaaagaactttccttccctattcttctctatcagcccctgtcactggcatat

SEQ ID NO: 168422 - DNA, 317 bp, Homo sapiens
caataaaagcatctaggtaaactgtagtacattcatataacgaatagatatcacattattaaaattatatttatttaaaattgccatcttaattcagtgtcaagtcagtgctataaatgtaaatgtacactgagaacaagaaagaggcagaggcagaatgagacgaagttaacaaaacaaagggaggagagtcacaaaatagtaataaaagtgatttctggttaaataaaagtataattttttttccttaataatatctacatttttcaaatatgcaataagtatgtattaaataaagtaaataagaataagcttta

SEQ ID NO: 168423 - DNA, 413 bp, Homo sapiens
aagtatttgtagtctttggaactactttctttttctggttaaggaaatcaaaatataagtctcatctttagaacctggacattatttcatgcatgtggaaaatacccatcccaaacagtgctggatgagtcatctgaccccagagaagccggagataatgcctcttccagacttcctgtctctcttttgcaagactttccataattctgcccctgcatctctcccacatcatctcctctaattaccagacgccaagttttctaatagcctgccttggaaagaagagtttccacccactcatgcctccagattcgcctttcaagcactccctaatcacaagtcccgccccacctacacacacactctctctcccggaactgtgacaggaactgtagagaaattcaggaactcaa

SEQ ID NO: 168424 - DNA, 299 bp, Homo sapiens
aaaagtagacatgtctgggtaaagagggaaaaggacagaaggattactctgaagaaacagactctagtcagaatgttactacaactaatgctggaaccttggggcgctctgctctaaagagaaggttctttccaattctaatggtctagaattattcctgcatttaacaggtcaaatgaattactagcagaccagcaatgcacctgagatatgacatgctttggtgcctggggtaggtatgtggatttctggatgtaagagataggaggtggcctttctgctttagtacatatttaaga

SEQ ID NO: 168425 - DNA, 360 bp, Homo sapiens
gaaaactagtacttccgccacactcaagatggctacatcagaaatagacttttccatccacctgggtggccccgcccccttatgaagctgcttccgccactctctgcgggttgggacgaattttacacttcttcgcagcattcaagatggtccggcttcctcctactttttattggctgcatcgcttcgtcttcaggggaaggcgggacttatatttgatcgacagctacattgatcaatggacaaagggcaaaggccaatgaagcgctggaactggagagtctctcgcgtgtctgggagggtgttttgcgcggggcggggtggagcagagccggaagcgggaggggagcgtcaaacagg

SEQ ID NO: 168426 - DNA, 488 bp, Homo sapiens
gaataatatgaacccctgtgcccatctcccagattgagcaatgattaacatttttcaacacctgctttgcttatctccctcctcctttttttgtggctctaagattttaaagtaaatctctgatttcttgtcatttcaaacctaaattcttctgtgtgtacctctaagaaaaataaggacattctggctgggtgccatggctcacacctgtaatctgagcactttgggagttggaaggattacttgagcccaggagttccagaccagcctgggcaacatagggagaccctgtctctacaaaagaaaaaaaaaaaaaaattagccaggcatgtggtggcacatacttgtagtcccagctacttgggaagctgaagcaggaggatcctttgagctcaggaggttgaggttgcagtgagctgagatgacactagtgcacccagccttggtgacagagtgcgaccctgtcttgtctcaaccaaaaaaaaaaa

SEQ ID NO: 168427 - DNA, 372 bp, Homo sapiens
cacaccccagcatcttgcagagggattcccctcttgatcacagcgtgcccaggccattggcactgtggtgaccatgtcacggaacgtgtgagactgggaagctatgcgcctgaacttgtgacaaggtgtgttggtgtgtggatgcggctatttgtatgtggaagcccagtgccgagtgtgggtgtcgggggcacgacttgtgaggctgggcggggctctggtccggagtccggtggcggtagagccctcattttcgcacgattcccccgcagctttccagcgccccctgcccccgaagctggctggaaagaaggtgggagacacctgttggggagctgagagcggcagatcccacaggggcctctccccatg

SEQ ID NO: 168428 - DNA, 169 bp, Homo sapiens
atatgtgttatgaatatatatcgtggatgaaaaaaatttaaaaaggaaattatttttaaactaagattagcaatttcttttggagctaaggtggaggaagaaagtaatggaattgagaggcatgtacagaagacaattttattgataaagtattgtggagagttaaata

SEQ ID NO: 168429 - DNA, 367 bp, Homo sapiens
agattggatcttaccaaaggaattcttaatggaattaattattaggtgtttgttttacgcatggctttatgttgcatggggcatgaaagccagtgcccatcctggcattataagagcaggagacctggcattttaagtggcccgcagtgaatgagctggactaggacagggagctgtgggaatgagactcactcctcttggcttttgctgacttatattctaaaagacttcgatggcctgaaagttggcaatcaggttttccaagatgaacctgctttttatgcagtgattttttttttttttttaaacagtgcagagttcaaatagctcaacagtattagcagtgaatatccttccttccgggtag

SEQ ID NO: 168430 - DNA, 229 bp, Homo sapiens
agtttcctcagaaaattaaggaaaaaatagaattaccatatgatcgctgttctgtttctgggtgtgtacctcaaagaattgaaagcagggaatcaaggagatatttgtacaccagtgttcatagcagcactcttcgaaatagccaaaaggcagaagcaacctaagtgtctgtccattgatagttgaatggataaaaggaaggaaattctgacataggctctaatgtgga

SEQ ID NO: 168431 - DNA, 158 bp, Homo sapiens
ggaaatgactaacaggaatatagcttttcacttttttacattggtaaagatcttctctgactttggaaagcctgccacttactgagggccacctctactcatggctcccaggatgtagtctatcttattgacgtctttgacagttcataactcagttc

SEQ ID NO: 168432 - DNA, 359 bp, Homo sapiens
aaaaaagtaaaaacaaaactggaggttctcagtctagggtggcgttagggactttcatttccttccagaggacattctgctatccgcagggtagaagcctaatcctcaaggttcaaggtgacaagaatagctccaaccatcatacgcttattccaggaagcaggtcaaaggatggaacaactaagaaatgacattaaagatatgtgtcagtccatctgcgttgctataaaggaatacctgaggctggttatttatagaagagaggtttaattggctcacagttctgcaggctgtacaagcatggcaccagcatctgctcctggggaggcctcaggaagcttccaatcatggcagaaggt

SEQ ID NO: 168433 - DNA, 162 bp, Homo sapiens
caaacagttctggcacgtgttgccacattaaacatacaccagcaagacttgcaccatatgtgcaaaatcattttctattacatttctaaaaatctgtatatatgagctgtcaaaaattaacgcagatctgtactgtgaaatgacacagcactgaatgaggaa

SEQ ID NO: 168434 - DNA, 519 bp, Homo sapiens
ggaaaaggtacatggggtgaaacctggaggaaagcaggtgcaaaattctatgaggcttctccccattgaggcacataggatgcacttaatttcttcagcaatgaattgtgacaacacatgtgaaatgttgtctaccaaggaagctcattagagactgagtgcccaaagtttttcttgagggatggcacgtaggcatctgcctagaatgtaccaaaattccagactcccagaaagaaaataagtatacaacataaaccatattgtttgtataaacagtgtaggcagagtaagctgcccttatcatttgaggaaagtttcttatcaatgtagggaactgtttaccagctaaattcccaaatgccagccaagggccacccttgtaaggcggcctttctaccctctggtaactcttgtctgcacagctgatttttgcaggattaagttgaactatatgaatgccatttttataggtcagaattggtctggtatcagtaattctgtattgttaaacttaatagt

SEQ ID NO: 168435 - DNA, 732 bp, Homo sapiens
ggagaagcagtcaaaagccagattattcagggtcatgaagaataataaaaatttgaagtgttgtaacaatcagatctgggtctcttagagatcacctggctggagtagggggaaatggctggagggggattagagagaatacttaggaaaccagtgagagatgccaataaagtccagtgcaatgaaaagaagatgaattaaggcagacaggaagtaaaatctaaaggacttagttactaactaaaagctatgatcttagaagaggggattttttgctgggtggatgacagtataataaagataaggaaacaaagaattgagaagtcagggtttgagggagaggggaaaaatcagtttgagacatgttggatacaaggtatctgtgaaaatccaaagaaccaagtaggtaaatgaaaaattcaggtctcgggttcaggagtgatctgaagatacagtcagaaagataggaaagaccgggcgccatggctcacgcctgtaataccaacactttgagaggtcaaggtgggcggatcatctaaggtcaagagttcgagactagcctggccaacatggtgaaaccccgcctctactaaaaatacaaaaattagctgggggcatggtggtgcgtgcctgtaatcccagctactctggaggctgaggcaggagaactgcttgaatccaagacacggagggagcagtaagccgagacagaagcacagtactccagcttgg

SEQ ID NO: 168436 - DNA, 439 bp, Homo sapiens
ggtgtctagaggatcccgaaaactgaatagaggcaggtttgagggagaggggaaaaatcagtttgagacatgttggatacaaggtatctgtgaaaatccaaagaaccaagtaggtaaatgaaaaattcaggtctcgggttcaggagtgatctgaagatacagtcagaaagataggaaagaccgggcgccatggctcacgcctgtaataccaacactttgagaggtcaaggtgggcggatcatctaaggtcaagagttcgagactagcctggccaacatggtgaaaccccgcctctactaaaaatacaaaaattagctgggggcatggtggtgcgtgcctgtaatcccagctactctggaggctgaggcaggagaactgcttgaatccaagacacggagggagcagtaagccgagacagaagcacagtactccagcttgg

SEQ ID NO: 168437 - DNA, 492 bp, Homo sapiens
gtgggttgaccgtggcttgtgggttgaccgtggctttgctgggatatgggtgtaaagttgataaggaaacaaagaattgagaagtcagggtttgagggagaggggaaaaatcagtttgagacatgttggatacaaggtatctgtgaaaatccaaagaaccaagtaggtaaatgaaaaattcaggtctcgggttcaggagtgatctgaagatacagtcagaaagataggaaagaccgggcgccatggctcacgcctgtaataccaacactttgagaggtcaaggtgggcggatcatctaaggtcaagagttcgagactagcctggccaacatggtgaaaccccgcctctactaaaaatacaaaaattagctgggggcatggtggtgcgtgcctgtaatcccagctactctggaggctgaggcaggagaactgcttgaatccaagacacggagggagcagtaagccgagacagaagcacagtactccagcttgg

SEQ ID NO: 168438 - DNA, 514 bp, Homo sapiens
agagtaggtcatgtgaaaatattttccatacatactgaaaatagaggaatatttcagggaaaagaaggaagtgaaagctgttaaactgaattcaatatcctcatcagcgagttagtcattcattttcgacacttgcctttcaacagccttgtccctccattgttcacagggcagcctgcttatggttggctgccagcaacatatacgaattctctagctgcacactttatatgatagatgccaattgctaccaatgagatttggggctagactgcatatgaaatgaattgcatctatggaaagtagctgctattcagacctcaataattcaatcactgtgatttctacgaagaccagtatgcagcataatttatgaactgaagattgagctgggaaaattctttatgtatttaaatgcagctcattttgactttatagcaaagcggcaacgggatatcaaagaaatccaagggacttggccaaaattgaatccaaaacataaacacattgaaaa

SEQ ID NO: 168439 - DNA, 312 bp, Homo sapiens
tgcccacccggtgacttggcgagcattccagtgccaggaacgacggacagccacattacatgacgtgtgaaaaacatcctctaccaaaagatgtcagccgaccacctcacatgaggctggcaggatttggggcagctccttgcttcccagccctggagaacccactccatgcctcatgagtgtgaacatgggggaacgatggcacgtggccacaccccaagccccgtctctgtttggcacccacattctttctgcctaatgctgcagcggcagacacctgccctccccacatttttctgacaagtagctgag

SEQ ID NO: 168440 - DNA, 533 bp, Homo sapiens
ggcaggggaaacctggaggccatgtcactggctggttttatctgtttcccatagagttgggagcttcccttactttctgtattccaagcgaggagtcaatgccacatctaagcaactgggcctccatcacgccaagccctccaagaccaggctcttttcctaggactaggccactctcctgggatgcaaaatgaacacaaaaaatgacctggacagcccagcctagctcaaaggagctgctgcagtcgtagcgggcatgcctgctcaaaacctcccaggggactgcccagaaaggtcaggggcacagaagcctgtgctcagagatcaggaaggggcctcaagatgaactggtccacctacccacattctagagcaaactaagtcatgaggaatgaaaaagataaaatatattactttgacataatttgagatggctgtcacagggccagcagactgaggtggccctgcaaagctgtcctttgtgggggaaatttgcatctgtagagaatctcctttaatgcagccaaggcttc

SEQ ID NO: 168441 - DNA, 440 bp, Homo sapiens
agaaggtgtggaaggaggaagagcaagagtgagggatgagaaatgcctggtttacaaaaaccaatccacttctacaggccttaatcaaaagaaagacaaacgctcatgtaaaaatccacacctagaggctctcaggcacagagcgatcacaggagaggcagagtgtgcaaacaagctttcattaagagacctgtcagctctgtttcatttctccaggctgctctgcattctgctggcaatccagccggaaaaataatggaaggacaaacacgtctgaacaggcaaacaaaggtgggaacattccacctacagaacaggacagatcagaaagatgccagggaggggggatgagatggcttttttctgagcaaacaaccatagcccctccccttaactccaaactcatcggaaacatgattttctggctttttatgcagcaa

SEQ ID NO: 168442 - DNA, 206 bp, Homo sapiens
atgatttgaaatttgaaattttccccttagtaatctttgacctcatcaccctcttatctcttaacatatagaatcagatcctagattttgacaccattcattatttcaccatccccaacatttccattttaaataggctactctgcatattgttccagtttatttactttttctagtgagaccatctctgggttttatttatttgt

SEQ ID NO: 168443 - DNA, 310 bp, Homo sapiens
acttgcctcccctgcacacacacacacacggtggctgctccatttgccagcagacgtgtgtagaacctactgcatgctgggtagatcctggggatgcagaggtgactctaccctgccctctgggagaccccaccgaaggtgaaggcatgtggagaggagagggtatggatccatcacataggtacagaatggagggaatgccctgtgccctggaaacagaagcaggggagcccaggcccggcagctggtccgggagggctctgcagaatgccccgagggcaagtgcgaggacttcccatgtcgggggtgg

SEQ ID NO: 168444 - DNA, 417 bp, Homo sapiens
gggacaagcaagcagaagtagtagaggaaaaactcctgggaacagttctgggctagatttgtcctgggctagatttgtccttcatgacagaaagaagtttatctttatgacagtcacttccatttgagcactatgaaatcgttgacaactatgtagtaaaatttcagttcatcctagaaaagcatatgtcaaatcatgtatcataaattcagatgtccctgatcatataagttactactacttggaaaattgatggtaattttgagaaattgtgactgttttaggtccacgttaggacctcaattctagttgagactgaattccctgtaattctgattaagtcctgtactgtatcctctgccacttgatccacatgggagtgccttttacaactctgtgtgagtcttttaagttaat

SEQ ID NO: 168445 - DNA, 232 bp, Homo sapiens
agcccccacccaggacccgtaaggccccaccccctgctttgagtcgttctgccttcctgaacctgagcaatgtacacctcacatgtactaactgatgccgatgtctccctaaaaggtataaaaccaagctgtcacccaaccaccgggacacatgtgctcaagacataataagactgtacctcaggccatggccaccggtattaggctcagaataaaccctttaaatattgta

SEQ ID NO: 168446 - DNA, 159 bp, Homo sapiens
cccttggtgccacttggccttctaagggctgacgctacaatgcatttccttaggcctgtgtggtaaccaagtgcatgacaggtgcaaagctgtgctatggaataagctcagagaccattaagaatatcctaagaatctctaatttcacatgttatttaa

SEQ ID NO: 168447 - DNA, 139 bp, Homo sapiens
aataaaataaaataaattcaattatttagtaaatatatatacaactgattttattaagcaagtaatatcatattttctaaaaataataaaaaaactgaggaaaggaaaccaatgtatttccttaaggtaagggaagaat

SEQ ID NO: 168448 - DNA, 341 bp, Homo sapiens
atgtgttcagaagagagaaggttatggaggctgtggaggggtgtgtggagagaagagtctggagtatcagggaaccagtctgaagagggtggggccagattgtgggactttggatgttgctctacaggcaacggggaacaactagagatttgcagtcaggggtgacatgatcattctatcagcagtgaagggagtgcaacagcatggtaggacaacagcgggaagactggctaggacacaactgtcaacatgggtgaagtgaggaccaaattgagggacagcagctggggatggagaagaggaacaagagggacttcagagaccttcctcacatcaatccc

SEQ ID NO: 168449 - DNA, 385 bp, Homo sapiens
actttggacttttctttggactctgtgtttccgaggtatgaattgataagaaatgcctaccctttcttccttcttggtacctttccctcacctacagaaaattaaaggagtaacacaatggacatctacaccctcttcctccagttaaccaattgctaaagtttgccacctttgcattttctttctctctccataaatactttcttctctgaatcatttgaaagtaagtcacagagagtatgacatttcactcgaatacttcagcatttatcttttgtagataaggacattttcctgcataaccacaattctgttacctaactttgatataataatttaaattactgtacagtccatgttcacatttacccaataatccccagaa

SEQ ID NO: 168450 - DNA, 705 bp, Homo sapiens
caccttttaggaaaatataaaacatttttattaataaagtgtatcctatgatagagttaaactcagagcccaaatgtagcaagtagttacatttgagaatcactgagaacagctattccttctcctccgacttaggctggctcatgcttgacttagaatttttcttacttctgctttgctacattagtctttgctggagagcccctcagaggagcccacagtggtctacgtagaggcgccatgaacaaggttatttactctctgcactttcgggtgtggaaagaagagtccagagtggggagccaagtccaggtctgggtgtttagtgtcttccctgacggtgacatgctgagccttgatcctgcttgggcgtggcctccttctgaagcaggttcctgcggaagctcaaacaggctgctcatcctgcttgctgctggctcacactggctactgatcccaaagctgctcaaaggccctggccatcttttctcttactcgtgtgccatgacactgtgcacatcgaccaacagaagataaaccccatcagtccagggcagctcagaagactagcaccggaatagttcgggggcactcgttaatacactgactagaattccatatcacccaaatcctaagtagcacttcatgtcaccaagtgacatcatttttcttcatagatttcagtttttaaaagttgattattaa

SEQ ID NO: 168451 - DNA, 241 bp, Homo sapiens
agcccaggaggcagaggttgcagtgagcactattgcactccagcctgggtgacaagagcgagactccatctcaaaacaaataaataaaataaaataattcacaatgtcatgttttagctgacgttgtgaattttagtaatctttttttaacctttaactccatcctgagttacattgaccaaagaatcagtatctagaattatatcaggaactactaacagggttaataaaatgaataaag

SEQ ID NO: 168452 - DNA, 429 bp, Homo sapiens
tgacatagaggatccctgttatctcattctgcaacatctattttcatgttccctgctgcctggccactaagccaatggtacatattttaggtttcaagttatggcggcactctattttgaggtattcattagtgcacactatctcctgtaacaaatagaccccaaaatgcagaatgattaaaacaccacagagatgtgtttctcacataacaagccagagtgagagctcattagtggcacgtggcttttctcctgaaaagctgaatgcagtgattcggaaacccgtgttctttacagttagtagattcacccttcccaaggcctagtaaccaatggtattcagcggtggaacgggaaagagagagcctggagagagcccatatccatactccttgcagaatgagattacacagggtcctctagatgtgt

SEQ ID NO: 168453 - DNA, 525 bp, Homo sapiens
ggtgaacacgctgccagcacccacagctgccagagcccaggagttcaagaccagcctgggcaacatagcgagatgccccatctcacacagcacactgtcaggcttacacttgtgtgcccactcacactcattcacacccagccatctcatatcctcacactcaggttctttcatactcgtatacacacactcacacactcacactctgcccacacacgatcacactcacatgctcaagcattctcactcgagcacacttgcgtgctcaaacgctcccacacctcccaaagcactgggattccaggtgtgatccactgcacccagccagtattttcatacttacacccaaacatgatcccatgcatactcagatgtttccaggctcacatattctaacacaatcacatccacacaccagaacaccaccgcatgaatccactagtgtgttctcacactcacatttgaatacgtcgtgctcacatgctagggcgttttcacagtcacactcaaacatgaccacactca

SEQ ID NO: 168454 - DNA, 235 bp, Homo sapiens
ctctcagaagaaactgataaggggatagagaaagcagaacagggaatgtgcttcctagccaagcagaattgcaattgcatgtatcaaaagggtagcctcaacctgatcccaaaggtaaattctggagagtaaattgtggctcagagtttgctcctaactaaagtaagagagctgagcttccaaactcccatacccattacacatcagctagagtcttagggttgaggatgctcag

SEQ ID NO: 168455 - DNA, 499 bp, Homo sapiens
agagcactaatgaattagattggtgcctttataaaagagattccagagagcttgctcatctcttctgccttgtgaggacacagcaagaagtcaccatctgtgaaccaagaagtgggacctcatcagatgccaaatctgccaacacttcaatcttggacttcccattctccagaactgtgagcaatacatatctgttgtttataagccatctagtctatggtattttgttctagcagcccaaacggactaagacaatctccccattaatttaggtcttatttctttcaacagtgttttgtggttttctgtattgcaccatttcattgatggtattataaatgctagttttaaattttcaattttttagtgctagtatataaaattatttatatttatatataatttatatttgaccttgaatcctgcaaactttttatagttatctattcctgtaactttttggaatattctacataaacaaatcttatgctctgtatta

SEQ ID NO: 168456 - DNA, 210 bp, Homo sapiens
aagctgttaaaaaataattcacctcattattaaacaaacagatgcacagtaagaccaaatgccacttttcactcaccagacaggcaaaagttaacttgtctgactgtttttgacatgtgttctctgaagtggtatgtcttgttaaactaaactcttggtaagttatactgattacacttgtatgaaaagtatatgaagcagtttccaaat

SEQ ID NO: 168457 - DNA, 214 bp, Homo sapiens
cacaaagccaagatcaatagagctttggcaaacagtaataatctcctgcacattctatcaataggtactcagaaaacatagcttgatcttcatggacctgatgattgggcccttagcctgccttttgcctttctctgattgaatgtcaaaatgtcaagaaaatgcttcaatgggagtgaatttctctacagtctcctgaggaaccaaatcggcc

SEQ ID NO: 168458 - DNA, 558 bp, Homo sapiens
atagacaacatttcaaatggaaatatgcattttttcttttttcctttagtatttttgaaatgagaatatatgtggcatatctttatgttgtagagctcagtgatacaacaaatacctatgagcccagcccccagcccccagccccagaaccagagcatcaccagtcatttctaactgtcagtgtgttccttccacgttccatcctgcctcgcccttggggtcgtcactgtcctgaagttggggctcatcatcctttggcatttaaaaggagttttatcacaaatgtatgcatatcttaacaataaactggttaatcttgcttgtttttgagctttatatgaaatggcatatagaatggagttgtctgggcttgctttttcacttaacattataaatttctgacaagaaaatttgtggatctcattttaaggaagagaatggccccatatacaaatcatttttaacctctactatagatatgtgatacacaagaaatgtaagaaatacatgtagaagcttaatacgaaatatatcactttttttattagagtcagagat

SEQ ID NO: 168459 - DNA, 507 bp, Homo sapiens
gtccccgtccagtttctgaggacaagagccaccacctgtagcaaataaagacccagcaaccctttgactcatctttgtgagtctctggaatcagagggtagccacatcgctgagaggtggagtgaagcactcgggtgaaaaggtacaaggaagtcagggacaggagtgtggggacatcacctagacaatgacagagaagaggggcacagccgagtgaggggagaggggccggcagtcctacatcccctggcctgaagcacgctccagggcagaaggaaaaacactgtctttggggtccaagagacctgagttcaaattctggctccaccactgaccacctgtgtaaccttgaactgctgctgcctgaacctcaggttccccttctaaaaatagaggagaaaaggatgcatttctccttgcccctgtgagaacgaaatggtgcaagcaccaaggagcctcagcaaaggtcgggcctgcccccgcctggccaaacctttcctcttcagg

SEQ ID NO: 168460 - DNA, 332 bp, Homo sapiens
tctatcacggctttagaagccatccttgatagatggttttacaactcaatacaagttttagtattatccatagtggtagaagaaatacaatatatgctatcaggtgatgatgttttttccaagctggattgtaaaaaccatagggcaagggctgtcttattcatccttgtattcctgtttcagacacagaaccaggcttggaacagagtaagtaattgtgcccaaatggtgattagaggtgggtgaagtcagggtgtgctgtcgggaggaggaggagaccctggagcagggcttccagagaggaggagaagttggataatctgtgggagagg

SEQ ID NO: 168461 - DNA, 2745 bp, Homo sapiens
tgggcggactccccatggccagaggctgagctccactcccgccggccgctccctaggggaaggggaaggagaggggagagcagcgacaggcctccagcaagcaagcgcgggcggcatccgcagtctccagaagtttgagacttggccgtaagcggactcgtgcgccccaactctttgccgcgccagcgcctggagcggagagcagaggcggcccggccgcggcgcgccggctttgtcatgatggccagctaccccgagcccgaggacgcggcgggggccctgctggccccagagaccggtcgcacagtcaaggagccagaagggccgccgccgagcccaggcaagggcggtgggggtggcggcgggacagccccggagaagccggacccggcgcagaagcccccgtactcgtacgtggcgctcatcgccatggcgatccgcgagagcgcggagaagaggctcacgctgtccggcatctaccagtacatcatcgcgaagttcccgttctacgagaagaataagaagggctggcaaaatagcatccgccacaacctcagcctcaacgagtgcttcatcaaggtgccgcgcgagggcggcggcgagcgcaagggcaactactggacgctggacccggcctgcgaagacatgttcgagaagggcaactaccggcgccgccgccgcatgaagaggcccttccggccgccgcccgcgcacttccagcccggcaaggggctcttcggggccggaggcgccgcaggcgggtgcggcgtggcgggcgccggggccgacggctacggctacctggcgccccccaagtacctgcagtctggcttcctcaacaactcgtggccgctaccgcagcctccctcacccatgccctatgcctcctgccagatggcggcagccgcagcggctgcagcagctgcggctgcagccgcgggccccggtagccctggcgcggccgctgtggtcaaggggctggcgggcccggccgcctcgtacgggccgtacacacgcgtgcagagcatggcgctgccccccggcgtagtgaactcgtacaatggcctgggaggcccgccggccgcacccccgcctccgccgcacccccacccgcatccgcacgcacaccatctgcacgcggccgccgcaccgccgcctgccccaccgcaccacggggccgccgcgccgccgccgggccagctcagccctgccagcccagccaccgccgcgcccccggcgcccgcgcccaccagtgcgccgggcctgcagttcgcttgtgcccggcagcccgagctcgccatgatgcattgctcttactgggaccacgacagcaagaccggcgcgctgcattcgcgcctcgatctctgagagcccaccgcatgccggtgcagacggatgcgaggatgcagggacgcgcgacgccggccccggtcgcagccgacgacgccgccgccagcctgacctcacaccctctgggcccgcctctggagccagcgcccagggtccctctgtgctttttcgctttcctaagctcctgtcgctcctctttgtcccctcagtttatgtcctcctgtgctcacctccctgacctctgtgaccttgcactcccctggcctgaagctgcctctctgcgcgctttctactgggctcgtctctttccggagccccagcgtctcctgcccaaattcaccgcggaaagggcccggggcggaggtgcgaccgggcgtcggcagcgcagacctcttggccttctctcacaggtcggtgcgctcgctctccgcgttccccgcccgactgccgtgcagtccatggctagacgcgccggacaggactgatggcgggaccgcgctgcccgagaaagggacggaccaatacgtgtgtttgctccgcgaaccctcttgaagctgttcagaagccgcttgccgcggggcccactaggcggggcgggggttgggacccagcgggagccggggcagcctggctccacggcctgtactcggtttacaccgcgggcggcgcgagggaggctgcgtttcctccgctatcagtcccgtcgcttcgggcacctccggccccggcggctggctaatgttttgtttgaaagatcggtggaactttttaagagagtatttaaaaaaaaaaaaaaaaaacaaaaaaaattcaccgggcaaccggggaagtattgtggccttggagtttgctaaatccaaatatgaaaatcaaaagctttagtattcctcatcttctcttctggaagatttgcgttagagtttttgttgggccttcaaaaagctgtgttcagagttaggagaatatatccaataaaagatggtttcgtctaccaattggggaagtttcaccctctccctatctgaagaaaaaaatcaaaaacaaatgtccccggatctttcgatgcaagtcctggaggcagggagatcactgcctgcctggcccacgctgctgggacggctcgtcctccctgctttttgtttttcaaacctcctgcttctcccaccttgggaaggagaaatgtgaaacccggcagcggccgacctaggcggtcttgtggcccggagccggcccggcccgaaaaccatagacctggttgtactgtagcttgttgtttgggggaccaaattttctagagagaactagagcacttttgttgtgtttttttgttttgtttttgttttttgccttgtcgttcccgaataaattttgtgttccttcttttaaaaaaaaaaa

SEQ ID NO: 168462 - DNA, 560 bp, Homo sapiens
ctagcaccttaacaatatcccaattctttctgttgcgaaatagttttgttgacagattcactggtaatcttttaagaccacagttataaatgacacatcacttttattttgcagctcctaagatgtcgtttttgagtttgatttttgaaactttgcttatatatgtgctttgctgtaaatctgtgtgtgtaaccttgttgaagtttgttgagcttcttccgtttttatatccttttttaacttgaaaatttctgtctttattttgcatttttcaccttcatgatttgttttttgtttttaatgttttcattgatgttctcatttttctgattacatttagttgtacgtgtttccatttagctgattcagcattattcaggttacattttaaaaatttgtacatctttgtttttatggttgttttctgaaaaattttaaattgtttaattagaccatgttctaatattttgtatacattataatatttgcttgttatttgaacattaaccaaaagctatttatcacaacctttacaatgttgttttctcctgacatagtct

SEQ ID NO: 168463 - DNA, 341 bp, Homo sapiens
atattaaaccagaattcctggactgtagccatctcaagcaatattgaatgcatcaaaaatttgatatgttggaatgggcactgacattggatcgtaattcttgttctaccagtaactgggtgtctaggagcaaggcatgccttcactggcatcctccttatgtaaaacaaaacactagatctctttgtctcatttggttttgtttcagtggtgagtggctttggggtgttgaaggcatgctcctgctctcccactttggtggctctatcatgcttttgggtcagggaagcatttggatgcttttgcagaatgtggagggaagcgaatgagaagtattctgg

SEQ ID NO: 168464 - DNA, 402 bp, Homo sapiens
cagatatgtacagactgtaggagggaagaacgatacaggatgcagggaatacgtgcaaaagtgcagaggttggaaattgtaagcacctacattacaacaatggcttactttgaatgcctaacgatttggatatcttttcacattattttacccttaatttgtgaccactgcacccagccaggaatgagctttcaagatgtctttattgtagtagatatttttgaggagcagtaccttaaagtggttaagaacctttgctttggtgtcaaactcttttgctattcatttgctttgtttccttgagcaagttaactttgttacctcacctgcaaaatatgaatgatgataatcatacctccctcatgcgattatgttaggatttttaagagataggacatacac

SEQ ID NO: 168465 - DNA, 418 bp, Homo sapiens
tttcttttcttttctttttttttttttttgagacggagttttgctcttgttgcccaggctggagtgcaatggcacggtctcggctcaccgcaacctctgcttcccaggttcaagcgtttcgcctgcctcagccttcctgagtagctgggattgcagacatgtgccgccatgcctggctaattttgtgtttttagtagagacgggttttctccatgttggtcaggctggtctcgaactcccaacctcaggcgatccgcccgcctcggcctctcaaagtgctgggatttacaggcatgagccaccatgcccggcctatttgtccttctttttaaaaaacttctattataaagaaatttaagtatgcaaaagtagagaaaatagtttaatgaattctgatatacccatcaaccagttgaaa

SEQ ID NO: 168466 - DNA, 197 bp, Homo sapiens
ggtctaaatggagcacctgctgctcagggcagcctgtcagacagggagccattggcctttccaaagggccaagaaatgggaaacccaatctaggccttcaaaggtaggggaaaaagtcacatctgggcaaaccaatcacaaaagcccctctgtgcaatgggcagaatgtccttcagaaagctgtcctcctgggtcac

SEQ ID NO: 168467 - DNA, 221 bp, Homo sapiens
tggggatgaagagaaaggagtgcattcagaagaagcttgtgagtgctgatcaggcggggaagaggaaactgaagaagggaaaggacttaacgctgagaccacaggatgaggcagcaggagcacaccgtgcttcattcatatgatcttttttttttttttttttttgagacagagtctcgctccgtcgcccaggctggagtgcagtggtgggatctcggctc

SEQ ID NO: 168468 - DNA, 382 bp, Homo sapiens
acctctctgtgcttcagtttcccgtcttgaaatgggatatgtgacctaatctcatcaggttaccaggataactcagtgaattaatagagataagtcccataacatgtgtaagactctgtgtgtttggtaggtgctgggcatcagtgctgtcagtgaacagagcagaatctgctgccttcatcctcccgggatggctttcttctctgctgaggctttttcaagtagagcaaaggccttgggaggctgaaatgagatggtggctggaactggtgggttttcacaccccaaaggtgggtgtgtcaaggggcagaagaacaggggcagtttctgtccgatgtccctcctggaacttggcatgtctggtttcaagaagcaggaactg

SEQ ID NO: 168469 - DNA, 202 bp, Homo sapiens
cgcgcgacttagaggatcccctcccaaggatcagaaaatgtggctaggttttgaaggcattcactgttaggtttaagtgcagctgttcattatgcgtcacttacattgttttaattgtggcgtgtgagtttcagtgcagtttaagtagtgaacatgatttcggagctacggtcctcattttctgggcctgtgtgtcagtttc

SEQ ID NO: 168470 - DNA, 152 bp, Homo sapiens
aaaatgtaagcaacaataaaggataacagattttccgagttttaagaatttaaaagatcaaatagtccactataactcagtaattcctcaaaatcctacggcttggctttctcgggcctgatggtcacaagcagagagtagtgaagccctgg

SEQ ID NO: 168471 - DNA, 294 bp, Homo sapiens
gctggtcttgaactcctgacctcaggtgatccaccagcctcggcctcccaatgtgctgggattatgggcgtgagccaccgtgcctggtcacaatccaggaatttttttcttaagagcctaagagtcttgtctttgaaatgtaaacctggaggaaaatagtgtccctatcttcctgttgcctagggagtttagcctaggcaccttgagctgttactacctgcttgtcaaggagatgtgagaagttttattttttcattggatacaggtaattaactagcatggatggccacgttg

SEQ ID NO: 168472 - DNA, 1583 bp, Homo sapiens
gggtaactcttagggtggaggtctgataacaggccggccttcattaaccagccgttggtatccaatggaatctttatgccccctatcaccctcagtcctctggaaaagtagagaaagccaacggccttttaaaaacacacctcgctaaacttaccctccagcttcagaaagactggaccactcttctaccccttgcactcctcctaattcgagccacaccccaggaacccaccaggctagacataaaatctgccaagctgccaatttcctgttacctactccagagacccagtgatatgaagacaccctagctggactgtcagttctcgttaagaacctaacccctcaaactctacaacctctgtggacaggatcctacctggtcatctatagtaccccaacagtggtcagtctacagaatcctccccactggattcatcgctccaggataaaactatgcccatctgacgaccagcctagctcctccacctcctcctggaagtcacaagtactctctcctacttcccttaaacttacccgcattcctgaaaaagaacaataaccctgtataccttttatttacagtagacctttacacagtcaccccactatttaaactctgtctacttatgcccctaatcaccattctcacctacttctaaatgccctgctttgtctatactgccagttcacgcttttcctccagaccattgtagctgatacctcatggagtcaccctccagctgctacccttaactctctcttagagtggatagatgaccttctgtggcaaagtactctccaattcttccatcctgatgaagttcttttcttttatacttactctttgtcttactcccgttctcctgccaccctctatccctccctaattatctccagaataccatcaacctcacccactccctcttcaccatctccaatccttcctatgcatttccctctcttcctcctactatacaggtgtccctgccctgccagcccactgggcaacttcccccatctccctatacctccaaacctctttcagtgacccccaactttaccctcctgaacaacttctttacttcctagaaaaattcagcaaaaactcccctgatacctcatactaacaaagtgctgttctcctcaatacgtatctacgaaatctatctccctacgtcacttccacacctcctgttcttggacccctcactatacaaacaactatccccattgctgcccccttatgcatctccctacaattacctgctggaattcccttgggtacctcccatcttccttatgttcctttactctttacctccaaggccctgccacccacattaaccaaaatattggagcattccagcttcgtattacagaaaagccctccctcatcactaacactcttaaaaacatcagtagcaacttttgcctaggaagacatttaccctggctctcactccatccttggctatccttcccctgttcaatggattcccctccaaggccttctgcctgcctgtttatacctagtcttataaataacagtgaatggctacttacagataccaaattctttt

SEQ ID NO: 168473 - DNA, 888 bp, Homo sapiens
gacgcgaggacccgccttctctctcggcgtttccgctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagcttgggaagataaggaagggaagaagaagatgaacaagaacaatgccaaggctctgagcaccttgcgtcaggaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtccgtgctgcaacttctgaagaagaaatcagaagctccttctggggagagtcgcaagttcctcaaaaaaggattggggtgactgaagattgagggactcccgaaagattccggagatgatgaagacctggggacaccggtccacatcttcgaatccgagtcaaagggcgccacgggaaaaaacccgcggcgcccaaattcttaaagggcccccc

SEQ ID NO: 168474 - DNA, 937 bp, Homo sapiens
gacgcgaggacccgccttctctctcggcgtttccgctgtcagggccctgcggtgtgactcgcgggctcagctggttggtattttttgggcctcgtgcttcgtggtgggagacccaggtcgaggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagcttgggaagataaggaagggaagaagaagatgaacaagaacaatgccaaggctctgagcaccttgcgtcaggaagatccgaaaatacaaccgtgatttcgagtcccatatcacaagctacaagcagaaccccgagcagtctgcggatgaagatgctgagaaaaatgaggaggattcagaaggctcttcagatgaggatgaggatgaggacggagtccgtgctgcaacttctgaagaagaaatcagaagctccttctggggagagtcgcaagttcctcaaaaaaggattggggtgactgaagattgagggactcccgaaagattccggagatgatgaagacctggggacaccggtccacatcttcgaatccgagtcaaagggcgccacgggaaaaaacccgcggcgcccaaattcttaaagggcccccc

SEQ ID NO: 168475 - DNA, 675 bp, Homo sapiens
gacgcgaggacccgccttctctctcggcgtttccgctgtcagggccctgcggtgtgactcgcgggctcagctggtccggccgtagcacctccgcgccgtcgccatgtcgcggtttttcaccaccggttcggacagcgagtccgagtcgtccttgtccggggaggagctcgtcaccaaacctgtcggaggcaactatggcaaacagccattgttgctgagcgaggatgaagaagataccaagagagttgtccgcagtgccaaggacaagaggtttgaggagctgaccaaccttatccggaccatccgtaatgccatgaagattcgtgatgtcaccaagtgcctggaagagtttgagctcctgggaaaagcatatgggaaggccaaaagcattgtggacaaagaaggtgtcccccggttctatatccgcatcctggctgacctagaggactatcttaatgagcttgggaagataaggaagggaagaagaagatgaacaagaacaatgccaaggctctgagcaccttgcgtcaggaagatccgaaaatacaaccgtgatttcgagtcccatatcacaagctacaagcagaaccccgagcagtctgcggatgaagatgctgagaaaaatgaggaggggatgataaagcattgttttaatggtgaaaacttcacagatca

SEQ ID NO: 168476 - DNA, 277 bp, Homo sapiens
cactcagttacattaaatttcttctgcacaaaattggtctaattccatacatatttttgttatataccgttcacctgttctgtagtttgtcaggcaaggtccacctcatcatttgatatccagctgtagcaattcctttccttaaagcccttcacccactgaagtcatcctttatgccagggtggtaggaagtatgttaaccgttgttacagtactcatcacactatatagctgctatttgtttttctttctgcctgccagacaaggagctccctaa

SEQ ID NO: 168477 - DNA, 733 bp, Homo sapiens
aactattagcagttgtacactccaagaccatgaattactaagttgtaaagttattaatcaggggtaggtgctgagaggccacagaatgcaaaaccatgtttaagtttaagtaatagaaagctgccttcgaagagattagaatctaatatttgagacttttgtgttattcttaatgaccttcttacttatcctgagtgttttccttctttggatagctctactaaaagattaaacatataaatgaaagcaaaacctcaaactccacgtttgatcagagtatgagaagcttccattttagttccatttctgattaattcccaattataaattcattacagagggacttgatagcttttgactaaatttagcaagggatatcaaaatatatctgagctcattttgaggttcaaactgctatcctaaaaagtataacatgccataatttttcagatgaaaataccttcctttagctgcatgagatttgaaagaaacttacgcatggtcaaacgggagtgtcaggcacaacttggtgtcaagtctctggtctgtgcttctggatccctgatctagctccattttttatcccattccatggatcaaacctgacctaaggcacaggtatacctgcccccaaaaccaatgttacaataggaaaaccaattggatctacccattttactcagtgtttcttccttggtccctattctcaagatcctagttacctagcctctgt

SEQ ID NO: 168478 - DNA, 312 bp, Homo sapiens
agagacttgcaaggccccttgaggccccagacgacagcacattcttctttcccccacagtctattggccaaagtaagcctcaggcccagcccagattcgaggagtgacgaaagagcctccatgtcttttggggggcaaagctgcaaggtgacaggacagagggtgtggaacctgggagacctttctgtcccccacagccgagtggctgcagtgggccccagagctgcatcccctggcctcaaaagcagaacagccattgctgccccgctgcctatcctggtgtctcttctccggaccacacgtctgagtctg

SEQ ID NO: 168479 - DNA, 573 bp, Homo sapiens
tatagacactcatccttcaggaccattccttgataactccttacaagcttctattactcactccccagttccttaaatcttcttcctcctgtctaataaaatctttttaaaaaatacactgtctcactgtgttgccaggctggagtgcaatgaaaatgtgatcataactcatgatagccttgaactcccgggttcaagtaattctcctgcctcatcctcccaagtagctgggattacaggcatcggtcaccacacctggctaattttttgtatttttaaaagaaacggggtttcatcatgttagccaggctggcctggaactcctaacctcaggtgatccgcccacctcggcctcccaaagtgctgggattacgagtggcatgagccaccgtgcctggccccatgtacttttcaacaatgaataatgacaataggaatggagaaaaaaatagactagtccagaaaatatttagcgagtgcctctcttgagctgggcacagtggctcacacctaaaatcccagcattttgggaggccaagatgagaggattgcttgagcccaagagtttgtgcc

SEQ ID NO: 168480 - DNA, 350 bp, Homo sapiens
aagggacaaattatgagctgctgtaaaggtacacacagtctagtgagaaaccattcaattttgagggggaaactctagggaaatagagtaagttaaaggagtagagtgtgccagtatgagaaggcaactctcctggagtttgagttccaaaactcagtgggctcataggtcatggtgtgatcttagaagtcataagtgaccaacaaggagtttaataacgccttttcttatactccctctttttacatagcctttataccaagttatcatctggcagtcattttagatataggtttctaagttagacggtagggtccaaatgaagtgtttggcaaagtcatcttaatttt

SEQ ID NO: 168481 - DNA, 601 bp, Homo sapiens
tgaattcagaaaaatccaggttcagacaccggtcctaccaggtcctagccatgtgaccttgggtaagttatatgacctccctcaacttcaatttcgtcatctgcaaaacagatatacacaatgactacctgcttcctagggagattcaaagctgtcattcggcttaggcacacagcctggggccagcactgggcacaggctcaggaactccagatacccagcggcaaagagcacagttggcctcccgaagcttcagtttggaacactgcattggcaatgggaccccagacagaaatgcagtcattagaaagggaaagggaaatgtgtttgtttagttattgcttcctcagtgaggtggctttactgtaggaatatttaaacagcagcgctttgaaattgaggcagccaagatataacctagtggagatatcttaggggctttgggaacaaaagaaacagaaacaaagacctggaattcaagtgaaagaggaggacaaaaaacacaccccaaggggaggcaggtgggttttgtgatgacagtggtctcccatctgccctgtcccctgcttccggctcggttcactgtcccctctgcatggca

SEQ ID NO: 168482 - DNA, 329 bp, Homo sapiens
ttcctacatacaacatcttatagcttctatatacctcatttcaaacaaaacagaatttcataaaagcctcatgtaacttctgtttctaccaatcattacgttacatgaaatagtatttgatcaataaggcaattctgtgtcaaattttatacacaatttgcttcttacaaaagaaagactaacatctagaatttattcaaaatgtgtcgtggtacaaattcctttaatgtcgccaacctaattcataacactgtcatgagaattactattaccttgtatgagttactccagggatcaacaaatgacaacctgtggactaaattgagccc

SEQ ID NO: 168483 - DNA, 327 bp, Homo sapiens
aaatctcagaaggatttttttttaaatgacaagctgattctacaattcatatggaaaatgcagaggacctagaatagcccaagcatcatgtaatttcaagacttactataaagctctagtaagtaagacagcagatgaatagaccattggaacaaaatagaaaatctggaaatatacatgtatgacagtggacttctgacaaaggtggaaagacaattaaatgtacaaaggaaagtcttttcaacaaatggtaccaaaactattagatatttatatgcaaaaaattgatccatacctcacatgatgtacataaattaactcaaagca

SEQ ID NO: 168484 - DNA, 178 bp, Homo sapiens
agcaggaccacctgctgttggctgactgaccttgctgttccctcagactcttagggacctcctcctgccccactccaatctggacaccacgaggcaaaatgtagccaggaccccaggaatcccgtttattaatgaatcagctgttagggcagatgtcaaagtcaggcttgctatttcc

SEQ ID NO: 168485 - DNA, 285 bp, Homo sapiens
ccccatgtcactttgtcacagtgtagtttgtgactggttttctccactctgtaggttgtttattctgctgatagtttcttttgctgtgtagaagcgctttagtttattaggtccctcctagcaatttttgttttcgttgcaattgtttttgctgacttagccaaaaattcttggccaaagccgatgttgagaacgatttctttttttttttctcttttttttttttcctttttggagacagtgtcttgctctgtgcgcgggctgaattgcagggtttggactctg

SEQ ID NO: 168486 - DNA, 483 bp, Homo sapiens
cttccacctctactctcccacctgcattgaccctcagaacacagcttccctcctgcaactgcctcataaacatacctcttagcaggggtcgactgcccacttgtgcattagtaacccactccagaaattctctgtcctgtatttcccatggccttcccactagagtcttccttctggcacattaacacatacacacacacacacacacacacacacacaacacacacatacacatatattatttcccccgtcttaaaaaagcaaaaccacccttggccccactcatccctctagctatcacctaactttaacttttctcatttcctcataagagttgctttgcccactgcctccaatttctctttttcttttctcttggacccagtcaaagggagctattgctcccaccacccttctcagctgctgctttcaggtaccagtgacttttgtgttgcactagacacagccaaccactccctcctc

SEQ ID NO: 168487 - DNA, 376 bp, Homo sapiens
catatcttaaaatctatttgccgccaccaatttttgattaatgaatgccaggcagtgaaattaagaacctacaaatgtaaaatattttctaaatacttagaaatttctgttataaattagtatttttaggattaattttctagaatattctaccacatcctctttactaagcacagtactaggttggtaactgaagaatatgagaaagattcatgttatttattttcaataaagcaggtattgctgtttctaagccagacctgatcacctgtctagagcaaggaaaagagccctggaatatgaagagacatgcgatggtagatcaacccccaggtaggtgagagtgaacacaacagacgacatgaatgagaggtcc

SEQ ID NO: 168488 - DNA, 2299 bp, Homo sapiens
tttttggcggggcctttgtccctcgctgtggcctgagctccaggtctcgtcttcagcgctctgtgtcctctgctcctagaggtccaggctctgtggccctgtgacctgcaggtattgggagatctacagctaagacgccaggaacccctggaagcctagaaatggagaacctgaagtctggagtgtatcctctcaaggaagcaagtggatgccctggggctgacaggaatcttctggtgtactctttttatgaaaaggggccattgacatttagggatgtggccatagaattttctctggaggagtggcaatgcctggacactgctcagcaggatttgtatagaaaagtgatgttagagaactacagaaacctggtcttcttggcaggtattgctgtttctaagccagacctgatcacctgtctagagcaaggaaaagagccctggaatatgaagagacatgcgatggtagatcaacccccagttacatattctcattttgcccaagacctttggccagagcagggcataaaagattctttccaagaagtcatattgagaagatatggaaaatgtggacatgaagatttacagttaagaacaggctgtagaagtgtggatgagtgtaatctgcacaaagaatgttatgatgaactaaaccagtgtttgacaactacccagagtgaaatatttcaatatgataaatatgtgaatgtcttttataaattttcaaatccaaatatacaaaagataagacatactggaaagaagcctttcaaatgtaaaaaatgtgacaaatcgttttgcatgcttttacacctaactcaacataaaagaattcatattagggaaaattcttaccaatgtgaagaatgtggtaaagtctttaactggttctcaacccttactagacacagaagaattcatactggagagaaaccctacaaatgtgaacaatgtggcaaagcttttaagcagtcctcaacccttactacacataagataattcatactggagagaaaccctacagatgtgaagaatgtggcaaaacctttaaccggtcctcacaccttactacacataaaagaattcatactggagagaaaccctacagatgtgaagaatgtggcagagcttttaaccggtcctcacaccttactacacataagattattcatactggagagaaaccctacaaatgtgaagaatgtggcaaagcttttaaccaatcctcaacccttactacacataagataattcatgctggagagaaaccttacaaatgtgaagaatgtggcaaagctttttaccgattctcataccttactaaacataagataattcatactggagagaaattctacaaatgtgaagaatgtggcaaaggctttaattggtcctcgacccttactaaacataaaagaattcatactggagagaaaccctacaaatgtgaacaatgtggcaaagcttttaatgagtcctcaaaccttactgcacataagataattcatactggagagaaaccctacaaatgtgaagaatgtggcaaagcctttaaccggtccccaaaacttactgcacataaggtaattcattctggagagaaaccctacaaatgtgaagaatgtggcaaagcttttaaccaattctcaaaccttactaaacataagataactcatattggagatacatcttacaaatacctagaatgtgataaagcctttagccagtcttcaactcttactaaacataaggtaattcatactggagagaaaccctacaactgtgaagaatacggcaaagctttcaaccagtcctcaaaccttattgaacaaagtaattcatactggagagaaaccctacaaatgtgaagattgtggcaaagcctctaacccgtcctgaattcttactaaacataagaacattcatactgaagaggaaccctatgagtgtgaagaatatggcaaagccttcaacaagtcctcaattcttaccagacataagataattctggctgggtgcggtggctcacacctgtaatcccagcactttgggaggctgagacgggtgaattacatgaggttgggagttcgagaccagcctgaccaacatggtgaaatcctgtctctactaaaaatacaaaattagccatgcgtagtggtgcatgcctgtaatcccagctactcgggaggctgaggcaggagaattgcttgaacccgggaggcagaggttgaagtgagctgagatcgcgccattgcactccagcctgggcaacaagagtggcactccatctcag

SEQ ID NO: 168489 - DNA, 561 bp, Homo sapiens
tttttggcggggcctttgtccctcgctgtggcctgagctccaggtctcgtcttcagcgctctgtgtcctctgctcctagaggtccaggctctgtggccctgtgacctgcaggtattgggagatctacagctaagacgccaggaacccctggaagcctagaaatggagaacctgaagtctggagtgtatcctctcaaggaagcaagtggatgccctggggctgacaggaatcttctggtgtactctttttatgaaaaggggccattgacatttagggatgtggccatagaattttctctggaggagtggcaatgcctggacactgctcagcaggatttgtatagaaaagtgatgttagagaactacagaaacctggtcttcttggcaggtattgctgtttctaagccagacctgatcacctgtctagagcaaggaaaagagccctggaatatgaagagacatgcgatggtagatcaacccccagatggagtttcactcttgctgccaaagctgagattgcactctagcctgggccacagagcaagactccatctaaaaagta

SEQ ID NO: 168490 - DNA, 741 bp, Homo sapiens
  misc_feature (460)..(460): n is a, c, g, or t
  misc_feature (566)..(566): n is a, c, g, or t
  misc_feature (735)..(735): n is a, c, g, or t
  misc_feature (737)..(737): n is a, c, g, or t
atagatcccccggtgatgcagatgtggctggtctgggaacactgctcttcccatccttgctctctgctgcatcacccagaaagcagcaacagtgggatgcagtcagaatgagctcctgctccccagctcatgcagctgcacccagtgttcctctacctcttcttggacacgcagcctgtggcgccccctgcttcagcaccagaccccacaccctcactttgcagggtgtggttcctctctccctcagcaattccactgacttatttccagcagcaaatacacatgctgttatttctcccatctttagaacacagctttcctagccccatatcccttaagcggctgctcaagttttcttgataaccagtcccccaattcttctccgatccttcctcttgtaactgctctgaagtctactgctgcagagtgccctaatcacaagcctgtggttccatccatntttacccagtgaacacacttatggaaaagcacttagtccacagcgcaaaaatgcctagcaccttggaagccccctgcacccccttccagtgttaccctcccaggancatcagatcctgccttccaaaaactgcaaggactttgcttgtttctgaacttccataaatgaaatctgacaaaatgtacttttgtgtgtctggattcttcaactcaatgttaggtctgtgccgttcactcataccattttgatactgtagtctgttcattctaagtctngnaatt

SEQ ID NO: 168491 - DNA, 242 bp, Homo sapiens
atatgaacgatttattaccgttttgtctttttgtttgctgtccctattgtttttatacccatgggttcaggttcagattgaatgagaggaaagaggttcccccttgccttcaggggctctctcccagttttagcaaagaggacacttggaaataaaaggtctgtaaatggatttccagaacactctctgccggcatcacttgaaatatcttcctgtttccccaaggatccatacctccagtg

SEQ ID NO: 168492 - DNA, 695 bp, Homo sapiens
gggcaggggtcactgtggcagaatattagtgatggcttcctggagtggcaggccacagccaccccacccttaaaaaggcagttgtactcattgaccccagtcctcggccctccctgttgcctcccagacaagatgtccctgcagattttttttttttttttttttttggaaaggggtttccgctctcggctcaccccgggcggtggcagtagtagggggtgatagacctcacgcatacactggacaagccccgaccaccggggttcccacgccatttcctccgtgccgtcagaacctcccgagataagaggggcataacgggcgaccaccatgtgcgccgagcaaaaataggatattacaacgaaaaagagggggtacccacccaggggctctcaaaatctccaacactcggagagtcccgccaccacatcggcccccccaaagggctgcgggaataacggggcaaataaccccacgcggggcccaagccgccccgtgaaaaatttaaaacgcaggaggaggacttccttcggcgcactggcaatctaaccactcgaggtcttggcatgcacagctggagggccgaacctggggatgagcccaggagggtccactgccccacaattggacagccaggtgccgaacccaacagaggacgggcccaccgtgacaaacgccctgaactacacaagggc

SEQ ID NO: 168493 - DNA, 1178 bp, Homo sapiens
tataggaatgtgcagtgtagataccagcatacctcaactagaaatgcatcattcatgaaaagccagcaagagcacttgtgaatttggaaatggcctggttcatagaaaatatgtgcttttttaaaaatataggactgattgattgattgataatagaatgtatacgtccatataaaatattccagcttcctgacaaccagttatttgcactgcttcctcggttgcaagttagaacagacataattgtctaatctacatctgcttaaaaagttaagctgttgtctttgcccagtttttagtatttgcaaaggatgacaatgcatgatttatgtaatgtatttttgagatgtaataagaatacgatcctagacaaatcagtttaggcatctgtttttatatttaaaaaggagtgtttggactatctttagggcgactactgtctttaacttctaatatacaagtagaacatgatgaataatgaataaattatttaggacaaaaaaaattttattagaagcatctcactagaaaattaattagtgaattcaaaaacaattcaagttttatattgaagagctaactgactcaaaggaaaggctattgtaaatggagataagtaagtcaccacacctatgaacagccagagagccctgtgataaatcaaatttttaaatactaatttaagggaaaatggtttgtattcagatgtaatttgtacacagtaaaatgtatcgattttaggattatagttactcacttttgataactctctacacccatgtaacccttacccaatccaggttaagaacccttccgtcattcctcaagggtcccttgtgccttttgcagtgaatttattcccctcttggtcccgtcccagcaaccattttctgatttctgttgtcttagatgattagttttgcctactcttgaattttatgtaaatgaaatacacagtgtgtcacctttgtgtctggcgttgttgctcagcgtctctgtgggactcactcatctacgttgtgccaggacccatagttttctttttgctactcggtagtgtttcattgcatgaatgtaccacaatttgtcctttctcctctttatggacatttgttcttttacagtttggggctgttgttaaataaagttataatgaacattctttgtggacttatgtt

SEQ ID NO: 168494 - DNA, 1196 bp, Homo sapiens
ccagaggatcccagtggaagatgtgctacaacaggatctagaagaatatgtcaaactataaacggttgtgatgtgaatgacttggttcttggcttgtgtttttcaatttcctataatgcacattcttccaaggcttttttaaaaatataggactgattgattgattgataatagaatgtatacgtccatataaaatattccagcttcctgacaaccagttatttgcactgcttcctcggttgcaagttagaacagacataattgtctaatctacatctgcttaaaaagttaagctgttgtctttgcccagtttttagtatttgcaaaggatgacaatgcatgatttatgtaatgtatttttgagatgtaataagaatacgatcctagacaaatcagtttaggcatctgtttttatatttaaaaaggagtgtttggactatctttagggcgactactgtctttaacttctaatatacaagtagaacatgatgaataatgaataaattatttaggacaaaaaaaattttattagaagcatctcactagaaaattaattagtgaattcaaaaacaattcaagttttatattgaagagctaactgactcaaaggaaaggctattgtaaatggagataagtaagtcaccacacctatgaacagccagagagccctgtgataaatcaaatttttaaatactaatttaagggaaaatggtttgtattcagatgtaatttgtacacagtaaaatgtatcgattttaggattatagttactcacttttgataactctctacacccatgtaacccttacccaatccaggttaagaacccttccgtcattcctcaagggtcccttgtgccttttgcagtgaatttattcccctcttggtcccgtcccagcaaccattttctgatttctgttgtcttagatgattagttttgcctactcttgaattttatgtaaatgaaatacacagtgtgtcacctttgtgtctggcgttgttgctcagcgtctctgtgggactcactcatctacgttgtgccaggacccatagttttctttttgctactcggtagtgtttcattgcatgaatgtaccacaatttgtcctttctcctctttatggacatttgttcttttacagtttggggctgttgttaaataaagttataatgaacattctttgtggacttatgtt

SEQ ID NO: 168495 - DNA, 369 bp, Homo sapiens
cggcgacctagaggatcccgtctgtccatctagagaatgctgactatacaggattgttttgactcttttcactttgtcatttgtgtatcagagtttttcttttgtggttactttgagacttgcataaaatatttgtaattgtaataatctattttaagttgatacaacttaacttcagtcacatacaaaaactctacactttacttccctctctcattctgtgttcttataatcagagtttgatactttttgtattgtgtattcattaacaacttttttaatttttaaaaagtttttattttttatttttttttgaacatttaccttcaggggcacatgtgcaggtttgttacataggtaaatgtgtgt

SEQ ID NO: 168496 - DNA, 143 bp, Homo sapiens
agtcagtgaagaaacataaaaacagtcgcatagaatgatgcacagagatttagaaatagcaccataaaagctctaaacagggagattccacctggagacatcagcaaggcttgcagaggagagagaactgaccatcgccgatc

SEQ ID NO: 168497 - DNA, 144 bp, Homo sapiens
gtggagagagagcctgcaagagaattagcacgcacctcgtggatcttagtaattgttttaaagccaaataaaactgtttcttgaataaaccaatacatttctgaagttgaaaagaatcccaaaggaaacgaatgaacatccttg

SEQ ID NO: 168498 - DNA, 631 bp, Homo sapiens
gtctgtatcctgttctttgatctgtgtgtctattgctcaccaatgccacatcgtcttgattactgaagctatgtagttaaccttaatattgagtagagtgactccttcaactttattattattttttggattgtttcagctaatctgtagcctctgcctttccatgtaaattttagattaaacttgtctatgtttactacaaattttgctgagattttgacaataattttatgaaatctatagattaatgggaaaaattgatatccttactatattgagtttcactttctttttaaaatatattttctccttaacgtccataccagtacacccatctgggtttctctcttttgctgctacctttatcttatccttctgcctcatcttcctctacctagattttaagtatcagtttcttgaagttcaatcctagaatcactttttcctctctatgtgctctcagactgaacacatcaacacccatctcttcaatgaccatcaaagcaaaaataatgacacacacaaagactcactcaagtttatatccacaagctacttctcttcagaaccctggacattatatgaaattgcctaactgaaatctctgcttgaatatcccagagacacctta

SEQ ID NO: 168499 - DNA, 494 bp, Homo sapiens
agatggagttttgctttgtcgccccagctggagtgcaatggtgggatcttggctcactacaaaccccaccttccgggttcaagcgattctcccacctcagcctcccgagtaactgggattacgggcacacatcaccatgtccggctaatttttgtagagacaaggtttcaccatgttggccaggctggtcttgaactcctgatctcaggtgattcgcccaccccggcctcccaaagtgctagaattacaggcgtgaaccaccgcatccggccaaatatcatcttcttactgaggccttacctagcctatttaacactgtaacctacccatactcttttggtaccccttagctaaatctttctccacaataatagttagtattacaaaatttttaaaacttctctcccccactcaactaaaatgttagccctacatgtgtaaggatacacgtttttgtgtatcttattcactgttatatctccagtgcctagaac

SEQ ID NO: 168500 - DNA, 361 bp, Homo sapiens
ggaatccattgtagacttggtttaaatgactgtctttggttatgaatattgtttctaaagagtaaagtcacatgagtacattcctggtaatataccagaggtcaaacagcccaacaaatgaagagtttgaaatgtagataatttaaagatgaagtactagcagtctgtaagcaagccagtattgaaagcgaacgtcactgaggttattgatgaattaaaactaatggataggggtgagaaataaattagataaaaatgcagcaccaaaaaggagagagatgttatctggaattcactgtcccttacatatttagttaattcttgttgatgttgctgttgctttagatgttgtggtatagat

SEQ ID NO: 168501 - DNA, 387 bp, Homo sapiens
agacagagtcttgctcttttgcccaggctgaagtgcaacggcacaatcttggttcaccgcaacctccacacctctacctacctaccaggttaaagctattctcctacctcagcctcctgagtagctggcattacaggcacatgacaccacgcctggctgatttttgtgtttttagtagagatggggttttgccatgttggccaggctggtcatgagctcctggcctcaggtgatccacccgcctcagcctcccaaagtgctgggattacaggtgtgagcctccacacccagccatccattcttgaaagacagtttcattggatacataattctaggttgacgagtatttcctttcactctttgaagaaatcattctggcctccattg

SEQ ID NO: 168502 - DNA, 378 bp, Homo sapiens
agggaaagaaggttctggtggaaggaaggtgcccatccactgtgatggtgtagtcttgtagatgataactttatggggaaccagcaaaaagtggaaggtgactgctgtttcaagcttgagttgagggaggaatattgagtagtgtgtttgaaacaaataagtaagtccagtagaatgtggagtgtgtgcgtttgcttcttaagaggagaggatgctatgaaattaattttaaacctgctgaggatgaaagaaatcaattgaaagtatagaatcaattaatagtagaggtcgtagggaacatgaagatttcccagttgtagagattgggagattggagcctgggaattggattggctgttctgttctgcactcagcccg

SEQ ID NO: 168503 - DNA, 249 bp, Homo sapiens
tccgagctcggtaccgggtgtcatgaaataagtaagtccagtagaatgtggagtgtgtgcgtttgcttcttaagaggagaggatgctatgaaattaattttaaacctgctgaggatgaaagaaatcaattgaaagtatagaatcaattaatagtagaggtcgtagggaacatgaagatttcccagttgtagagattgggagattggagcctgggaattggattggctgttctgttctgcactcagcccg

SEQ ID NO: 168504 - DNA, 396 bp, Homo sapiens
  misc_feature (18)..(18): n is a, c, g, or t
  misc_feature (26)..(27): n is a, c, g, or t
  misc_feature (31)..(31): n is a, c, g, or t
  misc_feature (42)..(43): n is a, c, g, or t
aagctgtatgtaactcangggcgagnngcangtgactcaggnncgagctgccagtccatggggattgtaaacctcatagaaactgccagaggttgaacatggaagggtttttctctgttctacaaaacgaatctatctgggcgctggctgccatccaggatcacagctcctaacctcgggttcattccgtaactgggaaaacctgcctgtccggctttgatggcctcgctggctacactggccctgtagaagcctgaaccttctctcttttcttccattccctcctttttctccttggcagtttaaatcttggttcagagtgtatctcacccttggaatgtttctctctttgattcagtatctccatgtaaatcgaccgctcctttacaaaggagg

SEQ ID NO: 168505 - DNA, 563 bp, Homo sapiens
tattctctatctcctaaataactgcatcacccctataagcttccattttccttcttcaaagccagtaatataattttattactgagttttgaataataattaaagcctttaaaatgttctatatccagagatggatgatgtttgattttcatgaggtcttctgggaatgttactgccagattgccaatgaaatgtcggccttttcatgaaaggtatcacattacttaatggattcaacctcttgtccctggcattcaatagattaattttgtttttattggtttctgaccaacaccatcctcaatacttgaagttacacactgcccataaaggattaattttacacaagaatatcaccaagattaaaaaatggggtgggtggggaaacaaaaaggaagtaagatatagagctccagctgaagtgatcaatagtaatctacatttcacttgtttttcttctcacttctctcactgtcctgtcatctctgcatatctctttttgcaaattatagcattgttttggtttacaggcaactcaaattttgaaggtgattttagctaaa

SEQ ID NO: 168506 - DNA, 536 bp, Homo sapiens
acttgaggtgtgaagtacttacactcctaaatgtacaggctgattaccccttatctgacatgcttaggatcagagatttttctgatttaggaatattttgcattacactggttgagcatccctaatctaaaaatctgaaatgcaaaatgttccaatgagcattcctttgaatgtcatgttggccctcaaaacgtttcaaattttggagcatttaggattttcagattacggatattctgcctgtattacctctcccccaaattgctacaacttaagacatattttaaaataattttataatttaataacaataaaaggtaccaaattagaaaccaagccttaaggttacagtgtcagtttttccatttaaattagtttccaagaagattgtttacattctatacttaattgcaagaatattaagtatgtttcctattcaattcaacctgtattaacagatacttcatgccattctatggtaaaacagttgaatttgtgaataagataaaccttaattaatcaccaaaagaactaaa

SEQ ID NO: 168507 - DNA, 478 bp, Homo sapiens
tgtttgggatggaattctgccagcatgctcctgatgtaaggaaaggaaaatttacctcttgccaagctcagcatttagaagtgtatctggtacatagtctgtggtgtgtgtttgttcggtagataagaaatgcttatgaccaaaggcatacttcagttgggtagatggtcagctagcaaacatgtctagtaccaaacatagtgaggcaagtgtctcgagaggttacagaggacttaggagagagactgaccagaacagacttcatggaggaggtagtgtctagggaccctggtgaaccagcggggaggattctagaacaagatatccaagcccttgtcacctctcttgagctgtggccacagcctccctcctagcttcccagcctctcgtccctctacagtcagactgattctccacacaaccttcagagtgagcccatggtttaaaacccccacagtgtccccattatggacagaaa

SEQ ID NO: 168508 - DNA, 428 bp, Homo sapiens
ctaggaagtatttcctgctattttacagatggagaaactgaggaacagaggtgctgagtcatcggctgaaggttactagctaggggagggaggatgaacgactgcaagtacatgctggagggggccagagccacagccagtgtgcctgcccttttaccacccaaaaaagcagctcttggaagaccagccaaggaaactggcttgctctgcttggagattagtcccatgtaatataaacagctgatcgcagagactttggaaaacaggactgggagtggagcggggtggggtgagtttttgagaacttggcttgttttcttgctggttttcttaccagtctgcaggagtcattgatttaatgtccagcctctggtcatggggaattaaaatggtcacagggaaaatagaattaaaatgcttggaaaatc

SEQ ID NO: 168509 - DNA, 1525 bp, Homo sapiens
  misc_feature (1384)..(1384): n is a, c, g, or t
aagtcggagggaggaggttgctcagagtggggtgttgccctctgcgaggatttggagtcccctggcctcccagcagggagtggagaggcattcccagaagcatcagcttcgggcatctccagaaccctggcttggtccctgaccaaggagtgtccccaactgctgaataggccaggagtcgcctttctctaaggcttacatctctccctctggggtgtgtcctgcccctccctgagtcaccccaaggggagagaggggaaaaaagggaagagaagagaggcattgactacagaggaaggaaaaggaagcagagcagaggggggagagaggccacacaggagtgggtgacagaggagactgcagagggcaggtctagggcagaagatcgagagagggcaggcccaggtcaggaggaggtagagagagggcagccggagcaccccaaggggtgcctcaagagcaggtgggggcggggagccgagggggcgggccggccatgtcccacgggacctactacgagtgtgagccccggggtggccagcagccactcgagttctcagggggccgagctgggcccggggagctaggggacatgtgtgagcatgaggcctccattgacctctccgcctacatcgagtctggggaagagcagcttctctccgatctctttgccgtgaagccagcgcctgaggccagaaggctcaagggccccggaacccctgccttcccccactacttgccgcctgaccctcggccctttgcctaccctccacataccttcggcccagacaggaaggcgctggggcctggcatctacagcagcccagggagctacgaccccagggctgtggcggtgaaggaggagccccgggggccagagggcagccgagctgccagccgaggcagctacaatcccctgcagtaccaagtggcacactgtgggcagacagccatgcacctgcccccaactctggcagcacccggccagcctctgcgcgttctcaaggcccctttggccactgccgcacccccctgcagtcccctcctgaaggcgccctccccggctggccccttacacaagggcaagaaggcagtgaacaaagatagccttgagtaccggctgaggcgggagcgcaacaacatcgccgtgcgcaagagccgagacaaggccaagaggcgcattctggagacgcagcagaaggtgctggagtacatggcagagaacgagcgcctccgcagccgcgtggagcagctcacccaggagctagacaccctccgcaacctcttccgccagattcctgaggcggccaacctcatcaagggcgtggggggttgcagctgaggctggctggtggattgtgggcaccaggctccctggcacggnctaactctgcggacccccatcctgctgggggcctagaaccctgagacatagaccatggataaatggcaaccggggtggcaaagagggcaggacccagcataatgattatatggctgaataaagttgcactgtgactgggtg

SEQ ID NO: 168510 - DNA, 418 bp, Homo sapiens
gcaggatcaaggatcaaactgagaaacttaaaaacctaaacaaataggcagagcacagtggctcacgctgtaatcccagcacttggggaggctgaagggggcaggtgacctgaggtcaggagctcaagaccagcctggtcaacatggtgaaaccccgtctctactaaaaatatgaaaattagctgagtgtggtggcacacgcctgtagtcccagctactcgggaggctgaggcaggagaatcgcttgaacccaggaggtagaggttgcaatgagcagagatcacgccactgcattccagcctgggcaatagagcgagactccgtctcaaagaaaaaaaaaacctgattttataaatatgtcactgcaaaatttacaacacactctcttcctcatataactctctcaataaccttgtag

SEQ ID NO: 168511 - DNA, 472 bp, Homo sapiens
tcaacagtggtggtcccatcaaattataatgctgtattttaccataccttttccgtgtgtagatatgtgtaggtacacacatacttccattgtgttacgtctccctacagtagtcagcacagtcccatgttgtacaggtatgtggcctaggagcaataggctacaccctatagcctaggtgtgtggtaggctataccatctaggtttgtgtaagtacactttatcaagtctgcacaaggacaaagtcacccaatgatgcatttctcagaatgtatctctagcgttatgcaacacgtaactgtgatggacatgttttaacttgaagcatatccactgtgctagatgttcacacagaattatggtccttttagcaactaaaatagaattctaaagaaagacaaccagctgggcgcggtggctcacgcctgtaatcccagaactttgggaggccgaggtgggcagatcacgaggt

SEQ ID NO: 168512 - DNA, 298 bp, Homo sapiens
aagaattttcttcttatgcagaaagaaatagatgggttgcaggtagtatttagggtacttctgaaacatgaacatagagagatgacatcttaatgatttcacattttaattttagcatcttttccacaatatgataaaatgcatatgtttttaacccaaatgattaatttgctttaaaactgattaattatctagaggaaggtttagaaacgattgacattttgggctgggtaattctttgttgtgaggggctgtcctgggtattgtaggatattcatcagcatccctggcctctgct

SEQ ID NO: 168513 - DNA, 326 bp, Homo sapiens
cggcaccagggaagccaatagtgtaactctcagtctgaaggcctaaaaaccaaagcagctgctggtgcaagttccagagtccaaaggccagataacctggagtccaaaggcaggagaagaagggggtgtcccagttccaggagagagagaaaattcaccttccctctaccttattctattcaggttgcccacattgagggcagatcttccccactcaattcactgactcacataccaatctccagaaataatgctttaccagctattcaggtatctcttaatccagccaagttgacacctaaagttaaccatcaggtcatcctttg

SEQ ID NO: 168514 - DNA, 269 bp, Homo sapiens
tggtagggaaaaaaagaataagaatagatttccagggaggagaacaagcatgcacaaaggcacagaggtgtctttggagcactagtgagcagccagtcaggctagagctatggggttaatgcagttcactgagtgaagatcagaccatcgctcccagttctctgctcgctgtcaggtgactgggcagtaacttcccccagaatgggtgaagcttatttccttgcttcacttacgttgggtttggccatgtgacttgctttgaccaaaag

SEQ ID NO: 168515 - DNA, 446 bp, Homo sapiens
caagctatccggttcaattgagacgagcaggcttagggaaatgattcatctgtaaacaaaatattaaaacctaagaagcctatgaatatacgatgtgattagatttcctttattatctgacattggcttgaacctccccttaccaggaagaacagttgcctctcccaaggcagccccctagtgcgacatgtctgtggtgtgctctccactaggtccttgtgtttgtagcactgcctcctctctgagccattgtcccatcagctctgttactactgacggctgccctgggcacagcgattcttcactgcatctacctaagctacctccattgtggcttcagaagagaccttcttccatggatggctcacaggacagttgatgccaggatgtcatgagccgcagaaagagaagaaacattgaaccggatagctcagcataagtcccac

SEQ ID NO: 168516 - DNA, 304 bp, Homo sapiens
tgatggccaaccaccattctgatttctatcactatacactagtttgatctgtgtttggacttcatgtaaatgaaatcatacagtatatattcctttgtaactggctttttttaacctaagaatgtttttcaggcttatccatatttttatgtgaatcagcagtttattcatttttattgttcagtaatatatcaatgtgtgaatatattatccattcgtctgttgaagtcatttgagttctttccagtttcgaactattatgaataaagctgctaaaaacatttttaaaacaagtcttgttgtg

SEQ ID NO: 168517 - DNA, 445 bp, Homo sapiens
caaagaagattcattcaagtctgatattaaaatatatggttacctcttaattcccatactgcatcattgtgtagctcatgtctcatgatgctgacatttcaggagcatgttaaggaggtgtcagagtgaaggaaggggcatgagacttctcgtggacaggtctttgtctctccacttctgttagctctccatctataagcagattagtcctttttcagttgtctgagctgcagatacaatttccaacattttcattggtcacttacttcggttatgattttaaaaacatgttattgtcaagcacaccgtttttataaatttgaatttgtcagtcttttatggcttatgtattgagttatgattaaagaagtcttacctacatgagataatataaaatgaatctatgctgtcttatactattaaattatttcatttgtaaacatgt

SEQ ID NO: 168518 - DNA, 277 bp, Homo sapiens
cggcgccgggcccgctgggaactgtagttttcgtgaagaaacacgcgtcttgttttgggtgtcatggcttggcagatccgccaaaacaggcaaatggcattacacaatgagtatttatgcttcctgccgccaccaaaaggaagttcactgccatgctaaaagtttaacaaagaactccataaagaaacacaagtctcacaacaaaaagccaacttcccacctcgttaccagagttggtttaaagtggtggcaccttatcatttctcatgaccagttt

SEQ ID NO: 168519 - DNA, 272 bp, Homo sapiens
agtttggttccaggaaatctaaatagttttgtggctgtggatgccagttacagagtcatcatgtaaaaagatgaagagtacagtgggagggtactgataaagtccaggggaatgagagtacccactaaagcagatgtgagctctgtgtcagagtgcaaatatgggccctgagccttctgggcactaagagctcaagggtatgcatgagggagtggcttggagtggaagttgagctaggaccaaggaaaagagggactacactaaagtcttat

SEQ ID NO: 168520 - DNA, 394 bp, Homo sapiens
taatttacactaatctccaacacattctattatctgaccaactacagctgtttaggaagttgtttcccaaacatggagctgtcaactgctattttttcacatgcttgtaatttcttttaattatcttcctctcttgactcaccggcttgacccatatagacatttaagcttgtggttcttgctttatttagagcagtagtttttcagattgtgggttgtgatctatttgtgtgatccgttagtgaataaaacaaaattttgtggagcataatcagcattccaagggaaaggaataaagaaaaagtagtatagaccattgtttctcagttgtgggccattttgcctgccctgccctgaggacatttggacatttgcagtgttggagatatttttg

SEQ ID NO: 168521 - DNA, 305 bp, Homo sapiens
acatattttaaaaagaaatcttgtatcataaatgaagcttaaatttatatttttaaaaaacattctgttttaaatgtttctctcttcccttcctttggaaaatgctgaccttggaaacaaaaatcagatgcagccacccaccctactgctgcccaagccaatcctaagtaaatcagttggcttgctgggaagtttccatgaccgaaaagaaaacagaattcacttcaatttcatcatcaaagtccacgaaagcttgcaaagcacttccatatccttctcaatccatcctcatagtctcctgaatt

SEQ ID NO: 168522 - DNA, 428 bp, Homo sapiens
agggtctcagcttactgatctgtaaataaggagggtgaggcccatcgcctctagctgtccatcctcgtgtccatggggctcctgcagggtgcctgcaaaacctgaacccttccgacaaagatcagcccaggcaggtgaggaatcccaaatatagctgcagaggccggggtgaccagccaaggggagggaagggaagactcagggtgaaaaagcagccttccagtgtctgcagggctcttagtggaaagaggggtgaaccttgttgaatgggggtaagtggggacgtgcgggccaagggtcaagactggaccgagcaatgcagttacagagattccagatgaaaacagcggtcagcttcgagcaaagttgtactacaataaaataggcatccatacaaggtaatgagctcactgtccccacaggtaacc

SEQ ID NO: 168523 - DNA, 364 bp, Homo sapiens
agacctagggcaggttgtggggaggcctccaaagctcaggctccatgactcagccaggatcccaagaagggcctggagatgcatattgtatcttgggagctctggttgagcttcagtgagaagggctctcaacagagaacttcttgttggtcagttaattcaagatgacgttgggaagcatcagttgccacttcccagcagaggagtagtttttattttcccagcaagatggaaccaggtttgaataccagtctccccatttcctagctgtgtgcctccatggacaagttacttaacctctctgttttcccatctgtacatcaaggacagctactcaaagaagggttgtgggtattaaataaga

SEQ ID NO: 168524 - DNA, 273 bp, Homo sapiens
cggcacgagggctggcagggctccaaggaccccacgttttccctcccaacacaatgtaggctcaataatacttccttctcagaaggaggctcccgggggtgagcagcggctgcagcagctccaaaactacccttggctacccttggtaaccccaacgcaggtccagctctatgccctctactgaaggctttgggggactggataggctagtcctgcccccacctccccaagtattacccctcctaagtcctgctaggggacgtattcagttca

SEQ ID NO: 168525 - DNA, 218 bp, Homo sapiens
tggcaatctgaggcacactccaaaccctaggtgtgcaatcttaggcacagcccaaactcaaacccaaggcctcaaggagataaaaaaggagtattccaggtcctgcacaaccaagttctgaaactgtgaaaacatccagtcacacctcacacctttagcaccaggcccagaaagggggtcagggtggtttcatggatgtgtgaccttgtgcagtctca

SEQ ID NO: 168526 - DNA, 855 bp, Homo sapiens
atctttacctgtattttatattcgtataacctctaaattttacaaattacccataatacatttcttatataattaaaaaaattctgagtacagaacaggaaatatgttcaatctttattccattagagttctacttggaaagtattaatatgtaaggtttttatttctccataagaaatagacctatatagtcaggcacagtgtctcatgcctgtaatcccagtgctttgggaggctgaggcttgaggattgcttgaggccaggagtttgagaccaacctgggcaacacagcaagacctggtctctacaaaaaaattcttaaaaaatttagctgggtgtggtggcatgctcctgtggtcctacctacttaggaggctaaggtaggaggattcccttgagcccaggagttcgaggttacagtgacctatgattgtgccactgcactccagcctgagtgagagagtgagacattgtctccaaaaaaaaaaaaaaaaaaaaaaaaaaaagaaaagaaagataaatagatctatgtctagttaattcgaggagatggtacacatttttagagcacatgagaacgaagtttatacttttctgattttctgggtttccttgatgattttttggcaaatccttgtctgtttagctgtctggcatatgtatgactgtggttgggcttctttgtactcaaccaatgaatgcataccaactgtaacacctgaaggtaggatcatgaataaatactctgtgatttggggttagtatagttttggttgttttcccttctcctgagatttcagaaataaaagattcctattcctgtgatttttttggcacacagtaagacatatttga

SEQ ID NO: 168527 - DNA, 217 bp, Homo sapiens
tatcagcctggagacaccatggacagagcttccacctctgtccttactgaaatccagcactctgagttatttttgccactgctttgtttctatctctgtcctctatgaggttattttttcccagaactttaatgaatcataattgttggtggctgctacatctatatgagctatgcctgatgttcctgcatatcttgttaagtttcttactaagaca

SEQ ID NO: 168528 - DNA, 425 bp, Homo sapiens
agcctgagcaaggtaagactccacctctacaaaaataaaaaacaaactaaaaacctggcatttttagaatgcttaagtcattcaaatattaaagaaaattgttaggccaggcgcggtggctcacacctataatcccagcactttgggaggccaaggcaggcagatcacctgaggtcaggagttcgagactagcttgaccaacatggtgaaacccagtctgtactaaaaatgcaaaaattagccaggcatggtggcacacacctgtaatctcagctactcaggaggctgaggcacgagaatcacttgaaccagggagatggaggttgcagtgagctgagatcgcactccagcctgggtgacagagtgagattctgtctcaaaagcaaactaacaaagaaaaacaatacttcctggggtttcggtgt

SEQ ID NO: 168529 - DNA, 484 bp, Homo sapiens
ggaagaggcatgttgggctgagttttagcggggggtcctgtataccagcggtcagcttgttctacctccagcccaaggacccctgtcttgggctgtttggccccaggcaagccagtcagtgtttctggaagctctccgagacagacatttactgcctttctccattcaccgcgtttctgccacttggccctcagagggaactggagagggatgtttccacctttcactcaccacacctctatttacagagtgacagaattgaaacagcctggccagcactggcttgggagctggggatggttaaaagtcaggaatcagcaaggttagccaggcctcccaagggctgagggcctcactccacttccctctggctctgctagaaaatgcttgtggtagagggctctgcccagcccaattctggccccttttgaatcttgttcagtcttcttcagggtgtgtcccttggctgcccattttgagagga

SEQ ID NO: 168530 - DNA, 415 bp, Homo sapiens
ctcctgcatctttatatttccttttcacatctgtttctctcattcccccatcttcaccctgtttcctgttcctttctctcttccaaaaattctactttactgtcaattgaacaaaaatattgaacatctacctagatccagatggcctaggttcaaatcctggcttcactacctgtgaactatatgacctttgcaagctctgtaacctctctgggccttagagaccttatctataaaatggagattacgacaacagtatgactgctaaatgtgaaatgtgtagcatcgttgttggcatgtagcaaaggctacataagtgttagctgttactatatataaacattgttatcatcacattacatcaacatgggtcagagaaaaggcttgccctcagagatggttgcaggtggagagt

SEQ ID NO: 168531 - DNA, 956 bp, Homo sapiens
taggagaggaatcaggattgagccttgaacacatatggccaattggagaaggatgagcctgcccaggagattattaagatgtgaccagagaggtggaacaaagactaagtgtggtgtcatagaagtaagtaaaagagtggtcagcagtgtctgttggctactgagaagccagttacagtggaacttagatttggcaacatggacatcattcactaaccttagggggagctgtcagtgggaagcttgaaacatgccaattagatggggttgagaaatgcaaggaaatggagacagctagcgtaggcagcttttaaaggtatttggggagagagacccagggtgagtctctttaaatggtaaagaaaacttaccttattcaagagttccagaagaaggtggcactagggttgtatattcagtggctcaacaatgtcatcagagacttagatttttccagcctcagtgtgtgacttggtcctcaggctgtcccctcagaatgtaggatggctgctgtaattcagacatctttagcagaagaaggacaactttgtcttatgtcctttaaaaaaaatcttaatacacatgctgaaaagtatacaagtgttaagtgcagctggaattttcagaagtcaaacaactgtaaccagcatgcagatcacaaccccagtaccccagaagttcctcttagtcatgaccctcctcctagtcatgatccatctcctcccccaggagaactaccatcctggcttccagtggttaattttgcctattttagtacaatgtaatgaaataatatactatgtgttcttttatgtttggttttcagcatcgtttttgagatccatattgttgcatgtagttgtaaagtgttcatctattgcatgaatataccacattttatccattctattgttgatgggcatttgggtagcttctcctatttggcttttacaggt

SEQ ID NO: 168532 - DNA, 519 bp, Homo sapiens
caggctgacacagttggctcatccctgtgatcccagcactttgggagactgagatgggtggatcgcttgacctcaggagttcaagaccagcctgggcaacatgacaaacctcatctctacaaaaaataaaaaaaatgtaaaatttaaaaaaacccctcagaatcctcaaatggtataaataatcccctctcaatatactctttggctttaaaagcttaaaactgatagttatattttggccattgcttaagtagctaattttgggagtggaaggtatcttctttccataaaagaaaaccagcaaacaacaatgtgagctgaattaatttttgtttataatgtaatttctctgtttgtttggagggctttttctgtgggtgcttcatagatttagccatgatgatttccattttagatttatgaactgtccgggaaggaattctgttttaatttgtcacaacaccacagtcccttgaaggcatggattcttaatgcatctgatgaggagaatgtaatttt

SEQ ID NO: 168533 - DNA, 360 bp, Homo sapiens
cttaaggcttgttcaatttcatttcttgttatcactcagtagtcaaggagaaggaagcatcaaatgtttaagaaaaaaatactaaagaacttacattcaacatatatcgacaaacttttaaaaaactgaattggaaagttgccataaccagtttcagtgaaggaaaacctcaagtcagcccccataataatggtgttttccaggaaattaggtttagggtaagtggtctgttagaaattctgaaaacatttttcctctttttaaaaaacaggtcacagtaaaaattaatggcttccttcaagtacccagtacactcctatatacatgtaggtagaccataaattaccagtgagctccaat

SEQ ID NO: 168534 - DNA, 622 bp, Homo sapiens
gaaaaaatggatttgatgagctagaagttagagagccccattccaagtttgataggcaggaaaaggtacatgaaagtactgtttcagaacaacaccgctacaagataggaagagagatgagagaaagggaacattgaaaagctcaaagagtgatgatgagaaacaacccagatgttgataaaaagtgagacctgaaaacaaattgattaaaggagacaaaagaaaaggaagaataaaagagctcaatatcttgagcaacagttgcctaattgtcgaaattaaattgtctggaaggaaattagtaattagaaacttggttctcatggtatgttgtatttctacacaaattagcccaagaattcgtaatatgaaaaatatcccagttagaactaatgtatgatttattaatggggtggtttgctgaatttttatttccaaatgaatgtttgctatttagagtagatgctaccttaatttaccagatgcagttctacaattagatgcatatggttagcagaggagtagaaactttgtcatggttctttatctgagatagtatgggactatggatgctggaaagctgcacttttctctgttcaaatcttatcaatagattaaactg

SEQ ID NO: 168535 - DNA, 311 bp, Homo sapiens
tagctcttcaaaacacagcccaacactgagagaaagcaaaatcagttttcaagtgctgacaataattgttataaagctcccgcaccaaagctgatgtatggttcttaactgttttccagccttccgtgtagatcagacaccatcagctgggagcaagatgagtagagattgttagggctgcatagtggaggcagcagtcagcaaagtccagcatcacacctgggctgggtatagttgctctttagagaggctagagttaccaaggcaaagatgaagtatgtttaggagtctctgttttaagaagataggga

SEQ ID NO: 168536 - DNA, 494 bp, Homo sapiens
ccacacacatgctgaggtggaggccaaccctgaacacatgcgctgcttctttaggaatgtaactatgaagtaaaaggaaacagtaaggaaggtgaactggaactctggggaaactgaaaaggtcatcaataggccttcaaaatatttgtgtgtaataagtagacacaagaggctggaggaagatgatcattcctagaataattatgcttactgggtgacaatatacagaagcaacaattacaataaaatgaaacagtttaatggactaggaagcagaagtctgagaataaaggaattaggttaatgagattaagcagagatggcattccacaggaggtgacttttgagttgaatttttaaaagatagctttatgtgttttatgaactgactgagggcagtcagaagaaggcattctaaatagagggaactggtatgtgctgaaacttagaagcaggaatgtacaagcaatatataaggaatttcaagcaagtac

SEQ ID NO: 168537 - DNA, 166 bp, Homo sapiens
cccaaaccagcagcatcatcatcaactgggaatttgttaaaaatgcaaatgctcaggtctcccctcagacctgctcaaacagaaatccgcccagtgggatccaatagtctgtgtttaacaaggcttccaggcaaggctgacacactcaaatatgaaaatcactgaa

SEQ ID NO: 168538 - DNA, 126 bp, Homo sapiens
taacaaaaaaggcagatccactggggattcagacccttcaggaataaaaatttgggtcactccaattggctaaagaaccttacacatactggctgggtgcagaggctaatgcctataatcccagca

SEQ ID NO: 168539 - DNA, 478 bp, Homo sapiens
ttaaatggttgcaggcaattaaaaaacactgaagatgtttgaatggaatctgaagaaagagtaatgagcaacaaatccctgcccaaaccttgaactaaggtatatggaggcagaaatggcattttgggaaaattgttgaaaagcaaaatgtcagaaaaattccgatgctcatgttccttcatgataattcaatctctgtttatttctgacttgattttatcaggtcagcttggcattatggaagaagtgaaggtattggagcaaaaaaaaaaatctaagtttaaattctaatttttttaaatttttaagtttttcattttaaaattctgattctgattgtgaaggtcagtttcatccataaaatggcagttgtaattaaaattcatttttatgggttgtaaggattactaattattagtaatatacataaaatatacagcaggaaacaggtattcataaaatcttaatccctttgctt

SEQ ID NO: 168540 - DNA, 236 bp, Homo sapiens
cagccatctttgaccagtttatagtttctttgctgtctttatgctgcttttgataaatggaatttttaatttaatggtagttgaatttacctatcttttatggtttgtgctttttgggtccttttctcctccaaggcataaaatattcttgtacatcgtcttctaaatggttatgtaggtttctaattcatttgcaattaattctgggaattgatgcgaggcaaaggtccaatttc

SEQ ID NO: 168541 - DNA, 295 bp, Homo sapiens
gggagtccttgcagtgtgtaaacgtaatgctagtaaaaagttgtgtgatctttagcttcaaaggagttaaggacttttaattgtagcctatatatcaaggtggttttgaaatctccatgatgctgctggttgtctcctttcaaaaggagctgtcttagagtgtctaggagagtaagaagagttaacttctgtttttaattctgccaaacttgtttagaaatgggtgtgctatttaacctcactgagatggggtttctaaattactttgaagtgttgtggtcaaaggaatggtgtt

SEQ ID NO: 168542 - DNA, 235 bp, Homo sapiens
ctagtcctgaacaactttcctagttggaccacagctgctaaccaacaaaggcccagatgtacttaggtgttaaattatctccaggctcaggatttatggatcttggaaaaacctcattgggattgggttcagactgatttaaccttgagcttgctgggggattctgttcccccttggcagctgaacctcacgctggtcctagtacaactgaggatccatgtggctatgccggaaa

SEQ ID NO: 168543 - DNA, 206 bp, Homo sapiens
ttctcagtgaactgcagggaggatggctttgaacaggaggcaaagcaggaaaggctgtgggcctcccataccctgcttcagtcagaacagctcccctcttccttgctatatttcctccaagaaaaagcttgtgctgtttctaaaaataagatccaaaaaacaacataagtgataatattgtaggcctgatattatattcagagcta

SEQ ID NO: 168544 - DNA, 454 bp, Homo sapiens
aatcccagctgtagcgttagaacatcgatgaaattctccactaatctactcctctccacctgaactgaaaaaggtcttctttcttttttctcagtgctagtgttctattaatagaagtagagacatactttaatatggagataaactttaataatagaaataaaaacatttatttggtcatgtcataatgaccaagacaaagttaactctgattccacagtatattttaagccaaaatatacttgctttctgaaccataaacatggctaaaatgacctttctttttttccaaagaagagaaaatcctaacaaatagtctataagaaaatatctaaaacactttgtatgaaacttgctttactttttcttaatctccaagattagataatactggaagaatattagatctttgaattcaagtcacactgaaataggcatggcaaaatgagtattt

SEQ ID NO: 168545 - DNA, 248 bp, Homo sapiens
catatatttggtctttcggtttagtcatcttggtgctccagagctgtatacccactgcctacttgacattcttcttacatgtctcaaaggcaccttggattccacgttttccaatttagtgtgtgatcttccctcctaaactcaaggctttctagtgttccctacctcattctgtggcaccattctccatccattcagtcgatgcgagtcaggagagtcgatgaatatgatagtgaaatggatttggg

SEQ ID NO: 168546 - DNA, 287 bp, Homo sapiens
ctttaatgaaattaggctcctgtctcatgagcatgctctcttccttcctggttcatgtttttgttagtgacaccccttctctgattaacctttcccttttaacagcaattgtttaaatcttgtccatcccttaaactttaaagccaaatctaaagtccacatccttttaagtaccctagctagaaggaatgtctcttgatctctcagtaggactccagtaacactttgttccttttagattgcaattatagagatctatcttgcattatagttgtgtggcattactg

SEQ ID NO: 168547 - DNA, 282 bp, Homo sapiens
ctttacataattacatggtctttacttttacatgactggcagtgtagtagggttgtttacgtgaacatcaccacagacacgtgagtaatgtgttggaatgtcacaaggcaataggaatttttcagctccattataatcttacaggaccaccgtcatatatgtgatctctgtcattgaagaaaatgtccttatgtagtacgtgactgtatatgaaagtttattatactattcttacagcttttttctaattttgagtttttctaataaaaagtttaaaatata

SEQ ID NO: 168548 - DNA, 583 bp, Homo sapiens
aatcatgcctctggtatgcaaagtgtcttgactaagagccttgtgccttctagctccaacttgacaacagaaaaggtactcttggtatgcaaaataagagcctaaagcatctgtggctgtaatttggtattcactttctataatcagtaagaccactgattaaagaccatgcagtcgactaccaatagctctaaacaaacatcctattgcagcatatacatagcaaatgccatctctgaccccggaagtttggttgtccaggtaacctgggcagggaaaggtctgagttcaaggtgaaaagtcttccctactgcaggatagaaacactatcatcaataataaatattcacagacctgtagtccctttctgctttggtggttacacagctcccaggtgaactggaagcctaaataacctgagccctaagagcaagcacttttggtccacaggtgtcatagtctctgcttctgcgcccaccctttgttccaccaccattgtagtgagatggtctagtgaagtcatctctgtctggcccaatccaaggctctctcttttgtccttcaccttattgacttctcagca

SEQ ID NO: 168549 - DNA, 316 bp, Homo sapiens
gtatagtgcctaaaataggacctggcattgaacagtcactcaatacatgttagttttcaactccactttccaagtacaatttctcttcctcgttcagttactcaacaatcatttcttcaaaacagtctgtgccaggcacatactgggcgctaagatataatagcaaggctgataagaacctgctttcatggtatagcaggagaaacagatattttacaaataactaaacttaatatttatgttcagttgtgataaacactgtgaagactgacctagggagatgttgaaaacagatttttaaaacttttaaactttt

SEQ ID NO: 168550 - DNA, 576 bp, Homo sapiens
ttaaacatctgggtttcttagctgaagttcattttacataaatatgtaattctatctcctctttgcttgtggagggtgtagcccaggaagctgagttacttgattcatccttttggaattgtaacagaacaactttagtaccctgaagcctcctcttgtcagagtctcagtaaatatgcgaggctgctgttgaagttggaacctgtatctgctctattagcagaaatttgacttcacattttctttatatagtttaattgaacaccttcttgttcatgttttttgtttatcattttaatgaataaaaatagttccatagctaataagtagggtttactaattaaaatgaacacagtggaaacacacttgtttctgactgtggagactagggcaagtggcttctgttttctgagccttggttgccccatctgtaagatggggattctgaggcttatgagacatgatctctgtaaataaagagcttggcacagggcctggccatttattgagtgcttactatttgccaagcattttacaaagttattttaggtgaggtatttaagtcattgacctggg

SEQ ID NO: 168551 - DNA, 432 bp, Homo sapiens
agatttaccataattcttaaggtccttggatattcagaatggctaatgagcagtagcttcaacttaaagtcatcagctacagtagcccctaatgagaggcagcctgtcctttgaagccaagtattgatttttctacagctataaaagcctagatggcattttcttccaataaactattttgtctacactaaaatgtttactgtagccacctttatcaattatcttagctagatctggataacttgctacagtttttccatcagcacttgctgcttcaccttgcacttttatgttttggagatggcttctttccttaaacctcatgaaccaacctctgctggcttcaaacttttcttctgcagctttctcacctctttcagcctccaaagaattgaatagagttactacggccttgctagattaggctttggc

SEQ ID NO: 168552 - DNA, 261 bp, Homo sapiens
tgtcatgcaaaaatgataaaaccttgatatcttcattcagtttatgtaaaactgataaacatggaaacagttcatattttgagaaaactgagtcttcccattcaaggaacccacctcgcgcttcccagtgtccctctaagaagctccagtaaagaacctgtctacctaggtggattcggatgtaaaaccgacacagggttttatctgagaactcttcgcctactgaaaaaggctcatggtatttttgacaggggaatgagt

SEQ ID NO: 168553 - DNA, 301 bp, Homo sapiens
cgatgtccaggaccttattaatttcccccatcaaaatcttagaacatgaataacatgaagcctttccaaatatagaataatcagacatgtctacagcacaaattattggaatctgcccatgttttttagattcccttcttcaatttatgaggggatattattttcttagccattattttaatagcatcaaagttatttattaggtgaaaagtgatctattcatgtatcagatattcaatttgctagctgcttctgttatggtggatgataccactaacatctaccacacactgacaaagtg

SEQ ID NO: 168554 - DNA, 274 bp, Homo sapiens
tgactgcagtagagcttcttagtgagcagtctatgttggagtgtactttcagagaagctcgtggtgggggaaatctggaatttgtctaaatatttcatttctttgataaattacattaaaaaatcaatgagagtatctatttggtgaaatcattttcctccatgtgaccaaatgagaaatttagtgaaagatttaaaatcatttctcagactttttccacattagtcgggaagcaaaccccttttttaaggcaatgtcagttattaagctttag

SEQ ID NO: 168555 - DNA, 136 bp, Homo sapiens
gtgactttcttctctgatgtccagactgatttgcagattgcaaagatccactcttataatagaaagagatgccattagattagaaaaaaagccacttatcacaggaattacgtgctaacacagtggttcaccttaa

SEQ ID NO: 168556 - DNA, 564 bp, Homo sapiens
ttgtagtacctcattcagtatcagttctctcaatcatctctcaaatagcaattttccactggaaaagaaaagaaatgaagaaacagggttcccagatagtgtaactttgtaaaacaccatacaggacaaagtatatttaaaaaactctcccaataccagtccaagctaagggcaacttttaagtctgagggcaattctacaggttccaaggacagaaggaaagacacatgaaagtaaatcccaacttttctcctctcagatgcgaccaggtacacctgcattgcaggcctcagcacggcaccggacgcagcccagagtgccttcacccaggccagctccccttacccccaaagaggcagtgagcctcagagagggcaagtggctcgcccactgctacacggcttcgaggtggtagagctgactccaaagctggtatttaatggattcactgacgtcttcatccactataggactagccttgctgaacaaaacttcataataaagaactctgtgaaaaaaacatggatttggacataacaaaccgactttcctcctctacccagc

SEQ ID NO: 168557 - DNA, 216 bp, Homo sapiens
ccatttccggccccgcccctttccctgccgctgtcacgcctcttttctgccctgccacaccccattcccggccccgaccctttccctgccgctgtcacgcctcttttctgccctgccacaccccattcccggccccgcccctttccctgccgctgtcacgcctcttttctgccctgccacaccccattcccggccccgcccctttccctgccgctg

SEQ ID NO: 168558 - DNA, 375 bp, Homo sapiens
tctcaggttagcccactctcctgtcccaggggctcatccagcctgccccttccttgacccttgacaccatggtgtcagcccctcctgctagccccatgttcttggtgacaagccagtaaggagctttgtcacacccatgatcccctcagatccttactagcccatatctcagcagtcagaagtgaagcctgaggcccagaggaagcaaatgatttgcccaagaccaccagccagtcagctaagagcggaggttcgagcatccgttcctgaagctcagtccaggcattttccgctgtgcttgtgcctattctcccaccatcaaaacctgttcctaggccgggcatggtgactcatgcctgtaagcctgaggcagat

SEQ ID NO: 168559 - DNA, 672 bp, Homo sapiens
cgggttcaagcgattctcctgcctcagcctcccgagtagctgggactacaggcgtgcgccacccacgcccagctaatttttttaatttttagtagagacggggtttcaccatgttggccaggatggtctcgatctcttgacctcgtgatccaccctcctcggcctcccaaagtgctgggattacaggcgtgagccacttctcctggccgagaaataatttttaaataaaattcaatgaaaaatatttttcccccaagtcatttctccaaagggaacccgtcgcgtgcctgggatggggaaagaaaggtcaccgtgaacatcctcgaccaaaacggctttgtcccctattccccaccttttttttcctgcgtgattcctctacaagaatctttgagaacctcgcatgttttaaagctatctaaaatatttttattttcaattaaaatagttgcaaagatacaaataccaacgtggaactttttaaaaatcaaaattctcacatcagtctcaaggtgccttttggaatatcaatatgatagtataatcaattcataaaatacatgaccaaatttttctttgtcaatgcgatgtttcagatgatttttttcctcctgaatgcctatttccattctccatttgccttacaatttcaccctaccataatatatctat

SEQ ID NO: 168560 - DNA, 506 bp, Homo sapiens
gggcattcagatccaacataattactgagcacctgtcctggcacatttcatgctttccctgaaccacgtgcataagtgttattatcattctcattatgcaggccatagatcgaggctcagacacatgtaggaactagcccagagtttcaaagctactttaagtggacaagtgtggactctcaacacgtctcctgacagaggctgtgttaatccatgactagaagatgggctatgtgtgtgacctgctcttcgtttagttaaaaatggcatacttgattcccagcttatgtataggctgggatgtgaacttccagtggaatatttctgttgctgaaatttgtcaccacctttctaaactggtgacagaatttttttgggtcatacacagactcattgcaagtaaggcaaacctactcttaaagtgacctaaacaatgaaagtgctgaaagtaaggataatcatgttcttgaagacagctgtgtgaatgggttaggagttttatagaa

SEQ ID NO: 168561 - DNA, 523 bp, Homo sapiens
atccttaaatgcttctaacactgaaaatgagatgaatatcacaactagaatggttatcacattatacataagtgggttgcaaaaactgattttattatacacgtatactttttaatttacatttggattcaaactttttttattatacactcctggcatatgtaacattcagatagttctctttctagcactatgataatctcatcagatcccaagagttggggaggaggacttgatttcagactatccagtttgcaaatccacatcacatatgcctttacgaattattttgaataggtagtatgcattacacaaacactatacagtgaagtctttttcaacctctctcagttaattatatcttctcaaaactattctacgcaaacacaaagacatatgtactatatgtttttgtttttgttttgagacagagtctcactctgtcacctaggcagagtgcggcagtgcgatctcagctcactgcaacctctgcctcctgagttcaagcaattctcctgcctca

SEQ ID NO: 168562 - DNA, 576 bp, Homo sapiens
caccatctgtcaccctgaacaagcagagactcctgtgtctgagatgccgtggacccccgctcttccagaggtacctccagctccctttctatgctaataccagaaaattctccccataccctgcagggataggacggccctccttttgagtttccggggagttcttcctcagagaatgagatctttgctcattcttgcctggtggtggtgagggttacagcggtgtcatgcttggaactctgtcagcttgtcacacttgactcaacaaagatggagtcagggttgccctgagccaaggaggagcgcagtcaggaacacgtggtgggtgatgattggccacctcagcccagcagtgactcgtgaaaaaggcacaaagcagacaatagccaccacgcatctcttgtggtacaaactgccataattctagtccccactgactggtcaaggggcaaggattctgtcttccatgagcagacgggccccgccaccctgcagcagctcccacactgggccagcatcctcctctgaggccacagtccctccgcaggccaggccagacagagtcagatcttctgt

SEQ ID NO: 168563 - DNA, 623 bp, Homo sapiens
ctcaaacaaacaaacaaacaaaaaaagggatgccacttaaagccttctacagtcaaatctcagtcttcccatccttaccaccagctctcctgaatcccagtaatgagacattgctctagccaaacgctcatactgtgtatcttaatataagtgcttatgaatttttcttcatggagtagctcttcctccttgggaagcagcagagcttagaggttaaaaatgcaaggtttggagtcaaacttgcaaggttgcctgggtttaaatcctggatctcttacttggtagagtagtttatttaactttctcgtgcttcagttttcccatctgtaaaatgtgaataatagtacagtttgtctcttagggatgctgtgaggattaaataggctaatatatgtaaagcattataaaggaacatgaaaatgctctaaaaatcggtgagctaagtatccatctcaagaagttttaaaagaagagcaaaataagcccaagaaaggaaggatataataaaataagagcagaaactaattaaatttaaaacaaatacacagtgaggtactttcaatgtcaaattcattgtaagagagaatagaatagtgtttgccagggactggggtagggggcag

SEQ ID NO: 168564 - DNA, 464 bp, Homo sapiens
ttaattgaagggtttttattgtaattgattcttgcaaggaactttgataaatggtctaatttaatatataagatgtcttaggatatatctatcaagggctattgctttctttggataggctaactttgattttactattgtttgtttcttattgcatgttattcagtatagtgatcctgtaggatacactttgaaaaagtatttggtgatttatgaagttgggatactgcatactctatgtatgaaaaataggggtgcacattagcactttagggctttagtagtcctacatgaaagtaacgttttaaattttgtgttaaaaccagtgtttctatacttaatttgattacagagaattttaaaaaatgtatataatgcatattaacattcatgagaagtagtattctatggctgtaatttgaacaatgttatgtagattttcttcagattaaaatcttgatcca

SEQ ID NO: 168565 - DNA, 445 bp, Homo sapiens
gacctgcaggtccttgagtggggtagagccccagagaatatggtgtcctgatttgccaaagagtcacaggcagcatgtcttgctggccatgggccactcgcacgggtatgggaagctggcatggcagggcctcttcgggtggggtgtctctcccagggcagtgctcccatctgcccgggaagccctggctgaggtctcagaggagagacaggatgctccgaggaacttgcttgccttcagaatccctatatcttgccaatgcttccctttcctcctccctttctcctcgcccaggcttagtgtgctggtctcctgctccgtgaaaagtgctcccagggaagacctgggcgatgggaacaatccccagggcctggaaggaagctcacgttagggcaaaggaggggggtgatgttggggatggcagcccagacctgagcaagccagg

SEQ ID NO: 168566 - DNA, 443 bp, Homo sapiens
ttcactttgagtataaaaatggaaataacagcacctacctcctagagttatggtgaggattaaatgagttaattcacattcatcattaggacagtgtatggcatatagcatatgctcagtaagtatagtcagattacgatctgctgagtaataagcagtttacatccattatctccttaaaacctcagaaacttctgaggtaggtaaatactattatgaagaggcttaataacttgaagagttacaataaatagccgggcgcagtggctctcgcctgtaatcctagcactttgggaggccgaggcaggccggatcacgaggtcaggagattgagaccatcctggctaacacggtgaaaccccatctctactaaaaatacaaaaaaaattagctgggcatggtggcgggcacttgtagtctcagctacttggggggctgaggca

SEQ ID NO: 168567 - DNA, 199 bp, Homo sapiens
ccagcaaggttcatgtaatgtggtcattatttgtgggcctgtctttgaaagcagcttataaatatacctccagatgatatttcagacaacaaagagtgctcagttgatctggtgacacacaaaggctcccaagttgttacacattaatgagaaagtggctgaggaatataccagagccctaggccacagtgtcaggtag

SEQ ID NO: 168568 - DNA, 409 bp, Homo sapiens
atttggtacatgggtgagaactgcaagtcctctgaaacccatagcattttgcttttaccacttttatggaattgaatccatcaagttctcctatgttttaagtgtatctgggcacaggtacaacttcattggcatcaccacattccctatagagtcatacctaactggtctcttgtatctgacatgtgttcaacaaatttggttggggacatggtttcatgaaaatataaatgttggattatgcaggaacttaactcttatgctttttttttaagtagcatgatgtcaaactaactgtttgaagaacttctccatcccctgtaagactgtaacagtgttatattgaaaaagagttctggaaagaaccgaccttaacgtccctgtcttaaaaagccatgtcaatctagga

SEQ ID NO: 168569 - DNA, 144 bp, Homo sapiens
tagccaggacaagagagtgaagaaaggaaaaggaatcaaaagaagaaatactcaaaccccacaaaaaaaaatgaatgaaggccacgatgtggaaatgagcagtggataaggaagaacaaacagtacagcatggggagcaaagga

SEQ ID NO: 168570 - DNA, 466 bp, Homo sapiens
acacacacacacacaccacacaggctgtcacgtgtcctcagcacaaagtgccttgagaaaggccattgctggccccacacttatcctgactgtgatcttgctgtgatcagcacatcccatcagtgtggcaacaggtgtggccagagtgggaaccaggccttttcttcagatttgctctttgttcctgaatagccaccgtcagaacagacaccctcctaggagtcacttgattaaaaatttccttttggatatttaggttgatgttttatccatcggttaaagtataaatgtatatttattataaaagtgtaattatggctctaattaatgattatggtgaattttactaactatagctatgaaaatattccaatagataaaaacagtgctaaaaatgtacagttaatccaagagtggtaactttaagtcttgtaatttttgatctaataaatcttcataaaatata

SEQ ID NO: 168571 - DNA, 579 bp, Homo sapiens
tcaatccaatcaagttgacactcagtattaaccatcatgcccaccatggtgaaggcatgcgggggtggctggtgttagactaattggagccttggaggatagtcgaggaaacggttcctgaacggtgtgtggatgagaatgttggagcagggtgctaaggaggcacagaggagaggcagagggtatggggttggagtggggagagccttaaggaggtgacatggaaggagagacctgaaagatgggtgaggccagtgcttctggaagtgtggttcctggaccagcagcatcagcagcatctgggaactccgggtgaatgtgatgcgcacgctcgagtataagaaccactgcattagaaaacaggtgacagtgccttgcggaggagcggtggctggtgtggaaagtactctaacagagcagagggaacacatacccagaggcctgcagcaggcatatttgaggcttgatcaggacacagccacccacacccactggttacaaattatctgtggttgctttcagcctgcagaggtagagctgagtaatggccacagaggtgtatggcccgcaaagccacac

SEQ ID NO: 168572 - DNA, 270 bp, Homo sapiens
ctcatttagtccatagcagaaatactgttattccagtgtgtcactaagaaagtaaggaacagagaggttaagtaacttggttatatagctgagaagcagtgaagccaaaattcaaacgaggcaatctggctgcaaagcctatgaattcaatcatgacataggaatataaattctcaaaatcacatagatgtacatgcctgcacatttcgataatgttacatataaataaacacctattactagacatatgcctaggcctttgtatacagt

SEQ ID NO: 168573 - DNA, 146 bp, Homo sapiens
ttttgggattacaggcatgagccactacgcctggcctctcttattaaatgttaatgccacagaaaacagaaccttttggccatgaaaaagcagattgtgctggaaagcattcattcatttattcaatatcctgatggcttattatg

SEQ ID NO: 168574 - DNA, 487 bp, Homo sapiens
ctgggctttctcgtaatatttctgagttggtgagcatgaagggagaaaaaagccagtccaagcttgtgtttcagactctgtaatcaggaaaaggcaaaaaaaaaaaaaaaaaaaaggtaaagacacagtatctttcccttccttctcaagcagtaaacactgggggacacttctagtgagtgcatctgacatcaatttctattcttcagcatcggaatgtcaatgaagtagaacaggggatgatgatttagcacagaaataattcaaagaaaatgatcaaggtgttatcagtctactgacactttatgcattttttgctctagagcatacatttgatttttttaaattatagatctcaggtatctggtgaattttgcttggtcctctgtttctgaacataccaatcaaaattattttaaagtctttgtctgaaaactttaatttctgtattacctgcaaatctacttttattgggggtaccgagctc

SEQ ID NO: 168575 - DNA, 600 bp, Homo sapiens
gttcactattcattcttctgaaatatctactgtgatagcagtctcctccagtgtgttttcataacaggtttatttacctgctttattacatgactggtaatatttgattggatgttcgacattgtggaatctatgtcattgacacctgggcatttttgtactttgaattgcaaaaaactactttaaacttcatatggaaccaaaaaagagcccgcatagccaagtcaatcctaagccaaaagaacaaagctggaggcatcacactacctgacttcaaactatactacaaggctacagtaaccaaaacagcatgctactggtaccaaaacagagatatagaccaatggaacagaacagagccctcagaaataatgccgcatatctacaactatctgatctttgacaaacctgagaaaaacaagcaatggggaaaggattccctatttaataaatggtgctgggaaaactggctagccatatgtagaaagctgaaactggatcccttccttacaccttatacaaaaatcaattcaagatggattaaagattcaaacgttagacctaaaaccataaaaaccgtagaagaaaacctaggcatta

SEQ ID NO: 168576 - DNA, 397 bp, Homo sapiens
gcgcccacgctgtcgcggcccagagcagcataatgctgcaggccgttgcaagagccgtcctgatggacggggaggtgggagacataggcggcagggtcggaggcgcgcacagtgttcgccacctccatacagcaggccagcgtctgccagggttcctccgcgcccatccaccactttcggcccgtcaagggttggtccgcggagtccaagatgtcatccatcacctcctccgcaaaggccaggcgcttccgcagaggctcccgcttcttcaaccccgtgaggttgaccaggtggatcttgagccaatccaggccgcgcgggccgagcgggcggccctgggcgaactccagcagggcccgcgccacgtcgctgcccaggtggttgaagtgcggcgggc

SEQ ID NO: 168577 - DNA, 241 bp, Homo sapiens
ggtcccattttttctccttgtctctctctcaataacttcttccatattaattattaacaaagtaaaattaatttttccccattataaaacacagagggaaaacggtctgaaaattaaaagggagcttcaaacaaaatcacacacaatcttgccaccatgacataaccattcttcgcattttgtgtaatttctttcacccctttttctaagtaattttgtatctcgccctcacaggagagtg

SEQ ID NO: 168578 - DNA, 115 bp, Homo sapiens
ggctggagctgccagggggcacttgactgccacttcgtagcaccttgtgctacctggttagtgtaatctgttaagtgctattatccttgccagttttacatatttttagttattt

SEQ ID NO: 168579 - DNA, 601 bp, Homo sapiens
ctcagagtctcgctcaaggcccacggcatgtactaccttggctactgctgctgatcatttagggcctaagcgctcttaagtcagcaggtgatgaatcctgacaggactgggtgcttctcttcaaggcagtgggctcacttctgacccaggatatgtctagaaatgtcatccagggaattagggcctggaatggggacctcaggactctctctggtgccctatcctcctgtgactgagctggtatccaagttataagtcaaagtcctctttactggtgcctttcctctcctcaagaagaaggaaagggccacttttgttgctgtgagctgtgctgcctggagttgggtaagcatggtgcatacgctcctttagcctccttggctggtgtgtcactaggtcatgtgtccccccaaatgtgctggctctgagcccagcacggcactaggacttgcctaggaattgttgtccttgtggcctagacagcctttcaagttaatttagaactgtgggggtaaagcttgtgaaagttccaggctactggtatgggcagttcccctgtggctagtgctggtctcaatgccttcttcatgggcatcacctg

SEQ ID NO: 168580 - DNA, 407 bp, Homo sapiens
ttttctaatcttcttagaagtttagatggccaaatatgaaggatggaactatataacattttgatttcttatagtgccttatggtgctttgtgtttgggaagtatttatttttattttttaaaaacaacttcaggccaggcatggttgctcacacctgtaatcccagcaagttgagaggccgaggcgggaggattgtttgagcccaggagttcaaaaccagtctttgcaacatggcaaaaccccacctctacaaaaattagttgggcatggtgtcatgcgcctgtagtcttagctacttgggggctgaggtgggaggatcacttgagcctgggaagtcaaaactgcagtgaactctaatcatgccactatcctccagcctgggtgaaagggtgagaccttgtctcaa

SEQ ID NO: 168581 - DNA, 1630 bp, Homo sapiens
tttgttgtttttgggagatgcgaaggctccccgaatgagaaagaatactcggaatcagcggtgaattgcagtgatctttcagagaaagcgcctgttcaactttgtcctctctcagagactcagagccttggggcactgagggatgccagttctgcctgttcatctggaacctggatctaaggagggaagaggcgttgcccctgctggcatagtcaggtaccagcccagccaggtattgaacgggctgagcttttcatgatggttcctgctgacctggaaacatcttaaatggaaggttagcttctatgagtcactgatactctttttattgctatttctaaatttccttggcttgaaaattacttctgctttgcagaaattatctgcttgcagctgtggataatttataacaatctctggtgaaacctcagaaaagagatatgcttttgtcttagatggatgtcagcagctgctgcagaacccggtgaaaacaccccccgggtagcacgaggctctgcgagccgtaactccgacaaacgcagaacttcttgaggctttcttcttctaaggagtatgacacagttaaaaaggaaaaaagaaccacaagcaaaacagttgccagtgaaataggagagggagctctttaaacaaggctggctgcagctggcctccgccgctcatctgcagggcgtgagcgcttggtccatgcagtgaagctcttccaacctgggtcaacgaaaacggagaagaaatggcccaagaaatagatctgagtgctctcaaggagttagaacgcgaggccattctccaggtcctgtaccgagaccaggcggttcaaaacacagaggaggagaggacacggaaactgaaaacacacctgcagcatctccggtggaaaggagcgaagaacacggactgggagcacaaagagaagtgctgtgcgcgctgccagcaggtgctggggttcctgctgcaccggggcgccgtgtgccggggctgcagccaccgcgtgtgtgcccagtgccgagtgttcctgagggggacccatgcctggaagtgcacggtgtgcttcgaggacaggaatgtcaaaataaaaactggagaatggttctatgaggaacgagccaagaaatttccaactggaggcaaacatgagacagttggagggcagctcttgcaatcttatcagaagctgagcaaaatttctgtggttcctcctactccacctcctgtcagcgagagccagtgcagccgcagtcctggcaggttacaggaatttggtcagtttagaggatttaataagtccgtggaaaatttgtttctgtctcttgctacccacgtgaaaaagctctccaaatcccagaatgatatgacttctgagaagcatcttctcgccacgggccccaggcagtgtgtgggacagacagagagacggagccagtctgacactgcggtcaacgtcaccaccaggaaggtcagtgcaccagatattctgaaacctctcaatcaagaggatcccaaatgctctactaaccctattttgaagcaacagaatctcccatccagtccggcacccagtaccatattctctggaggttttagacacgtgagtctcattccaatgctcttt

SEQ ID NO: 168582 - DNA, 1034 bp, Homo sapiens
tttgttgtttttgggagatgcgaaggctccccgaatgagaaagaatactcggaatcagcggtgaattgcagtgatctttcagagaaagcgcctgttcaactttgtcctctctcagagactcagagccttggggcactgagggatgccagttctgcctgttcatctggaacctggatctaaggagggaagaggcgttgcccctgctggcatagtcaggtaccagcccagccaggtattgaacgggctgagcttttcatgatggttcctgctgacctggaaacatcttaaatggaagggcgtgagcgcttggtccatgcagtgaagctcttccaacctgggtcaacgaaaacggagaagaaatggcccaagaaatagatctgagtgctctcaaggagttagaacgcgaggccattctccaggtcctgtaccgagaccaggcggttcaaaacacagaggaggagaggacacggaaactgaaaacacacctgcagcatctccggtggaaaggagcgaagaacacggactgggagcacaaagagaagtgctgtgcgcgctgccagcaggtgctggggttcctgctgcaccggggcgccgtgtgccggggctgcagccaccgcgtgtgtgcccagtgccgagtgttcctgagggggacccatgcctggaagtgcacggtgtgcttcgaggacaggaatgtcaaaataaaaactggagaatggttctatgaggaacgagccaagaaatttccaactggaggcaaacatgagacagttggagggcagctcttgcaatcttatcagaagctgagcaaaatttctgtggttcctcctactccacctcctgtcagcgagagccagtgcagccgcagtcctggcaggaaggtcagtgcaccagatattctgaaacctctcaatcaagaggatcccaaatgctctactaaccctattttgaagcaacagaatctcccatccagtccggcacccagtaccatattctctggaggttttagacacgtgagtctcattccaatgctcttt

SEQ ID NO: 168583 - DNA, 1489 bp, Homo sapiens
tttgttgtttttgggagatgcgaaggctccccgaatgagaaagaatactcggaatcagcggtgaattgcagtgatctttcagagaaagcgcctgttcaactttgtcctctctcagagactcagagccttggggcactgagggatgccagttctgcctgttcatctggaacctggatctaaggagggaagaggcgttgcccctgctggcatagtcaggtaccagcccagccaggtattgaacgggctgagcttttcatgatggttcctgctgacctggaaacatcttaaatggaagagatatgcttttgtcttagatggatgtcagcagctgctgcagaacccggtgaaaacaccccccgggtagcacgaggctctgcgagccgtaactccgacaaacgcagaacttcttgaggctttcttcttctaaggagtatgacacagttaaaaaggaaaaaagaaccacaagcaaaacagttgccagtgaaataggagagggagctctttaaacaaggctggctgcagctggcctccgccgctcatctgcagggcgtgagcgcttggtccatgcagtgaagctcttccaacctgggtcaacgaaaacggagaagaaatggcccaagaaatagatctgagtgctctcaaggagttagaacgcgaggccattctccaggtcctgtaccgagaccaggcggttcaaaacacagaggaggagaggacacggaaactgaaaacacacctgcagcatctccggtggaaaggagcgaagaacacggactgggagcacaaagagaagtgctgtgcgcgctgccagcaggtgctggggttcctgctgcaccggggcgccgtgtgccggggctgcagccaccgcgtgtgtgcccagtgccgagtgttcctgagggggacccatgcctggaagtgcacggtgtgcttcgaggacaggaatgtcaaaataaaaactggagaatggttctatgaggaacgagccaagaaatttccaactggaggcaaacatgagacagttggagggcagctcttgcaatcttatcagaagctgagcaaaatttctgtggttcctcctactccacctcctgtcagcgagagccagtgcagccgcagtcctggcaggttacaggaatttggtcagtttagaggatttaataagtccgtggaaaatttgtttctgtctcttgctacccacgtgaaaaagctctccaaatcccagaatgatatgacttctgagaagcatcttctcgccacgggccccaggcagtgtgtgggacagacagagagacggagccagtctgacactgcggtcaacgtcaccaccaggaaggtcagtgcaccagatattctgaaacctctcaatcaagaggatcccaaatgctctactaaccctattttgaagcaacagaatctcccatccagtccggcacccagtaccatattctctggaggttttagacacgtgagtctcattccaatgctcttt

SEQ ID NO: 168584 - DNA, 120 bp, Homo sapiens
gaatggctcttgttcagcaaggtcatccctgataaccctataaaagcagctccccttgcctcttccctatcacattctaccagttgccccgttactgttttcttcctagcttacagttct

SEQ ID NO: 168585 - DNA, 314 bp, Homo sapiens
ctggagacttgttttcctagactggatcttttaacatggtagttaactagggtataataggagtatgtcttatttttaaatttttctggcattctttagttcaacaaacgttttagtacctcctatgtgctgagttctttggatacaagggtggttaaacacagacttgtattattattattattattgttaatttatttttgggacagtcttgctctgtcacccaggctggagtgcagtggtgtgatcatggttcattgcagcgctgactgtgtatctcctccaactcttaaattattcacgtctcctatctg

SEQ ID NO: 168586 - DNA, 432 bp, Homo sapiens
agacactttggttgccacactaggtggggaggggggacactactggcatctggtgggtggaagccagggaagctgctaaacatcctttagggcacaggacagccccaacacaaagaatgatccagcccaaatgtcaatggatcgaggttgggaaacccggatcagagggcattggtgaagtcctctggggatctatagcagacgctggcctgttaatgcagggttgtgtcaccattactagtcacaggaatacaaagaccaaagccattgccactggtttccatggcagacaccaggctacaagtatctaaagaaactgcattctgctacagtacttgtttttgtgcctctccccgctagactgtgggggcagagaccacgacctacttgtgtctgtatctgcaccacctggcccagcatccgcaatacagg

SEQ ID NO: 168587 - DNA, 371 bp, Homo sapiens
cacccctcagtctcccgagtagctgggactacaggcatgcgccaccatgcccagctaatttttgcgttttttgtagagatgagatttcaccatgttgcccaggctgctctcaaattcctaggctaaagcgatcctcccacctcagcctcccaaatgctgggattacaggtataagccaccatgccaggccccaaatttacccttttatcaggagcccactgccaccatcactaactatacccttgataactaacctgctgcgcaataacagcattaatccatctacgacggcagagccctcataacatgatcacctcttaaaggtcccatctcccaacactgttgcactgggaatttttccaacacatgaa

SEQ ID NO: 168588 - DNA, 501 bp, Homo sapiens
gacatgggatttgtaaacttacagcatgtgcctcttttttctatctctcctctttgtagatggatcctacctggtatgctgtaaaacaccttaacaggctgtagaacttctctcatactttttgcttgtgattttgccttcaaacttcaacaggccccatgtgcttctgcctcaggagtgtttctttcagctttcctgccccatctccatctatatagccatagatagtcactgtttcataatcagtagacatggtttagcgtgtccacaaggttctctaatttctaagtctataccctcagacttcagcaggccctgtgaacctgtttcataggtggctagggagatgtagtggtactctcagctctcctctttcttccccagtgacagccaatagcttctaggtattcatggtaaatactggattacccatagggtttttctaaatttcaagccccaccttcagatattaggaagccacatactttacctttgtctcag

SEQ ID NO: 168589 - DNA, 358 bp, Homo sapiens
ttttcaggcaggtgtgatggctctaaatggaggttataggaaagttaagttttaaatccccaataattttcagggacagtgagtatttctcttacaacttaactttgaatgactttattattgtcccctagtccatagatgttttcatccaaagaagatagaggtctgtgatccaagaaatttgaagcagtgacttagagcagaaatagggatcatgatactttgaataatgcataaagaaggaaacctttctaaacaaaagggacacaaatgttgcttttttggcaacgggatgcatacggtctgtggaataccatttgcttcaggtccagggatgtagaaaactccccttggttta

SEQ ID NO: 168590 - DNA, 364 bp, Homo sapiens
ggctgggccagctgggtagcacagctttaagatgcgtcttggatgtggccgcccactccagattccacattttagcgggcaggacagcccttctgtgctgctgcagtggccagtaacattcccccagcagaggtccatgctggcgtctgtcgtgtgtctccctcctgctagacttcaccatccttaggaggagaaactgggccctcttggtaatcctatggcctggcaccaagcgggtgacccgtaaatgtgtgtggatgaactggacaaacagcccctcccattgatggagcagctgttagcttagcattaaaccagccggaaccctgccgcaatcgcaggcaggcgagcatggcccctttgg

SEQ ID NO: 168591 - DNA, 528 bp, Homo sapiens
aaagcactacaaatacacacttgcaaatagtactaaaagagtatttctaaactgctctatcaaaaggaaggttcaactctgtgagttgaatgcacacatcacaaggaagtttcttggaatgcttctgtccagtttgtatgtgaacatattcccgtttccaacgaaggctcctctccactaaaaatacccacttgcagattgaacaaaaagagtgtttccaaattgctctatcaaaaggaaggttgaactctctgatttgagtgcacacatcacaaagaagtttctgagaattcaactgtctaatttttatatgaagatatagccttttccaatgaagacttcaaattactctaattagctacttgcagattctacaaaaagagtgtttcaaaactgctctatcaaaaggaaggttcaactctgtgagttgaatggacagatcacaatgaagtttctgagaattattctgtctagttttcatgtgaatatattcccgttttcaacgaaggcttcaaagcactccaaata

SEQ ID NO: 168592 - DNA, 500 bp, Homo sapiens
atggaccgaagtgatgtatagggtcttagaaaacatcaccagctgcatcattaatacttaggcctaactgggacattccagagaggtaaattactcctttgcaattattcttgtagtatttttcaccatgatgttagatatttctgactcaaatgagtatttctgggaagaattgttgtttgcggaaataaaaatgtcagcctcttcaatctttgctcatttgaaaacctttcttatatgaaactgaattgagagaggaagacagcaaaattaaggcatttgctctgctcaggaccaacgtagagataagttgcccttcgcattactatcacttctcttccaaaggttggttttcaagggtagtatgggagcaggaaaaaaaaaagtcatctgccccagtttcgggaacacgtagggggcccagggcagggggatctaatgtgagacatgaaggatgaggctgacttagccaggcatagaggggtgtgggacacatgttc

SEQ ID NO: 168593 - DNA, 171 bp, Homo sapiens
gtcctttgttgcctgcatccctagtgatcctatccaaacacattccccacgtcatcactcacagagtattttctgtggcttataaccttgaagtcaaagactggatttgtaggaaaacagaacatgaattatgctgctcaagtttttgtgtgaatgtatgccttcacttct

SEQ ID NO: 168594 - DNA, 234 bp, Homo sapiens
gacagaagaggactcccaggccatgagtacctgtgtgccaggcacttctcatggattacctgtgcaaggtagatgctcttacccgcactttacaggtgaacacatcgaaagttcagagatccgcctgaaatcagccagccagtatgtggccaaatgagggtttgaaaccaggactgtcttatttcaaaacttgtgctctttctaatacatgctactgtttcctgatgagattgc

SEQ ID NO: 168595 - DNA, 216 bp, Homo sapiens
tgtggaaattgcctcaggactggtctcctttagttgaaaacacatatgggcaaagaaaatgcagggccaaatgaacttttctgcacagatctctttcaaactgcaggaaagtttgctttctttaggtgttagagaagccaacaagagcggatgtgcagggatgataggcatctcgtggtgaatgcagaatcaaccaagcatttcacggtagccagt

SEQ ID NO: 168596 - DNA, 200 bp, Homo sapiens
tttatttttagttaactaagacaaagtgaataattcactgtgagccaaattctttcttgattcctctttttggagcagtccatctttatgggaaaaccagcctagaatggtgatttcagtttcaggtgatttcgatagaattgtatttggctcagaaatgataagactggggccaagaaaaattttaaactttttttttt

SEQ ID NO: 168597 - DNA, 752 bp, Homo sapiens
gggtcagggcagagctggtggtggcccccagaggtgggagggctttgctgcaatcctggaaggccagggctagaaaggcaccctttacccattgtgcagacagggcacctagggttcaaaaggcagcacctaccccctgtttggacttcccacattaatgtgggagcttccctgagcccccagctccatgaggtcctctggtgactctttaagacggcatttcttggggccagcagcatgggctgtgactgtcctaggtaccattcagaagtgactgagccctgacctttgaccttctctgactatcccttcgcgaggaagcaggagaaatggggatattcttggtcctcgttagaggaacagagaaggaatctgaaacatcgctgtcctcacagaccccagcactggaggagcagaggcgaatggcttcctccccagagcctcagtcctcctatctggatcatgggcatagggagaggagggagggatgctggggcacccccattctggtttttggcatgtggtctagagtgtcttatgtcccacgaggttacactcagggggctggagaccccttcttgggcaggcagccctctcccctccagaggccctcccttgcccaggcagccccgaggactccagcctttgctgctccctcctcccccgacaggtcccctggggcctgggaggaagcgagcccggctggacagcccgaactgtctggttcccacagtctcagagctggggtggag

SEQ ID NO: 168598 - DNA, 186 bp, Homo sapiens
aactcctgacctcaagcgatctacccaccttggcctcccaaagtgttgggattataggagtgagccaccactcctggcttctcccattttttcacatctatttagtgactacttgtggtcttttcagctacatcatctctttgctaaaagccatcagtgacttagtctgtagctgccagctatcac

SEQ ID NO: 168599 - DNA, 614 bp, Homo sapiens
aagtgagtgtacatgaaagaagaaaaggtggccaatgactaacccctgggtactacaggctagtaagaggtcagggagatggaggggacagagttgggaggagacaatgaggcaggagaaaaattagaagagcgcgtatcctggcagctaagtgaagggagtctttcaaagaggatataccagtgagccacatcaaatactatagatggatttagcaacaagtcagaatagctggtcacaatggtggtgacactttgttctgatcagcaggaaaaatgcagactaggagacactgcacagaaaaggaaaactgggggttgcatttgtcccacaccactcctttctgtttcactttctccactgcaaaagggaaaacaaagaaaattaacagccatatcacttgcacaatacatacttataaaaacgaagcaggtctgtgagatgttttgagtaccttagtaaaaagtataggaaattccactttcaagagagtccactaacacatttaccgttacctactgccatcttctatctactgcttcttagcaaaatacttcctaggcaaaatagagaaaaatagctacttctgctgttctcagtaaagcagatactat

SEQ ID NO: 168600 - DNA, 535 bp, Homo sapiens
gtctgaagctcaaaagagaagtcagggccagagaggtaaaacagagaggcttggcatcactttatggaaagccatgaaaatggcagcggtcatttacagagagaatgtgtacagggaagggagaaccctggggcgagctcctggatgtggaagtcagttagaggagaaggctggccaggaagtgggtggatggatggaagcatggatagagcatggaccgatgaatgaatggatgcaaggatttacatacaaacgaccctaaacaactattcactttcctccccatggaatgtttggtttccacttacctacaaacaatataacccctttcctgttcctccaaggagagcaataaactacaactacccaccagaccttgaagaagctatagtaaaaaaaagggaccattacagttaggatgcttgtatttcttacttagtaattgaaaaaataaataaatcatactggaaaacccagtaaggaaaagcgaatgagatgggtttccctcattctcatgagcagttggtagtgacaa

SEQ ID NO: 168601 - DNA, 711 bp, Homo sapiens
ataaaataaacggttcatactgtctcaaaacacactgaatgagaatacagtaaaaggtagaaagcagtctaaaaaatgaacaataagtgtaaaaactcaaaaaagccatacaattaccaacacaaccttttttcctgattcctgagcaacattatttcccactccttggtatctctcagtaatacctaggttgtgattccttatgaagaaatctccatccataaggaattactgagagataccaagaagcctatcacagaaaagaggagccttaggcttcagccagacaagctaaagcaaacaccacagaatctaaatacataaatcaactatttaatcagacaacttttactaacaagtgacaaagtattaattttaaaataccttttcagcattaactgcctgtcctctcgagtccctatatctcagttattttcctaagatgtcccacctttgagccactgctaatattttttcctccaccttaagggtacttaccttcccctcccatcttcatctgcttacatcctgtcctctttcaagtctcagcccttctacctattgtgtgttaattagaaaatccccggccaggtgcggtggctcccgccagtaatccctaggaggccaaggcgggtggattgctgagctcagtcaagacagccgggcacatggtgaatccgtctcggtaaatacaaaattagcggcgtggaa

SEQ ID NO: 168602 - DNA, 313 bp, Homo sapiens
tggattactgatgctacacctgagatcaaataagaaattgtggtgcagtaatggaagtgtaaaattttcagagtttttaaaaaattaaacaatcagattgttttcaaattgagctattttcatcatattgcaggcatattcttgtttctattgctaggctgatttgctgctgggcttcttggtacctctgttcccagattaaaatgggaaaaaaaaaacacaaggaagtgagaatgcagtttaatttttaaagcaaacatttctggagttttgttaggtattttacataataaagaaaattcattcattctct

SEQ ID NO: 168603 - DNA, 326 bp, Homo sapiens
cagttatttctatgactcacatcttattaacacaccacttacttcagcaatatccattctaaagtactgctaacccaatgtgaaatgaatacaactaatgccagaaatgagtaatgaaatttaatttctccattaggtatcatgtcacaacaaatgagacttctattttttaatcaaacttttttccctttaatatgagaatagatcaatccatttgaacagctttcccaagaaactgaaaaggaattgcagaggttatagctgctgaaagtatcttttgagacttttgcttactcatcatgcccaaaccagcccattttctcagg

SEQ ID NO: 168604 - DNA, 246 bp, Homo sapiens
gtactttaccactgctgctcctcagcatcttccctgcacatcgctccaaatgtcatttccatttaactgctttgcaagccagtttgcccccatcctaatgcaatttgctgaggacagtgagggagcagagagggtaatctgcattgccctccctttatcagcaggtccctgaagacgatcggctgcggagtggagggaaatagctcctttaggtaatgctggttggtggcagcaggggcaagttct

SEQ ID NO: 168605 - DNA, 537 bp, Homo sapiens
cctggatgtccggaactttattgtacagtcttgtcctgaatttgcagctcttgactttattcttgtgacttcatttccgaataaagagctaacagatgaaagcctgacactgctagaagcagatattcttaacactgtgttactccatcaactaaaataatattgttcctatccatgcagtaccatgtgggaacagatgatgtgtcgtattaataaggacaatacctccagcattaaaaaaaaaaaacaaattatttttattatttttacagataaatttgggttttattgttattctgtcttccaacctgaatatagacaaatctggattaggaatagaccttaagataagtatgtttgagtttttagttgaaggactggcttatgttgatagttttgggatttgtaggcaaatcagtttgttacatacttagtgttaatgtttggtttgcagaaaaaaatgaaaacccctttttgataaatgcatttggtaaaatttgcactaaagttccgttgagccgtcagcattgactaaca

SEQ ID NO: 168606 - DNA, 607 bp, Homo sapiens
caggctggaggacagaaacagataataggtgaaagaattttaagcgacaggaatggcaatttgtaaaggcacaggccttagtgagacaaaagaatatcgtatttgagaaactaagaggtttagaattttccttatgaaaaacatgggatgttacaatttaaagttataattactagaccataaagtttgagaatacaagtggtaaactggcaaaggcaagtcaaatacaggagagtcttactataaagagtctcatacccaaattgaaggaagtaaaacttactgctttaaagctggatcacaagcctaaaatttgtctctctatattctataggttgagtatccctaatctgaaaacctgaaatccaaaatactccaaaatctgaaagcttttgagcatcaacataatgttcaacattcaaaggaaatgctcaacggagcatttctaaaccagagaagattaaagatattacaagaacgtgagattctaaacattcagtcactgttttcaaatgcaccttcatgaaaggaaaggagaataaccctggcaacattgctgcattgcctgtatggttatggctgcagaagtagaactgtgaggggctca

SEQ ID NO: 168607 - DNA, 161 bp, Homo sapiens
cccttcttataagggcactaaccttatgttagtcagggtgccacctaaccttaatatcttccaagatcctgtctccaaacactatcgcactgggggttagggcttcaacatataaatctggggaagaggggaacatgaacattcagtccataacaaatgat

SEQ ID NO: 168608 - DNA, 608 bp, Homo sapiens
ggtgattctgatgggccctgtctaaccactgtatttttctgaagcccaaggtgcagcgacttgccaagggtcacatagcaagtctgtgacttaagaagccccagtcacaccaaggaagacatggagagggtctgtcgatgctgaggctctggggcagcaggaatgaggggaggggatgtgtgagctgagggtagcaggcagtgggagaagagccagtggaggaggtgcttctggacctggaagacttcaggaattcacggatagctagcaaagaactcaaggatcttcctctcccatttcatagcagggaagactgaagcacagagtcacagaggacttggttggaaaggcatcagtctgctgggtcacttgttagtacccaggatttctggagactggtgggtcagaggctagcccaagagggtggccctggtctctttctctttgacaagccttaggactggtttctctccaggcttacttggactcttcatgaaggccttgcaaatgttgataaccacagcagccactggaccagaatcagactttgttttgaatcctggtcccccagggaggcaagcaacttacccataaccattctggcttca

SEQ ID NO: 168609 - DNA, 419 bp, Homo sapiens
caggaaggaaagtagatacagagatgtaaagtctctaaagaggcagaatgactaatggacttggaagccttggccactttcctgattgactatattgatgcagctaaagaaagaatttgtccggccggacatggtggctcacgcctgtaatcccagcactttgggaggccgaggcgggcagatcacgaggtcagcagatcgagaccatcctggccaacatggtgaaaccctgtctttactaaaatacaaaaaattagccgggcatggtggcacatgcctctagtcccagctactcgggagactgaggcagggggaattgcttgaacctggaaggtggaggttgcagtgagccgagattgcgccactgcactccagcctcgcgacagagtgagactctgtccccccgcaaaaaaaaaaaa

SEQ ID NO: 168610 - DNA, 480 bp, Homo sapiens
gtagcatgacagagggagaggagacagatgagctaatgtattcccatgtgcagcacaccaagcctctcatcttccaaacatattttaaaaataaaaaactagtactgagtgagcaaggccagcacgtatatagaacaattacacaaaccacaccagtgaaaaaaaatcacttctcacctcaaaagtctggcaatctacagctaggggttaataaaacatgtcttacgtctctgtttgacattagctgtatgtcgtaatggaaccctggaaatgattgacatttaaggatcgacttgaaggaggagggaagattggtctgaaaagtttgtgactgccagtagataatgtccaatgagaatgtgacagggaggtctagtacagtaagtgctgtacaatgcactctgaatttggcactcccgtcactagtggctccactgaagacatttcagtaaagctgtgacggtagaagccagattgttc

SEQ ID NO: 168611 - DNA, 469 bp, Homo sapiens
tctttgattgttagatggcatctttcccttcatacacccttatggaattctctcattttctttggatttgtttctttgctttgttctctttcagcttggaagattttctcaaatttgtaatcatctatggctgtaagagtatttctaagaacaagacactaaaacaactgcaaatgctgtgtcctgattaggcagcacataccgtctggtgagctgaaccatagggtgatcgaaggtgatctggccttttcattggtgggatcgcaatagtcaatattcgtaggtgttcgctcttggtttctccagtttctctagcgaacaatctattggtttcctgcctgggagatttatgccaggcttgactttctggacataaggcagaagaatagagagaggttaccacattgcagaaaccacatttttgtggaagagaacaaataaatgcttttgataaaccaaagcctcttga

SEQ ID NO: 168612 - DNA, 307 bp, Homo sapiens
ctaaccccaccaaaacaatgtgtggcttctatgggacagtgcatggaaagtgctgagtgtaggtccaggtacttagtaactgcatgatatatgtgagcctctgtcgtcattgtcatcactattaaaactattggaactcagatttgtagttcagactttagttttggggtagaggagagtctggcccagatgtctctggttctccaagtcttgtcctttaggggtctaccaggtcctgggcagggaagagtgagagtggggtaggggtcagtcccctgggtgtggtctcatctgtgggactccactc

SEQ ID NO: 168613 - DNA, 468 bp, Homo sapiens
gacctgctgcggtgtccttacactcattgagaaccattgatgttatgcaaatgctattaaactttgcgtctaagacttcttatttgtcctgtgacctttgattattagaaagcaagcataggttggtagtgaggcagaggtaatgcctatagaggcagtgctgctcctgtatcatactggatggataaaagctcacgtctcatcctatctggagagaattttcagagaccatctatatgcttcttgggaggtttaagtagattgataccctgttatctttagggatgacattgatagttactactccttatattggcttttcttccatccccatcttaactcttcctgctcctgtaggtcattctctagacagactgcttttactcaggttcttacctcagccattgcttttgggagaacccaaactaagacagcagtcattagagtacttagtatttaaaaggtaga

SEQ ID NO: 168614 - DNA, 461 bp, Homo sapiens
aataaaattagagaagaacaagagaaagagacgaaattccagtcccagtttgcagcctgaagaaaatcacttaactttcaaatgtgtgcgtcaatcacagattctgtgtggagacgtgagaaatctgagcagcagtggccctgaaagatccttttaccatgctatagatggaatcagtgtgtcaggcagaaaggtcaggacagaagatctctcgggtctcttttaaatgtgagcttctgggattctccttataaaagagttagattgttgttatgctcaaacaaaattacagagaatccctcaactataagatattaggtatgtacaatggtgtgctgaatggagctggcttgtaccagctcactagagaccactgttaaattttcaggaattttataagccagctgtcaaacacaataacgagagaatgttcaggtcagtggaactcctctgtaaactac

SEQ ID NO: 168615 - DNA, 505 bp, Homo sapiens
gattctaggcctgcatcagtcctgacttgtcctgggagggtgcatatagcctagcctatttagtgcctgagggaagggaaattttggccatttctgcgcagggcaggaccagtgatgaggtgcagcaaaatgaacccaaggcctgagtcaggaagtctgcatcattgaactggcagggcaagggcactggactgagagtcttgagttttattcctggtactatggctaacttgtatgtccttaggtaagtcctgtgcctctctgagcttcagtttcctcttctataaaattaggaggttggattattattattattgagacagagtctcactctgtcacccaggctggagtgcagtggcgagatctcagttcactacaagctccgcctcccgagttcacaccattctcctgcctcaacctcccgagtagctgggactacaggcgcccaccaccatgcccggctaattttttgcatttttagtagagatggggtttcaccgtttca

SEQ ID NO: 168616 - DNA, 401 bp, Homo sapiens
ccaggcattctaaattaacaatgctaactcttgtttgttcttcaaaattcaacatgtgcctgctcctttaggttagtgcccctcaatatgtaatttatggatggtgctgtctgtaaaatgttaccgattgatatgctttggatgtgtccccacccaaatctcatcttgaattgtaactcccacaattcccacctttcatgggaggaacccagtgggaggtgattgaattatggggcgggtctttcctgcactgttcttgtgatagtgaatggatctcacgagatctgatggttttcaaaaggggagttccccgcacaagctcccactttgcctgctgccatccacataagatgtgactcgctcctccttgccttatgccatgactgtgaggcctctctagc

SEQ ID NO: 168617 - DNA, 451 bp, Homo sapiens
gccctgccccacctttgagaggtctccagtgtcttcttttcaaggttgcttttcagacctcataatgttgagagaggtgtcacaaggagaattcccaacccctgagcaaatgggcaaagttgcaagtacccagcagagctgctcaaatattgctgcaaccagaaatccttcataattgagtgggaagcttctagtaaccaggaacaaaaagctgaggaattattacaggtttcttgaaaattattggatttttttttttttttagagatgggggtctcagtcacccatgctggagtgcagtggcacagtcacagttcactgcagcctcagactcctaagctcaagtgatcctcctgcctcagcctcctgagtagctgaggctatgggagctacatgcctggctaacttaaaaaacatttttttttttttttgtagagacaaggccttgctt

SEQ ID NO: 168618 - DNA, 379 bp, Homo sapiens
accttaaatacatacaattttatttgtcaactttagctccataaagctgaaaatgtaagtcttataataaaaaagcatacttatatttctacatattttatcaatatgtgagaatataaacagaaaaacttgcacaaaaatagttataacagtttgcttataatatttatgttggaaacaaatttaaatttcatcaacaggaaaacaaatatacatatcgtcattatttcacataataaactgatttatttacttaataaactgtcatttactgatgttatggattgattcagatatgaaatattcatatgtgtattagtacatacatatgtatatatacaatgacaaaaccttgagacatgaaattacataaataaac

SEQ ID NO: 168619 - DNA, 383 bp, Homo sapiens
aatcagtgtcatttctggattagtttgtattgattcatttttattctcgttaagtaagagtcattattcctctgcttatctgcatgcctggtaatttttgactatatgtaagagattataattttacatcattgggtaaaataaattactttttttaaattttattattattatactttaagttttagggtacatgtgcacaatgtgcaggtttgttacatatgtatacatgtgcgatgttggtgtgaataaattacttttcaatacctatgaatattattgaatttttcctgggatatggttaagttacatggaaatgatttgatctttctggatcacattttgttaggcagtaccagagtagcatttactctcagacttat

SEQ ID NO: 168620 - DNA, 556 bp, Homo sapiens
tcggctctgcctctctggatcaccggctagtactcccagttctcaatgtcccggtcctctggttgtcccagtcgctccagttgccccggtttccagcctcctcggtccctccagtctctcccgtccgcccagttttccctccatcggggttctaacctctcagatcctttaggaccaccccgctcccaaggccataggaggctggggcgcgttcggagtgcgttttttcgagacaatctccgtagcgctcacccctggccaccccgacccgcgctcctacctcgaggctgcggcgggctccgggcacggctggctggtgcgctactgacggtcgctcataggccctgtgcgccggcgagctctccagcggtaaggggcaggagcccagggcgagccagacccggcggctggcggcaggcggcaggcggcggaggtgagcgctggcgagagggcggaggacggagggcgggcaggagccagcgagcgaacaaggccagctccgcccgtgactcacccgcgctctctgccttcatcctctccccagcgctgctttttc

SEQ ID NO: 168621 - DNA, 107 bp, Homo sapiens
atatctgatgttgactatgactcttaccgtgatcctccctgcagtggtcacagtggcttggagtgcagggctctgatagctggtctgggatcacatgctgtcttgga

SEQ ID NO: 168622 - DNA, 206 bp, Homo sapiens
ttgttaaatgaatgaccagtaaatcagtgaaacaaaataaagatctcagaaatagaccataaatatcatcaactgatcttgggtaaagaaacaaaagcaacataatggagcaaagatagtcttttcaacaaacggaactggaacacttggacatccatatgcataaaaataaatctagatataggctttacgctcttcacaaaaaa

SEQ ID NO: 168623 - DNA, 294 bp, Homo sapiens
tgacccaagcacttcttaaaggcctcacatctcaatactgccacattggggattatgttccaacatgagttttggaggggacaaacattcgaaccacagcagttggctaataagaaaagacagttaataaatataggcaaggacagagaaattggaattcttatacattgctgatgggagtgtaaaatgatacagccactgtagaaaaatgtttggcagttcctcaaaaggtaacacatagagttatcatatgatccagtaattctactcctaggtatccacacaagagaaata

SEQ ID NO: 168624 - DNA, 908 bp, Homo sapiens
ccctgaagcagttgcaccaactttgttcaacatcagaaatttatattggagaaaaatccagcaagtgtaataaatttggaaaaacttttttttccccaaaaactatacctcaggaaacaatggagagtttatattaacatatttttgcatatggccatatgtataaaaatatttaattcaaaattgaatttaaaaagtctacataaatatcatacatagatatgtatgatattgaatacatgtattaaatacatagaatatgatatttaatacatagaaaagtctacatgaatatcagaatttacagtagaaacaactaagacacaaacacttgagacattacactaaagtgctgagtatagaaaataaaactaaagttgttaaattatttgtatataacttttaaaagagtggaagatattttgcaaagttatattcaaagtgtacttcttatttatttttttgagatggagtctcactttgttgcctacgttggagttcagtggcacgatttcagcttgctgccaacttcgacctttgggttcaagcagttctcctgccacggcctcctgagtagctgggaatacaggcatacaccagcatgtctggctattttttttttttttggtattttaagtagagatgagatttcaccatttggtccagggtggtctcgaactcttcatctcaagtgatctgcctaccttggcctcccagagtgctgggattgcagccatgagccattgcacccagcccaaagttatgcttttaaaataaattgttttattatttaacaattttggaaaagcaaattatgatataattcaagtatcaaattacttcatgctgtttcattgttcctattcacatgtgaaagcatgtgatcaattattgctgcatcacatata

SEQ ID NO: 168625 - DNA, 471 bp, Homo sapiens
ggatgacctgagcccaggagttagaggctgcagtgagctatgatagtgccactgcactccagcctaggcgacagagcaagagcctatctcaaaacaaaaacaaaaacaaaaaactcatttcctcctcaccccagcccctggcagccaccattttactttctgtttctgagtttatatacaactcatacccaagtttagatgcctcatatacagcatgtctttttgtgactggcttatacagcatgtctttttgtgactctcttagcacgatgtcctcaagattcagccatgttttgtggcatgtgtcagaatttccttccttttcaaggctgaataatattccattgcatgtacatctcgccttttgtgtattcattcatctgctgatgggcatttgggttccttctaccctttggttactatgaatagtgctgctaagaatatgggtatagatacctcttggagaccctg

SEQ ID NO: 168626 - DNA, 473 bp, Homo sapiens
ttggaagatgtgttggttgagagaaagattctgatttgttggttgaaaatagactcatcaagatcaactgctgtagtagtaaatattttgacattttgtctgtattcctgtgctgccctcacaagctgcatcaccttgagtgagtcattcatacttttttgtttgtttttgttttggagatggagtcttactctgttgcctaggctggagtgcggtggcgtgatcttggctcactgcgacctccatctcctgggttcaagtgatcctcctgcctcagcctcccgagtagctgggattacaggcacatgccaccatccctgctaatttttgcattttcagtagagacggagtttcaccatgttggtcaggttggtcttgaactcctgacctcaggtgatccgcccacctcagcctccccaagtgctgggattacaggtgtgagccaccgtgcccagcccagccatcatttttga

SEQ ID NO: 168627 - DNA, 346 bp, Homo sapiens
attttatagaggaggaaactgactttcaattaaaccatttgtcaagctctcttaaggtaatgagtcagacctttccagcactcagagcacagcagatctctgatgggggccccccaaatctcttcctccctgagtcagatcaggctgtgacatggtgttagcaagcgggtgtgcacgggaggatgtatggctttcagcttttaaagctcatctccctccatggctaagccaggcctagtgagatgtagatacataaatatctcctttatgccctgtcccaggggaaagatagaaccaaataaatccgattagcttcccaggatgctggctgctctctctttgaagt

SEQ ID NO: 168628 - DNA, 211 bp, Homo sapiens
aaaatcagagatggaaaggagatactgcaactgatgctacagaaattcaaaggatcattagtggctgctatgagtaactatatgccaataaattggaaaatctagaagaaatagataaattcctagacctacaacccaccaagattgaaccatgaagaaatccaaatcctgaagagaccaataataagtgatgaggttgaagctgaagtaa

SEQ ID NO: 168629 - DNA, 217 bp, Homo sapiens
ttgactgaatatcatggcctagcgaagtgggcacataaacataaccatcacaacccactctcgaaaattaacaggcagccctccgaatcccatcactgagacttgagtctctacaaatgacctcaggcaaaagagctaaggaagttcctgtctctgtaccattgatagggcagaaatgtcctatagcaacacagcctcctaaaccatatgtgtattt

SEQ ID NO: 168630 - DNA, 151 bp, Homo sapiens
caccgtaggaaatcccagctcagcttcctcagtttttgccgagccacgcactcaagggaaaaccagcaatcacggaaacatccattttaattattagcaaaattaaagacgtacaggcatgactttcagaaaccaggaactttttccctct

SEQ ID NO: 168631 - DNA, 315 bp, Homo sapiens
gatagctagaaagttgcctttgaaatagtttatggcttccctcatcttgcacatgatatagcaagcatgtggtggtcagggttatttaaaaaatatgtaaacattattattatttttttgaaacggagtctcactctgtcacccaggctggagtgcagtggtgcgaccttggctcactgcaacctctgcctcctgggttcaagtgattctcctgcctcagcctcccgagtagctgggactacaggtgcctgccgccacaaccagctaatttttgtatttttagtagagatggggtttcaccatattggccaggct

SEQ ID NO: 168632 - DNA, 151 bp, Homo sapiens
tgtatatattaatagtgtaaagaagttatctttacactattaagttattctaaccaggaaattaaatggttttttgactcagtcaaattattttacgctcttctgtaaattcttttttttttttttttagtttaggagtggaaagtttaat

SEQ ID NO: 168633 - DNA, 179 bp, Homo sapiens
tctagagttacacaagagtatacatcccacatctgcctctaggcatatattaccctggacaagatattaaataaatacctctgagctgcaagacattggacaataatagaacatcttcatagggttgttgcaaagattgagttaatgactgaaggtacttagcttagtaagaactcagt

SEQ ID NO: 168634 - DNA, 249 bp, Homo sapiens
tttagacgggcatctgccacactctaaaaatcgtcataacaaaagtcatttggcagatacctgacaaagcacttctccgtattattatcctcttgggtggtcccaatacccctgtgcagtcgatgtctctgtcacacgtgtccgtgtgaagagaccaccaaacaggctttgtgtgaggaacaaggctgtttatttcacctgggtgcaggcgggctgagtcctaaaagagagtcagcgaagggagatacc

SEQ ID NO: 168635 - DNA, 204 bp, Homo sapiens
tggactgcctttcttcaaattccttattaagaaaaacaacctctgtcttgactgatatgcttttatttgtttttttgtttgtttgttttttggttccctgcagttgaatttaattcccaactgatataattatgtttagtgcaaaggctcaactgggtatgattgtcatgagatcacttcagccaataaacagaaattatgata

SEQ ID NO: 168636 - DNA, 333 bp, Homo sapiens
agccaagcctcatctgcagcctgagatcctcaaaatgtcacagtctctttgctcttgggcagtatgatgccgcaggctctgcctggaagattattttcttgattacgggcgtgcacctggctaatttttgtgtttttagtggagatggggtttcactatactggccagtctggtcttttaactcctgacctcagatgctccacctgccttggcctcccaaagagctggaattacaggcgtgcagctccacccagcctggaagatttttttttttttttttgagacagagtctagctctgtcgcccaggctggagtgcagcggctcgatctcgg

SEQ ID NO: 168637 - DNA, 424 bp, Homo sapiens
tgggagtctggacatgccttctttctgggtgctagttacacagatatgttctgtttgtgaaaatgcagcttgctgtacacgtatgaagatgcacacttttctgtacggaggcgacacttcagtgtaaaaaggttttttaaaaatgacaccccagtgtagcgtcagacacatgcctcagtcccacctcacgtccccatccgtgagtccagcaacgacccaccagccgcataaatcagaggccagggaagtcgagctggcggctgggtttggaacatgcttcggtgactcagagcagcagctggaaataatctgctgctgttgacttcaccgccctcctgttcggcagctcgggggacctgccacggcccactgagtattccagtgccagagagctggggaaacctgtcctgaagttggcggccgc

SEQ ID NO: 168638 - DNA, 845 bp, Homo sapiens
tccgtccatccaccattattccatgaaagaaacaggaatagagggaaaaaaaccacctagataatttccatgtactgacagatgcagattatgaaattaaaatatcaatgacatttcttttcaatcatcatcacataaaaacaaaaattaaaaacaaaccaaaagcctcccagtgccacctcagcataaattgagcaacagctctccccatctctgccttacataataaactacaagctaattaaactgtgaatgaatgtgataacttgttacccttaaagatattcacagagatagatgaacttcattttggaagctggaaggtaaaattcccctccctgggaacccctacaggagtcggcctaagcttcccttcctgcatccatgtgtgtgttggttccttctgcactgcacaatccccaaggctggagagaaaggctgtttccctctgctctgtattccctacagcaccaggccagggccaggctgaatgaaagtcaagtgcaatcctcgctatgctaccgggagagccctaacattccttttggatatttgtatccagcacacagtattataagcacttgacagctgaatcctgcctctttgaggctatatttattttatttattacatgccattttgtaccttactgaagaaacaaaggcgggggcagagaggggagaccagaaaaatctcccagcaaaaaacaaatgagtattgtaatgaactataatcattaaattgcactccatatgtctgatccaggaaccaataagtaaaggggagggttaattctaaatgaccatcaatgtcgacgcggccgcgaatttagtagtagtaggcgg

SEQ ID NO: 168639 - DNA, 261 bp, Homo sapiens
agaaagacctgccccagagccccctggctttaggggtaggaattggataaggtgctattggaaggaaagtcttctggatcttggtgtgatctaagtaaggggtaaatgattggtaaacgatttttgagtgtgtaaaatgacgtagctttcatagcctgattttatggaatacattcttgatagcttcagtccggtagtttcctatcaagagatgtgaagctccatattttcccctcaagaggggggtgatcttaagactct

SEQ ID NO: 168640 - DNA, 191 bp, Homo sapiens
ctccagcttctggaccccatccaaagtggcagctccctctgctcttccacaccacccgctccaggccctggcggctcccgcctcaccagcctccctctgccccagccagctggctatgagctctcgggcccatgctcagttctggtgtcggtccatggctccccagctgcaggggggccaaagggcagcaa

SEQ ID NO: 168641 - DNA, 252 bp, Homo sapiens
ggatagtttgatagcaattggggaggggaatcatatcttaatttaacatcataaacctacacaaattgttgatgaataaaagattaattataaatacaaaaccataaagctggaagaaaatatgaagattgagaggactttctaaagattaaagaaaggaagaaaccacaaaacaaaatcaatagatttgactgcataaaattaagaacctctgtgctttaaaacaaaaaatgccaaaagaaaattaaaagg

SEQ ID NO: 168642 - DNA, 185 bp, Homo sapiens
aacgacggtttcgggtagattgttggttaagaagaaagctgggaaagtgaaggagagggggaagaaaggaagtgaaaagactttggctgttggaatctcagatctggaataggctgtataggctatttataatctctaattgccgaggaacctgaagttcagagttaaccagtgactgactcagg

SEQ ID NO: 168643 - DNA, 330 bp, Homo sapiens
cggctggctctgggtttccttgtgagtgatcctgtccgtggcattagtaccacctagtggacttcgcaggaagaactgcatgttgaaaccatgcggacagtcatttaccagagcggcggcggtgagcgcagcagaagggccagggtcctccgagcgaatcagcatgaaagaaaccataataatgagtaaactcaaagcttgaagcataaactcaaagcttcagggggacaatgagacagaggcaggggcgctggtcttgctttctcaggccgcccagttctgtttgactgagcctgtggtccgagcggatggaatccgcccctccagcac

SEQ ID NO: 168644 - DNA, 398 bp, Homo sapiens
cggagcttgcagtgagccaagatcgcgccactgcactccatccagcctgggtgacagcgagacaccgtctcaaaaaaaaaaaaaaaaaaaaaaatgcctccaaagttgatggcccaagtaactggcaggttgctcatgccattggtgtgaatagaaaacactgggaaagaaccagtttaggagagttttaggagaaagattgcaggttcaattttagacaaattgagctagaggtgcttctaaaatgttcaaatggtcatgtcaaggcaataaatgggtctggagtttagagaaggaatctgagctggagttaatttaacagtcatcggcatatggaagaaaactgaggccactggtatggagcaagtatggagttaggaaagaagaggccctggagc

SEQ ID NO: 168645 - DNA, 478 bp, Homo sapiens
gaagaaactccgaaaacatcttaacatcagaaggaacaaattccagacgcgccatcttaagagctgtaacactcaccgcgaggggcgtggcttcatgcttgaagtcagtgagaccaagaacccaccaattctggacacattatgacctttgtttcctgccatggaagaaaatttaaattcccaggctgaagaagcaaattaggcctctcaagcagaaaccaacagctttggagaccagaagccccaaatcaagctatcagcagggaagtactacctctggaagatgcaatgaagaatgcttttttccctcttctggcttctggcggctctgtattacttggcttccttggcttgtggctacatcactccaatctctgtctcagtcttcacattgccttttcctctatgagtttataggaatgaatgcaggaggaaatgacacctgagttgagcagtaagaggtgagtggaatagtgtg

SEQ ID NO: 168646 - DNA, 228 bp, Homo sapiens
ttccagccctacctggcacaatcccgtatgtgttgcagcctcaagtctaggcttccactatccttacagtatctccccacctctcaaccccaaagtacagtctgaaattcttgtcctggttacatgcctcatgtctttgggttgattgtttttccttgtttcaaaaaaaataaaaatcaggaaacatctcttgtatggtctaggtttcctcagtgtcatggtcacttt

SEQ ID NO: 168647 - DNA, 176 bp, Homo sapiens
catgtggaatgaatggccagaaatatgagccagcttgtgtggttgggacactgctaatagtggtgggctatgactttggaacaaggtgcaagatgagagaatggagattagcttggatgtgtacaaataaaaccatcggtaagtatgaaagagaagctgagagtcatagaggccag

SEQ ID NO: 168648 - DNA, 186 bp, Homo sapiens
ctccagagagaaaatctgaagtagttaagacgggttaagtaatgtctttggacttcttgggaacaactggcacagaggaccatgtcttacttggctctgtcttttgcagtttcatttcactctctctttaaatctttgaaaaccatatgtctgctctggttttattatctgcttctatccaaggca

SEQ ID NO: 168649 - DNA, 132 bp, Homo sapiens
tatttattgtgactgtgcatgtatggatacaaagcacacaagtgacattaagaccttaagggaaaatccaggaatgagctactccttcaaagcgtgatgtgcatgcaagctcttttagatcctcaaccatgt

SEQ ID NO: 168650 - DNA, 172 bp, Homo sapiens
tagtatcttattgtatggacataccatattttgttcatacacttaccagctgaagatcatgtgagttatctcctgtttttggagatcatgaataaagccactggagcaggagatttaagggtggggaatgtgtctcttttctgaaaggtctccagcacatcttttttttttt

SEQ ID NO: 168651 - DNA, 446 bp, Homo sapiens
ctcaacctcccaggctcaattgattgtaccctagcctgcccagtacctgggactacagccatgcgtcaccacactcagctaatttttgtatttttagtagagatggggttttgccatattggtcaggctgatctcgaactcctggctccaaatgattctcccatctcggcctcccaaagttgtgggattacaggtgccaaaattacctttagaaaatgtttcttgactattctgcttaattacttttttataatctttattggagcggatagcttgcggcaagctatccggttcaatgctgctgattattctccaggaggctcttctagctccaatcacattcttatatgcaacagataggaggtttctttcttcaactgtcagctccacatccatccctgctactttcttcattgactccaccattccgtcgtatcgctcagcct

SEQ ID NO: 168652 - DNA, 403 bp, Homo sapiens
tagctgggattacatgcgtgtgacattgcgcccagctaatttttgtatttttagtagagatggggttttgccatattggtcaggctgatctcgaactcctggctccaaatgattctcccatctcggcctcccaaagttgtgggattacaggtgccaaaattacctttagaaaatgtttcttgactattctgcttaattacttttttataatctttattggagcggatagcttgcggcaagctatccggttcaatgctgctgattattctccaggaggctcttctagctccaatcacattcttatatgcaacagataggaggtttctttcttcaactgtcagctccacatccatccctgctactttcttcattgactccaccattccgtcgtatcgctcagcct

SEQ ID NO: 168653 - DNA, 2506 bp, Homo sapiens
  misc_feature (790)..(790): n is a, c, g, or t
  misc_feature (1904)..(1904): n is a, c, g, or t
  misc_feature (1915)..(1915): n is a, c, g, or t
  misc_feature (1917)..(1918): n is a, c, g, or t
  misc_feature (1924)..(1924): n is a, c, g, or t
tgacacagaataacctccatctcctgggtcccagcgattctcctgcctcagcctcttcctatttcacaagtagggaaactgaagcccaggtaggcaagcctgacttgctggagtcacacaggaagttggcagctctgctccatccctgggatctggagcccctgctctggggaaggagaggtggggcgctgccttcccagagtcccctcaagctggcagggacggctgtacccccagggtcagaggagaactaaaaggagcggaagctggcctgggtccagggagagacctcgtgtttgcccaaaagggagctggagaggggcagctgggcccatatgcagggaggagctgcagggagctggtggcggggcagcaaagagaagtggatttggtgggtagaggggcccctccttggttctagtcctccccgcagccccttgcaaacaggcggggctctcctgtccttctctcctgcagcaagccctacatgaagaggcctctttggtgagtggcagctcaacctctgctaaatgcctccagtgatggggagttcactaccttccaaagtttttaaaagatgttaaccactgctattcaagaacaattctagaatttttttttttttgaaagacaaggtctcattctgtctcgcaggccagagtgcagtggtgtgatcatagctcactgcagctttgacttcctgggctcaagcaatcctccctcctcagcctcctgagtacctgagactacagatgtgcaccaccacacggggaggcttccatgtctacanaaatttttttaaaaaattagttgaatgtgatggtgcattcctgtggtcctagctattcaggaggctaaggtgggaggatcacttgagcctgggaggtgaggctgcagtgagccatgatcctgctactctactctagcctggactaacagagtgagaccctgtcaaaaaaaaaaaaaaatctttggtaacaaaaataaataaaaatcactagtttagacaaattatgagaaagctaggaaggttccagatttttgtgagccttgtgtacttactaaaggattttgactcaagggcaatggggagtcaatggaagtgttgttgttgttgttgttgttgtttgagacaggatctcactctgtcgcccaggctggaatgtagcagcataatcatagttcactgtagccttgatctcccaggcacaagcagtcctcccacctcagctgcccaagtagctgggaccaagggcgcacactccaccacccccagctaatttttaaaaaatatttttgtagagatgggggtctccctctgttgcttaggctggtcaattgaagtttttgagcaggagtgtgaccgaagggctcagtctagtgggttactctgatggctatttgtaggctggatggagtggggaggttaattctggggtaggagcagtagtccaggggtgaggtgatacagatctggacataggaatggaaaatggaaagtcagtggcagggagactgaaaaagcagcagtcaggctgaatgattgatagcagcgggaatgatgttggcctggtttcatccctgggaggagaattgacatgaggagactgaagaaaggcctgggtgtggggagagagctgtggcattcaattgaatgaagggtgacagctggtcatgaaggtgaggcactctagcaggcagaatccagacaaaatctgggaactgactgtgggtcctaggaaccacttgaggggaaaccatttttagggaggccttgagtttaaaaaaaaatcattgaggccgggtgcagtggctcacgcctgtaatctcagcactttgggaggccgaggtgggaggatcgtttgagtccaggagttcgagaccagtctgggcaacatggcganactccatctcnannaaaaanaaaacaaaacctcattggttttagatcagttggaagatgagttggaagtttgtgcagggagttagatgcacacacacacgcacacacacacacacacacacacacacacacagcctcatgactgcctctgacattgagaagctgcagagagagtaggaggaccaggtcgggggacacaaactatagctgaaggccaggatgaactcagaaacaagagattaaatgcggatgctatctccattccccaggctgaaaattggagggtagttttgtttgtttgtttgtttgtttttgctggggaaagtgatagtctaagagaaagaaacatagattgtgatatttgggaggccgaggcaggtggatcatgaagtcaggagtttgagaccagcctgaccaacgtggagaaaccccgtctctcctaaaaatacaaaattagccaggcatggtggcacacgcctgtaatcccagctactggagaggctgaggcaggagaatcgcttgaacccgggaggcggaggttgccgtgagctgagatcgcgccactgcactccagcctgggcaacaagagcgaaactctgtctc

SEQ ID NO: 168654 - DNA, 553 bp, Homo sapiens
aggcgctcggcgcagacagcccgtgggtttgtgtttgtggggtgtgtgtctgtgagcgcgggcgcttccgaagctctcgctccgcagcctcacaccccagaacttcgggttgcaagagcagattttagctctgaggctcacaacagagggcggccaccgtgcagggggagtggccagagccagcttttcccagcgccagggtcgctctcccgggtcccgccggactccatgccgccccgcggggccgcaggagccacccgggccctcgcgccccaaagtctttgtgccggtggcggcgcgggaagaccggccccgggggcctgggctgcggcccaaaggccaaaaatgcgggagaggcgtgggcgcgaggcgggacaagctccgcacagtcgccgtcccgcaaggggcaaaaaagtagaaaaagccgtttggggccaaactctcgggtctgagaaaccacgtttccgaggacgaactcgcggtgggaggacacatggggtacaggggacattgttcgcggcgcctgcccggcgcgccgtgggtgcgcggccgc

SEQ ID NO: 168655 - DNA, 458 bp, Homo sapiens
ttgcatcatctattttattttttggaagtattttaaggtgaggtctagacatcctgacatgctgctacttaagagactaatgcagctcctaaaaagaagggaattttcctatgcaagcacaatccattatcacatctaacagaatttacagtaattccataatatcacctagtatctagcccatattcaaagttccccaattaaaaaatgtctttcccagcagattgctctgatctcatcagggttgtctcttggggtttacaacaggtgctgttttcacttcctcctttctcctctacgttttctgcaaactggaagctagatctcaagctgtgctggccagtacagtagtcaccaggcacatataaatttaaattaattgaactgaagtaaaattcagctcctcagtcatgcaaaccacatgtcaagtgctcagtagctgcttgtggccactggct

SEQ ID NO: 168656 - DNA, 487 bp, Homo sapiens
aggtttttgtttctgagacagggtctcactctatcgctcaggctgcagtgcagaggcatgatctcagcctcccaagtagctgagactacaggcgcgtgcaccaccaggcttagctaatttattttttaagttttgtaaagatggggtctacctatgttgtccaggctggtctcaaactcctgggctcaagtgatcctctgccttggcttcttaaagtgttgggattacaggcttgagccactgtacctggctgggggttttatttattacatgcacaagattgtcagaatgagatctgtgtatatctttttcaaagtttaatcacactactgacattccttaccattaatttgcttgctaattatgatcaacttaatttaaattataaacatatttgaaatgctgacatgcacagcttagatttgtttctgctattataatctctttgttaaaaatgtacataagatattaataaatactttgatat

SEQ ID NO: 168657 - DNA, 436 bp, Homo sapiens
ctgaaaatacaagtcccataattcttatcacacaattatagatttttttcttctatcacgaaaaagatgaagttatgcaactgagcttaagtcacatcacactagaaactgtaatcaccttttctagaagataaattttacaaggagaatacaaaatgcatgcaaaatcccaacaaaaataactttaagattttacatattgcattagaaaaagactctgaaaaaatatatatgtacttattgtttaatacaaatactattgaatactaatactaaagagcagagagaactgcctactgaatccatttcaaatgaggcaaattagatcttaaaatcatttctttctcaacggaggtaataaaaagtatcaatcatgcctcactgtgaagcaggtgctgctgtaagacaaatctccatgtctgctccacctccgagt

SEQ ID NO: 168658 - DNA, 267 bp, Homo sapiens
ctaccttccaagggaccctgttacaaaatacactgaactcagacctcaatgcagcctatagtgacgccatcagtcccatggcactggctacctgcaatcttccctggctagcctttggacacgggactcatggtgcctaactgttagagggagtttctggaaagaaaacactggttttcctcccagctaggaagatcagacttcaactaagcaatgtgactactgtagatggtatccaagacttatttgatttctgagttctcttgt

SEQ ID NO: 168659 - DNA, 458 bp, Homo sapiens
aagtctgacaaggaaaatgtgctgtgatcatcctacgggggacagagcagctgctccaaggtggagtctattgtcaaggtcctcctggtaacaaaaagaggaaaaggtctatcaaagcatttcctgcccgcgggagccatgtgcttccattaattcttttccctgagtcagtctgtctccctcagctcatgtctctccatgtccactgtccagagaaaagaacaggcatttttagcagttgatttaaaaacctttccacaaagtgaggttaacgagaggaacaagctcagatattcagtggtatgcatctatatatttcataaggaagctggcactaagaaagggtggtttacggcagttatgatttttcagaaatctgctcatgcccttcaactgctttggcactgccatgggtacctgaggataagagagatgtctctgccatctctgcaccatca

SEQ ID NO: 168660 - DNA, 457 bp, Homo sapiens
gctccaaccacctgcaaccctgagctgaaataagtgcgtaaatgattatcttgttttcattaatctctctttaatgtatgtatagctcacatttatttcaatgtttaatattagaagtgttttggcctttatttagaagtttggtgatgtttttgtgacaagaaatatgccttaagaactgaactcttgtttatattaattctcctatggtaaaattggttttattttatgttgttctatttaaagtagcagtttctaggagcctatctatgacattagttgaggatttattgtatttactcatgcattgtttatcagtgacagatcactttgtatcttcttcctttggtcttttgtttctgtctctgctggctcttcctaccttcctcccttgaatattctccatagccatcacccactatggactgcacattgtccagctaccaccctgtctcat

SEQ ID NO: 168661 - DNA, 308 bp, Homo sapiens
aacgtccttgaaaacttccataaatgatggtgaataaattaaaaaggtggaaacaattttccaggtctctgagccatattcaatataatgaatcctgaataggagttcaatgaaaagattaggtagattttttttaaaaaaaacccatatcccatgggatcctgctgtaaggtacttttataaattatactgattatactgtctcatttctctgtctatttgccatgtgttatatactttggtgatctttgagaaagcatttaacctattacaggcatttttttcccctaaagtacaagtaggtaggt

SEQ ID NO: 168662 - DNA, 680 bp, Homo sapiens
agctctttcatacagtctgtaaatttttggtaaatgttattgaattatacattcacaaaagtacacgaatcataagtaaacagctcaatgaattttcacaaagcaaacagtgtagccagctctcagaccaagaatcagaacaccaccagcatgagaatcagaacatcactggcactcaaaaatgctccctcttactctcttccagttattgcccgaccgctgcccccatgtgcacagtgtgaatagtatcttgtcttctatcatcagagattagtttcactcgtgcctgtttttgaactttttataaatgtaatcattcagtaagtaccactttgctgtctggctcctttcctcatattatgtttgtgaaattcatctatgaattatttagtttgttcacattgctgaatgatattttgcattttgaacaaccacagcttatccgttctactatgatagatgtggtttcagtttggggctgttatgagtaatgctgcaattaaaactctcctatatgacttttggtgaataaatgtcaagtactgggttgggtacatacctaggagtgggatttataggtcttaggatatgccttcatcagctttagttaacactatcagttttctaaaatggttgtacctttttcacatccattagcaaagtagaagagttccttcctc

SEQ ID NO: 168663 - DNA, 437 bp, Homo sapiens
taacagaggggtccccaccccatgccgaccgaggtcgctctcctccacgtctcccagtcgcccacaaaggcggccacgcgcaggccggcgcatcccgagtgcggggcgcccatcccgactcagcccgccgcgcccaccgaggagaggagaggcgaccccgccccgccgtccccgcagcccgcccggtcgcccccgctgcgtcagtgcctcaggcagggcctgcgcgtcctcctcgcgaccccaaaggaacgtctggtccctagaagggtcgctgccgcgttaccgcctctttgcgcggggaagaggcagtcactgcccgaacctcggcccgaagccacgagagggagtccggggcggggagcggggccgggcgtccgattcccgcggcgctcccgcgctgtcccgcgtggctgcgggaccgtggggagggcggccgc

SEQ ID NO: 168664 - DNA, 311 bp, Homo sapiens
cagacacacacatgcagccgctgctccacagtcactccggacctccctgtgacaacacagggtgcccttctgtctctgggagtgcccctttcactcttatgtgctgtttggacggggattgtatgatcactgtgattatgagggggccccaggcattgggcgttctttctcctctggagcttatctgcccctacatttgctgtcctggtccccgccatcccacagaccatattcaggccccatgctctggtcccacgggcctctggtggacttggggaggggccaggctgctcaccctcaaggggcagcgc

SEQ ID NO: 168665 - DNA, 425 bp, Homo sapiens
tgggcccttattcacgcgtagatactgggaatgagcccgcacagagaaaaagagcactgcctgcaagccaggagaggcttgggagaaatcagctcagccctgccggttcgcggatcatggacgtccagcctcccagccggaagaaacccacctctgcggcttaagccacccggcttgaggtcttttgctcttccacctcattagatgccgggcaacaaaccaacccatatgccttacattgggttggtttgttgcccggcatctaatgaggtggaagagcagctcccccatcgttactgggatgcactggccctcaggatcatggacttgggctgaagggtggggcccagccggcttggttccctggggcccccccggccacacagggtctttctgttgggccaaagctgagtttccagggacgg

SEQ ID NO: 168666 - DNA, 358 bp, Homo sapiens
cctctgaacaaagcagtctgcttagttttacccatattaattcagcagctcccaactctcctgactcaggattcatcaagtactcacatcctagactctaggagccagctaccctattttctcatagcacctgtgtgagtttatcttcttactaaaacataaaagctccttaagggcagaagctatgcaagctttgctcatcactgaatcccaaggattcattggcaaacaacaggtgtttgtttgtcttagccccttctgtaacaaaagctcagagtgagtggctcaagtaacaacaagaaggcaaattgaactggagtttgaacaagctttggctggggttagctgcaagatgagg

SEQ ID NO: 168667 - DNA, 229 bp, Homo sapiens
gatttttttttcctcctctttcttcagagatgtcaataagatttaaaacatagcctgttaaaagattgcctaaagaaggcgtggacagtcaagaaagagaaattcaaagaactcctggtgccccaagcttaccagcgcaaggcataaaaacaagggtcagccacttggcaccctgtttcgggaccatcgccagcctctggttcagtccaaagaccagtgtggatttcct

SEQ ID NO: 168668 - DNA, 316 bp, Homo sapiens
gtgcctgtgttgtggtgcactgtgtcgtggtgcactgtgtcgtggtgcactgtgtcgtggtgttccagtcttcagtctactcagacccactctctacacagctaccagcaagtggattttaggaggaaatctaaatgcatctctccctgcacccactactccacagatcctctgtcactagcggtgacctacgctccttactacagcaagcagagccctcctcgccagcctcacgacacctgcctccaaacctcaaaggactttatcgcctcagacaccttcctatttcttatctctacccccccaccacccacta

SEQ ID NO: 168669 - DNA, 162 bp, Homo sapiens
attcagctataacataacttattttctgaacatttaaattatccgtgtggaaagcctcaaattattaccatgtactaaatctggaagtcattttgaaaattcagtgccttccaatcaatacttctgggactgagtaactgtgatgggagaatacctcctctt

SEQ ID NO: 168670 - DNA, 188 bp, Homo sapiens
gcccagcagtgcatcccctttcttctctgagttctccccagtacaaatctggtgcttggatctctttctgactcctcagtttatctgtcaaatggttccaaacttgagtagggtgagaggatcatcccccgtcaaatgtacattattcatacactgtaatggcgtaaaagaaccctagacacatggac

SEQ ID NO: 168671 - DNA, 112 bp, Homo sapiens
acccgcttcacgaccttttgtcgctcgtgcccactcttacgctcgtccccgcagtgtagtttcttcttccctccggtgcaagcaaaagccggcctggaggtccccactacag

SEQ ID NO: 168672 - DNA, 493 bp, Homo sapiens
gggtgaggacacaaatccaaaccatatcagtttataaagtctattaattagaaaaacttacaaaaacttaaaaataaagtcaatttattttaaaaaattaaataaatgaaccgccaacaaatattataaatttaagtaatagatgtactgtagttcattatatttttctctatttttctgtatgtttgaaattttcatttagaaatgtttttattaaatttatttattttgaggacagggtctcactgtgttgcccacactggagtgcagtggcttgatcttggctcactgcaaccttgacttcctagtctcaggtgatcctcccacctcacctcctgagtagctgggactacaggcatgagccatcatgcctggctatatgtttccatttctatttatttaatttaaaaaattctttctttccttaatttttgagacagggtcttgctctgttgtccaggctggagtgcagtggtgtgaatatggctcactg

SEQ ID NO: 168673 - DNA, 434 bp, Homo sapiens
tgaagaccaaaggcaggtctttgccctttctccaaaccaagcagagacctctgcctcacacacaatcagactgatgatttggtgctcctttagctatgcttacagtcagttgtctaccaaaagaaaagtaccatgtatttggaagccaaataacagaatgtcaggctcgaagatctgttgtgatgactaggctaaatgcctcaccacacctgtgttggtcaactttgtgccctatggttagttaagagcccctgtctacagtggtttcccacattaggcaaagctatagatcccacatttataagtctcaatgagttctgaaggtgtttgaggagttgcaagttccaggatcattccagattgaaatgatatgagaaagtcacaggtatgtgtcttctttttcccatgtggaatggccataacttgcctctgaa

SEQ ID NO: 168674 - DNA, 449 bp, Homo sapiens
tcctgggttcaagcgatcctccctcctcagcctcttgagtaactgggactacaggtgcacacctggatgattttaaaatatttttttagagatggcctctccctgtgttgcccaagctggtctcaaactcctgggctcaagagatcctcccacctcagcttcccaaagcattaggattacaggtgtgagccaccgtgcctggtctgaatttcttgctttacatgttagctgggaagtagatgccctcaagaatggtggagcatatgagctgtccctctaggtcagtcccatggccacccagctccagccctgtctctaggtgtgtgaatcccttttgcacaacagagagcctggggaggtggaaggtcttggtgacaccttgtgagttattcacactggctgtgggtgacagagccagaggtgggagcacagagctctcacagcacaga

SEQ ID NO: 168675 - DNA, 550 bp, Homo sapiens
ttttaaaaatatttttattggggtaaattatacacaacataacttttatcattttagtcatatttaagtgtacagttcagtagcattaagtgcattaatattgttgtggaatgatcaccatcatttatctctagaacattttcatcttcctaaacagaaacactgtacccattaaacaatagctcccagtagaccccttcccctggcaactaccattcaactttctgtctctgtaagttcgactactctagctttctcatgtaattggaatcatacaatatttgtccttttgtgtctggcttatttcaatcagccttatgtcctcaaggttaatccatgttgtaacatgtatgagaatttcaatcctttttaagactgagtaatattccaccacaatttatttatccattcacctgtccatgaacatttgggttgtttttacgttttggttattgaaggtaatgctgctgttaacattagcatacaaaaatagtcttttaaacacattgttaaccactacatatacaaacattgaaatcgggaacactgg

SEQ ID NO: 168676 - DNA, 273 bp, Homo sapiens
caatttacaacctaaagtacgcccgcgagagaactgtctcccacccggaggggatcttgaggcaatggccactttacgacttgcaatggcatcagcttgaccacttggtagatacggcaccaaagtcagtcacttagaccttgcacctgctcattccctcccatgcatgccattcatgccaaatcccctttaaaattccctgctttctgccccaaaagtgaagcaatacccttaaaggcgttcaggcggccgtgaatttagtagtagtcgacc

SEQ ID NO: 168677 - DNA, 123 bp, Homo sapiens
cagtaacctggcaaagtattttaaatgtgatttgcagaagcttataggagttaatgcctcacagatagtaagtagcagagttaggggtcagcctggcttcatttacttcccacaccctgtgtt

SEQ ID NO: 168678 - DNA, 229 bp, Homo sapiens
ggacaccatggtccatatcattttgatcaaactattcaacaagtctctgtgaagttgcaaactttcccacattttcctgacttctgagccctccaaaatgttccaacctctgcctgttacccagttccaaagttagttccacatttttgagtgtcttcacagcagtgccccactctctgtggtaccaatttactgtattagtttgttctcaagctgctatagaaaactg

SEQ ID NO: 168679 - DNA, 409 bp, Homo sapiens
tctcagaaatgtcacatgatttttgtctaatgattttaaacaaacaaaccatgggaatgcccaaggttgactaggatgcaataaaactggaaatcgcttaggcttctagtggcaaagtagattggtaaagcacttttgaaatgttgacgttatacgttaatgatatgggagcaggcagggaagtgctgcttacataaaggcatggtccccggtgagggttccaccctcgggcctgggcccatggatctaagtgaggacaagcatttctgctttcgctcccaaatgctgcattttctaagaccactctggcccgccatatccccacctaacaggcagacacacacaagtagctggacatcgagaggaacacacaggaagaagaatacaccggcggatgctgacaggtcat

SEQ ID NO: 168680 - DNA, 439 bp, Homo sapiens
aaaaatacgtttagctatcagcaatcaatctattgactattgtccccaggtagcatttgctaccagtgggaaaatactccttatattttaactactattgcacacttcataattgctaattagtacttaattttccctttgctcagtgaataatgattattgctttcacctaatacaacaaagggctacctttcacaatcaattttttaaaattagccaatgatcaataggtactacccatcccgcatgaatgccttacatagtctatcaggatatactgtgttaaccactacaatttttcaagcactgttggaggtagttaactttaatgctaacataaatacaggttagctactttgattattttaagaactataaaactttgaacactttgacctatggtaagaaaatttccatcattgaacagttttaaacttgc

SEQ ID NO: 168681 - DNA, 288 bp, Homo sapiens
cttcctcctgcattcctgttttacagtgagccacagaagtctggccacagttctcactggtcccttactttattggccacttcatctgcatttcccaccctcacttacccgtatgtcattgccaaatgaggccattcacatccaggtttcattaccttccttcctggtgtaagatcccccccatgattttatcaaataaggccaaattcccccacttatttttgaagggcatttattttcctgcctttatttgaaattcctccctaatacgccttgcaggttctatga

SEQ ID NO: 168682 - DNA, 490 bp, Homo sapiens
tctcttcctgagaagttctcctgcctgcataaccattcattagggagtactttacaagcatgaaggatattagggtaagtggctaattataaatctactctagagacatataatcatacagattattcataaaatttttcagtgctgtccttccacatttaattgcattttgctcaaactgtagaatgccctacattccccccaccccaatttgctatttccttattaaaatagaaaattataggcaagatacaattatatgcgttcctcttcctgaaattataacatttctaaacttacccacgtaggtactactgaatccaactgccaacaataaaaagacttttatttagtagaggctacctttcccaccagtgactctttttctacaactgccttgtcagtttggtaattcacttatgattttctaatgttctcttggtgaattttattatcttgtaccctctttttttttttttttttttttaaa

SEQ ID NO: 168683 - DNA, 336 bp, Homo sapiens
agtgccaatcagacagcggcgatatggtgagttatatttgttctgacctcgtgagactctgtccagccccactaagaatgaaaagaacattcctacctggttcctgatatgactgctcctcactagagatcagtgtattcagaatgccaaagctctactcccagtgtcatggggaagctccaagtggcccagtcaaacgtggcaggttatcactaaccaataagagcgaccaactatctgtgatcaaggctaaatgccagagaagaaaatctaatggctgcaggggaagagaagtcactatattggaaatgaacacttccaagacaaagaaacact

SEQ ID NO: 168684 - DNA, 173 bp, Homo sapiens
aaaagaggatcaccagaggctgaagtgcgggggcctcatgagaaccgaggtacaccaggagctcagaggtggggccagcatgttctgggggtgtctacaaaggcttccggcagctcagagttcagcctgagcaaactcttgctcattcattcactcattcattcagccaaggt

SEQ ID NO: 168685 - DNA, 387 bp, Homo sapiens
gagagaatggtggaggaaggagggagtttcaggaaggagggaggttcaggaaggagggagtgggcaactggggtgactgctgctgagaaaggagaggcaaggacagagacgtgaccatgtgctcctcagtgcagagggtgtgggtgacctcgacaggagcagtctctgtcttaagagggcacaggagctcggctgaagccaagggagtagataacatccatagcaatggacaggtggggaaccagcttagtgagggcctgaaaatatcgacccactgttctttttgaaacttgatattctctaagccactgttatattataatcaaatttgctctattctcatcctttggaagtattgtgtagtcattcaattttcttttttttttc

SEQ ID NO: 168686 - DNA, 388 bp, Homo sapiens
ctcagtttcagctacaagtcctgggggctcaaggaaaagagcagttccaaaaaaaaaaaaaaaaacaaacaaaaaaacggatacttacttttatcatcatagatttactgctgttggagaaaaggattgtatgggtaaaaatacaaagtgctgcaacaatgtggtccccagcaccagtgcagtgtggtcctcctgtggggcaggtgatggataaactatgtacaccgctagaaaaggcagtgccaatttgagggagctctgagtgccacaggtgggaaacagtgctgtggcagtggtggtataaaaacagcagcttccaggagtaccaaacactaatgcaacgtcatcccctagggacttctggattggaatgagaaacttgacggga

SEQ ID NO: 168687 - DNA, 1168 bp, Homo sapiens
  misc_feature (47)..(47): n is a, c, g, or t
ggttttcccttgtagtgcctgcacagtacaaaatgaaagcatctcangagttaaccatgtctccaactgctccagaaaaaatggaaagtaatagcaccttcacaagttttgagaacactacagtctggttcttgggaacaatcaactgtatcactgtggctcttgtgttctctaaaggaaaaccatttagacagccaacttatacaaactatatatttgtccttgtgctgataatacagcttggtgtatgtctattcattctatttgctgatataccagaattatatagacgtttggatctgctctgcactcccgtcctgtggagggcctccattgtcatcatgctcagcttgaatttcattgtgtcccttgtggccgaggaggctgttattgaaaatcgagccctgtggatgatgattaaaagatgtttcggctatcagtcaaaaagccagtatcggatatggcagagggacttggcaaatgaccctagttggcccccgctaaaccaaacctcccactctgacatgccggagtgtggcagaggagtgtcttacagcaatccagtatttgagagcaatgaagaacaactctgaaggacatgtgatatccaagttgatattacagagaaacaatgacaaaagggaccagtttcattgattttaagaaatgagaccttgtaacatcagctggagttttggggctacctatcaaatcatggtgacaaactaaagtctgtttgataaaatactgtctacagagaagaacattgacccagaagagtgctttcctcttggcttctgaaggtattagaggcattcagtgaaggcaagaatgggccaagaatttctatgggccaagagacaagcaggctaaaggggaaaaatatgtgatctttcctcttaggacaggacaatactttcctttttataaaaatgagttgaggggaagtagtactgtgtatactcacggagttgtaatttttgaatttttacttcatcgatggaaaaactaatgcgtgggaaacattacaccaatctttactgtctgggttccttttctctgtagtacttttcagatttgaggctttttcttctgtttctggccttacccaacatattgttaaggataagcttagcctatgctgcaataaaaaacaactctcagatat

SEQ ID NO: 168688 - DNA, 538 bp, Homo sapiens
aagcgtcgggatgggagaacctggcgtccattgtcatcatgcattgaatttcatgtgtccctgtggccgaggaggctgttattgaaaatcgagccctgtggatgatgattaaaagatgtttcggctatcagtcaaaaagccagtatcggatatggcagagggacttggcaaatgaccctagttggcccccgctaaaccaaacctcccactctgacatgccggagtgtggcagaggagtgtcttacagcaatccagtatttgagagcaatgaagaacaactctgaaggacatgtgatatccaagttgatattacagagaaacaatgacaaaagggaccagtttcattgattttaagaaatgagaccttgtaacatcagctggagttttggggctacctatcaaatcatggtgacaaactaaagtctgtttgataaaatactgtctacagagaagaacattgacccagaagagtgctttcctcttggcttctgaaggtattagaggcattcagtgaaggcaagaatgggccaagaatttc

SEQ ID NO: 168689 - DNA, 655 bp, Homo sapiens
  misc_feature (47)..(47): n is a, c, g, or t
ggttttcccttgtagtgcctgcacagtacaaaatgaaagcatctcangagttaaccatgtctccaactgctccagaaaaaatggaaagtaatagcaccttcacaagttttgagaacactacagtctggttcttgggaacaatcaactgtatcactgtggctcttgtgttctctaaaggaaaaccatttagacagccaacttatacaaactatatatttgtccttgtgctgataatacagcttggtgtatgtctattcattctatttgctgatataccagaattatatagacgtttggatctgctctgcactcccgtcctgtggagggcctccattgtcatcatgctcagcttgaatttcattgtgtcccttgtggccgagctctaagaagaactactgttttcacgtcaattaaggaggacaaaaaaaccttgctgcaggaaagtagaataactcatctggctaagtttccaagaggctgagacggttatatggatctttaacagccccgcagccagcagatggtcagttatcacaggaataatgcagactggctgttctctatcctttcatgggcagtggaacctaaatggcaaaaatgggtagattttaggaaaactactatatctggcaaagttccttatagaatctcacag

SEQ ID NO: 168690 - DNA, 340 bp, Homo sapiens
ctgtgggctccaagaacagctccccagtgcactggccatcaactgtgtttagccaatgggaggcaccagcaggaggtcagagggcagaagaagggagagttcacagcaggagtgacaggtccctctccacatggcagcggctgggtaccccacactgcagccaatcctccccagccctggcaacactgtaccacccccatgatccatgttggctccttaaccttctctgacaccttccctaacacctctgtccacagtctcttccttaaacctcccttcctcagctgagccattagaccctgactgatgcacgggctcatgacccatctgggtgtttcgt

SEQ ID NO: 168691 - DNA, 528 bp, Homo sapiens
tgatgaagcagcctgagagacctcagagaggtagagaatctcctgctcagcagctgactctaaggctcaaagcctgtgtcactgaagaccaggagaaatataaaccaagtgcattcctatgaagtggagtgaggaaacagagtctgcactgtgtctatgctgaaagctacaaatgcagatgccctggaaggaccagaatgtgggcaagataacagcttcttacaagggcaactttatgcaacaagttccatggtggccaacagagatgcacttacctgaacaattcagggcaggcctgtagtttatccatgaaatatatacagcagttcttgcctacttcacaaggttgctagagagcaacctgagaaaacactaagtgatacttataaatgtaaagttattatttatgctcatctctctaggggctttgatctcttgcctatattcctcctttcatcaaaccaatactccctgactgcaagatgaaaacaaggatgctactgtcatgttcttacctcaaaatcatgc

SEQ ID NO: 168692 - DNA, 632 bp, Homo sapiens
ttgagccaggatgagccaggaaaaggactttcacaaggtaatgtcatcagttaaggcaaggaccggccatttacacttcttttgtggtggaatgtcatcagttaaggtggggcaaggcatattcacttcttttgtgattcttcagttacttcaggccatctgggggtatacatgcaagtcacaggggatgcgatggcttggcttgggctcagaggcctgacacaaactatatcagctggggagggttattggatcttctacaagtatgaaaagagattcaaagtagtcttagctagacaacaacgtggagtgaacccaatgacacaaaatcattcctagtgtttcgcatctaaacctagtgctagtgtctgggatgcttcaaactgacaggcttgtttcttttccttggtgtaccagtgtcctggattctcccctcccccattccaactctattcaatgcttgagcagtgtcttcctctccctcctttccaaaccttttaaataccgtgttctctgtgctccagaaaggttggagcaggtgattgttacacttgtcaaggatagatgaaaaatctgttaaattttcttctgcctcttggattggctcttctgtccaggtggttgtgtttaca

SEQ ID NO: 168693 - DNA, 134 bp, Homo sapiens
ctgacccctgcactccaggaatcctgcccatgatgatggccacactctcccttacttgggttttaacctacttcttgctcatcttccttctctcccttcccttatttctactcctctgctttcctcatgttcta

SEQ ID NO: 168694 - DNA, 114 bp, Homo sapiens
agcactgagcaaaaataatgtggttatgcagtaagtgtaatggaagggaattggtatgcatggggtagtcaagaaaggctgcatggaggaggaagacatgaacacctccttcaa

SEQ ID NO: 168695 - DNA, 206 bp, Homo sapiens
ttaaaataataacagtaggggactcactgcaacaactttagtatggatgcaatgtgcaattgcctcatgttatgctactggaatggatgatagttgaggtcagataaagtcatggacaaccaattggatcaggaaactgattataaggattaatgatggacagatgtggatctgatggggtcagggtgggcagctgttattaaggg

SEQ ID NO: 168696 - DNA, 520 bp, Homo sapiens
cgatctagagtatccctcattagagaaatgcgaagtcaaagacacaatgagataccatttcacacccagtaggatggttatagtaaaaaagacaataataagtgatggcaaggatacggaaaagctggaactctcatacactgctgatgggaatgtaaaatggtacaggccagctggaaaagtttggcagtacctcaaaaagctaaacatagatttaccatatgactcagcaattctactcctaggtatatatccaagaaaactggaaacatgtgttcacataaaaacttaatacgaatgttcacagcagcattattcataatagaaaaatgttaggagggagggagccgctgggggtgtgacaggagagactttccagggacagatttgtaaaaactgcttcaaagtcctctccaaggactttcaaggcctccactgccccctactgacaggtcacggctcgggcagagaaagctggggatggagctggcggggggaggggtggccagcacccgcaagg

SEQ ID NO: 168697 - DNA, 413 bp, Homo sapiens
attacaggtgcctgccaccacacttggctaatttttatatctttagtaaacacgagttttcaccatgttggccatgctggtgttgaactcctgacctcaagtgaaccgcctgcctcgagctcccaaagtgctgggaatacaggcatgagccaccacacccggcagagaatttcttttctaaaaaagagtaaggttcagttaccaagcccagtaactgcagaaagcaacatttctcaacaggctgagcatgaagccttaatgccctaagatatcctctacatagaacgaatgacctttttcatgcattgagaacggtactaatgtgcaccatcattagaaaaactgagaaatagtcacgccaatcatttccatgttctgcaattcagatgaggagctaagctaagaaatgctgg

SEQ ID NO: 168698 - DNA, 417 bp, Homo sapiens
actcttaactgtaaagagtttcatgacctgctgaagaaatcatcttcagaaagggagaaaatgttctcaagagttttaaaaagagcactgaatcaaggaagggcattctttttgataaacccatgtttaatcaccaactctttcacttaatagagaaagctacctcttcagagcctcagtttcataatctgcaaaacggggatgatagtacccacctcaaagcattgctctagggctagaagatggacaatgccagttgcccatgttcttatgaggcagatggtgccaaaaattaaaggaatcttctagattgcttataccaaccaatgattccacagatgaacaaactgaggccaagatagaggaagccctctgcccaagaagatttggctactacatgggaacagcaggtctcca

SEQ ID NO: 168699 - DNA, 144 bp, Homo sapiens
ctacttcatttctaatacagtgacgtagtaacagagtggatgtgaatgttaaatgagtgagtataagaaaacattgttttcctggctcagacttaaggcaagaattgtgcttttaacatatgtgtaaataaatatttctaaata

SEQ ID NO: 168700 - DNA, 161 bp, Homo sapiens
tatgcaaatagcatggtaggactaaggaggaggttagaaagatgctgccaaagaattttcagacttcaaaagggcgttttctgcgttaagttctcttagggcctgagaagataccattagctccttactgaaagtccttcatctgtcaggctaatccaagt

SEQ ID NO: 168701 - DNA, 182 bp, Homo sapiens
acacagagacattttttcccctcaaattatcaaaagaatcacgctgcatttgttaagagagcaactggcaatccaggaagcagagttttgaacatatcagaagttaggaatctgcatcagagacaaatgcagtcatggttgtttgctgcataccagccctagggatcatctcgagaagcctc

SEQ ID NO: 168702 - DNA, 411 bp, Homo sapiens
gttttgagggaaaattttgaaaaatgttgaagaagtagagcctgtaaatgctttgtagagactgtcacagagccaaggaacagatggacaacagcctgtgtgtgtcacaaagttgatatagctttgttctcaaatgctgacagtgcagaaaaccacactacttagaaacgttggtgtaaaagtctaatatagaatacttgaaaattaaatctaacactatgataaacggtaatgtgccataaacaagtaaaggatgtattcccaaaaatgcatgggtggcttaccctttataactcatcaacataagacgtcagaggtggctgggcgtggtggttcacgcctgtaatcccagcactttgggaggccgaggcgggcagatcatctgaggtcaggagtttgagaccagcctgg

SEQ ID NO: 168703 - DNA, 137 bp, Homo sapiens
agacaacaggtgtggtctggccgaggttgggcaccactcttttgtggctgcgatgaaggagctgaagcctgcgttcactgctgggttttttgccccagaacttgttaaaaatgtaatgcttctgtttggccgggcgc

SEQ ID NO: 168704 - DNA, 242 bp, Homo sapiens
ttttgaaatctagcacctggtccttggtatgtgttctctaagtgccgattcccttgatagaagacttgggtctagaccccagatctcttttgacccctgccttttctgttgcactcatagtaccataaacatttcacttttaaagcacttctctctcaaagctctttctaaaccattatctcattggacaatcataacaactttgggagacagcactagcatcagttttcccatttgtgagg

SEQ ID NO: 168705 - DNA, 228 bp, Homo sapiens
atcccaaatctgaaaatccaaaatgttccagtgagcatttccctttggtgtaacatgaacactgaaaaagtttcagtttttgtagcatttctgattttttgtgttttacgtatgtatatgtatatctgtatcttgtttttttgtttggttgtttgagacagaatcttgctctgtcacccaggctggagtgcagtggtgcgatctcagctcactgcaacactcggctcc

SEQ ID NO: 168706 - DNA, 359 bp, Homo sapiens
ctaatggtttggggattcataggcaggtagcaaagcccctcccttacatgccatacatgtatgccaggtgagggctgcaggagctgtggccagcgcttatgtatattgatctctagttgaattctcaagcccctttgatttcctccctcattgtgttttcatcggtgactttgcttctcaatgacacactgtcaccagcggtgctgggaattgtggcagagtcctttttgttagaaagcataaactcattaaatcacttcagtcaaatcacttttgactgactttcattaaatacccctaacgtccatttaatcgtccattctaaagagccttgccccacccctcaccctttttgttat

SEQ ID NO: 168707 - DNA, 124 bp, Homo sapiens
aggggaatccaatgcctgtggtcccatgaagggaagccccaggtgtcactgaccaccctggccacagcagatggccccaggaatggtctgtggggccagcgaggttctccttcccgtgaattta

SEQ ID NO: 168708 - DNA, 642 bp, Homo sapiens
ttcagggtgaggtatattcatatagccgatagagactgtattatgtatgttgtagatcagagaatcagcagaattaatgactatgaaaaatttcaaagcacaagaaccttaagagatattccaaaccccttatatcagggattgtcaatggtgacttttaaatatatatgtatcgtgagccaggtgtggtggcttatgcctgcaatcccaacatttggggaggttaaggtgggaggatcacttgagcccaggagttcaaaaccagcctgggcagcataacgagaccctgtctctacagaaaattaaaaacaaaaaaattagctgggcatggtggtgcacacctgtagtcccagctagttgggaggctaaggtggtaggatgacttgagcccaggaggtcgaggctacagtgagccatgatcacgccactgcactccaggctgggcaactcaccctttctcaaaaaaagtactgtgcactgttctcatctccaggagattctgatgggcagctattgtaggaaaacactgcctaaaatcagatttttctaacagatggaacatcttatacctataatagaagcggtagtaaacctaaatttagcgtcgtttaataaaatggtactgacgtgtctctagttgta

SEQ ID NO: 168709 - DNA, 227 bp, Homo sapiens
gtcttgcccaggccatcctctctggcttcctaagttgctcgggctgcctgcctccctcggatgacacccacacaaagcaaatatctagtgagtaccgcagggccaggttacttccccttccatttcttggtatttgccccaccccatgtcccaattccttagggaggccttcttgacctcactgcatgaagcacccacccagctattctggagtgtctcctcttctt

SEQ ID NO: 168710 - DNA, 295 bp, Homo sapiens
ctaatttttgtaattttagtagagacgggggtttcgccatgttggccaggctggtcttgaacttctgacttcaggtgatctgcccacctcggcctcccaaagtgattacaggtgtgagccaccatgcctggcctgtttactatttatttttatttgttcctgctctattttagattttggactgataatttagaatctagaatctttataatgtaagtgaaccagtggacagagaagtagtatgaagttctggcagagtgcagtggctcacacctgtaatcctagcactttggga

SEQ ID NO: 168711 - DNA, 502 bp, Homo sapiens
tcagagttgctgtattgaattgtattaggacatcattcatttatgtaatatttgtttacttaattttgtataacctgatgtgatgtaagtgaggattgcattcttcagtgcttgactcatatactttgttgaatatggttacaaattgactattttaagttgaagataaaactgtttcttccgtgggttagttgtataaaatgggttttatttcttacaaatttattgtatacccctcaaaaattccaaaatttatcgcaggaataaaatagaatattattttaaacattaacaacgaaagtcaaagttatgatgaaaatgttcttaagggtgcctttctttttgtgaattgtatggaagtgtgactctggtaatatttggactgaaacaagcatggctattcttcattcttccactagtggtttttaaccttatctgcacattagaatcacttgagaaacttttaaaagtcccagtataaaggctgtattgaactaatatc

SEQ ID NO: 168712 - DNA, 238 bp, Homo sapiens
tggtccctggtggtggggtgatgatatatgtttatgtttctttgaaggaaaagacacccattgaacattgaacctggaacaatttcaaaacagcctttgaccagaggacttatggaaaaggaagaagtaccacctggaaaattatgagacagctataaaaatcactgtattcataacagttctagagacatacatgtacaccatcaaagagaaattattccgacacttgttaaaatgg

SEQ ID NO: 168713 - DNA, 239 bp, Homo sapiens
cattatgtatatgttgtaacttacttaaccacttctactgttgggcattaatctttttctttccttatatcctgtaaaatgctgcaacatccttgtaacctttgcctcctcagctcctactagttccttaggctaaatttctctaagtgggcttaagagctggtcaaaagatacgaactactttaaggctcactatacactgctatgaaactgatttccaaaataactgttttcattta

SEQ ID NO: 168714 - DNA, 575 bp, Homo sapiens
ctagggctcacactggggctcacacaaagaccctcatgctcactccgattcacacttatattctgggactccgagttagtcagactcgcatggggaacatggggctcacatttgaactcaaggactcgctgaggacactggggttcatagtcagattcacatttccaagctggggatcacattgactcacacggggaccctggagctcactcagattcacactaggacctttgggttcacacttagattcatatgggaactttgggggttagacctccatgggtaacctggagctcacacatagactcataccaggatcttggtaggactcacttgaagtcctgtgactcactcagattcatattgggatctcagagctcacactcagactcacagtaggattctgatgttcacacttagacttacaagggtactttgggactcacactcagacttaaaaagggataccagtgctcacactaggactccatataagccaccttagctcatactcagaagcccttatgaccagggtctcacactcagacttacactagaactctaatgcttatgct

SEQ ID NO: 168715 - DNA, 238 bp, Homo sapiens
acatcctgtctgttgcggcagggcacagagcctggccggtgataagaggtcaatgaatacttgatccgcagtgtcctcatctaaactttgggttaaatcagagaagagattcgtaacctcagtccatcgatacaggagtgagcttcacagtcaagaaacctactgaaatgtctgtgtattcttccagggagagggtctgcagttgtcagcagattctcaaagggtctatgccaagccc

SEQ ID NO: 168716 - DNA, 324 bp, Homo sapiens
gaaatccaatgcttgttcaacattagaaaatccatcaatgctgtttatcaaaagaagggaagtaataagtttatttcaatagattcagaaaatgcatttgtcaaattcaccatccattcagattaaaaacaaaacaatacaaaaaaccgtgtgtaactcaactaagaattaaaggggacttccgcaaactgacaaaggacatctaaggaagatctaccactaacgtcaaactgaatagtggaaggataatgttttccctctaagatgaaaaacaaggcaaggatttgtgacgggagccctagttatgcaacaaggcaaaaagta

SEQ ID NO: 168717 - DNA, 591 bp, Homo sapiens
atggtttcattcttatggtctcccactgccatgcaaagtaagaattttcctgttttaagtgccaagcataagaagacatggtccctaccctcatggtggtcttacggcaacaattaattctaaaaatctgtgattgttctatttaataagggtgctagcctagctcaaggcactcataaagcctgtagaggagttgtgggaagtaaatttggtaggggatatggagaaagtagcaaaggaagtactgatgggggtgagctccaactctgaggaaaatgcaaatctctccagtccagcaagtttacctcctcacctccagaggcggggtggggagtgactccaggctggtttttaaactggctgccaactgctcagctgtaatgccagatacatattaattgccaacagaaagcagagacacaggttcaagttccttctcaaaagtaatacagaaacttgaaatgctaacaagtgccaccttcagccaacttaggtgaataaactttcttaaaatcagtacaaaatgtttggatgcaagtctcttagtccccagagccacagaaatgcaaagaagcatcaggggctgtgaca

SEQ ID NO: 168718 - DNA, 421 bp, Homo sapiens
cctaattactagatcagttgaagaatgaaggaagtaaaactgttgacaaaaagtactgacagctcttataagcagtttagctgtgagggaaaggagagacagaggtggttaaaggaggaaggcgcaaagtcaggaagctaccagtggaaagggaaaaggaggggaacagacatgatgggtgaagtggggacttgaagctttagagatggggtccaaagtagaaggctggggttagttttaaacaacagagaccttctgagacaacatggaaagggttaaggatgaggtaagcaagtttgcagacatggcatcttttccttacatctactggtggtcatctactaggagtgagagaatgggcttgaggagatgtgtgaaggtttaaaatagctgatgtggagagagaggtggccaggataag

SEQ ID NO: 168719 - DNA, 415 bp, Homo sapiens
ggcgactctagacgatcccatttcgacatgtcaggatatttagtagcatgcaataatgaagatgattaaaatatcaaatgtacatattccttcttatgtacctggtgttcattgatatgctttacatatacacttggttctcattatttgtggattctgtatttgtgaattcactgacttactaacgttaatttgtaacccccaaatcaatactcatggtgcttgtgtggccattcctggacatgtgcagagtgggcaaaatattttgagtcattagatgcttatgtttctagctgagctcaaacaagatggcactgtgccatactgtaaatgggtttcttctcatggacccattgtttgcattttgtgctttttgttggtgatgtcactgttaaaaatagccccaggcatagtg

SEQ ID NO: 168720 - DNA, 455 bp, Homo sapiens
ccccaagatagaataggtgtcccaacgtaaggttatcctggcagcacggtcaaagagggttgattgggagccccactgacaataagcagctaaaggaaccacttcctttccctaacaggcctgagactcccctttcccattgagacacacaaggtgactaggtggcattaacagggttgtcccatcaaaataagcagccctgcctgggaagtgctcattctccctgcaggactcttttgccctaacctagatttgccaggtggtttggcctagggaaaactcctcacacccctcaggcagcatcagcagaagcaagttggggccccagaagcaacagataaattaagcagactgaaatcgcagcataaagatcctaaggaaaattaaattgtcattggaaccacggcccacaaaagtagaccaggacctgcctcctaacataaacaagatgactc

SEQ ID NO: 168721 - DNA, 356 bp, Homo sapiens
gccaagtgtctgattccgaggtacactcttgattagccacctcatctatcattggcccaggggatggtttttccaggctcgactagcccagtttgaaaacagaaggacatggagctatgtgagcatagaccatagttgcattctttgcacctacaggaagtaaacaacatgccaatccaagtcctaatgcaaataagagcctatttgttttctgagtcaatccttcaggtattatctgtaacagatctgtggctcctctggttagactgggccttgattgaatgtgatgttgccgtcagtctagatttgtgcttacatatgtgactggtccccagatgccatacaacacttaaatg

SEQ ID NO: 168722 - DNA, 88 bp, Homo sapiens
acttgaaacccgggaggtggagacggcattgagccgagatctcgccattgcattccagcctgggctagtaagagcaatacttcatctc

SEQ ID NO: 168723 - DNA, 347 bp, Homo sapiens
atgtccttctcaggatgttggagacatgatgaaataaagacggtgatattagccccctaacggtaatcactcatgctgctcccacccatgtctacccactggaacagggagtggtggcattggggtggtacagggcttgccgaggatgttggcttatagctgtatctccaaacatccagagcatgtcttctttttcacctctcctttagaatctgcttcctcgaaccatccctttaagtgcaggaagaaagctatttttaatatgaaaattactgttccagttatctcatggtggaaattcttaatgggctcttactttgggcatctgtctggctctcagtgccagt

SEQ ID NO: 168724 - DNA, 522 bp, Homo sapiens
ggaaggaatgaacaactccagacgcgtcacttgaagagctgtaacacttaccgcgaaggtctgcagcttcactcctgaagccagcgagaccatgaatccaccagatggaagaaactcccaacatgtctgaacatcagaaggaacaacctccggatgcactgtctttagaaactgtaacagtcactgtgagggtccccggcttcattcttgaagtcagagagtccaagaacccaccaattctggacatagcagcatattgaatatactctctgtagtgggtagtattgtccatgggcatccacaagtgagggagaaggtggcacattaaatatactgtttgtggtgggcagtgttgtttacaggcatccacatgcgggagatggtagcaaattggcatttacttcccatagaaatattttaggagagaagttattagggtttttgaaatagtgtttatgttttagtgcatgccctttaacatcttcctcctagcaaaaataaaaaatgaaataaaataaaata

SEQ ID NO: 168725 - DNA, 577 bp, Homo sapiens
caagactgtgtctcaaagataaactggcacactgaatagtcctataaatcctttgcattcatcctggtgctcatgttgttctctttatataaatatatatcactgcaacctccacctcctgtgttcaagtgattctcctgcctcagcctcctgagtagctgggaatacaggcactcaccacgatgcccagctgatttttatatttttagtagagacgggggtttcgccatgttggccagtctggtctcaaactcctgatctcaagtgatctgcccgccttagcctctcaaagtgctgggaatacagtttgtaagtcaccacggccggccactctttatattttttataaaaatgaaataaaaacaaaaaatgttcaaacctaatcattaatgttttagtgagaaaacacttattggtagtacttccctgcacaagatgtatagctctgtgctgtaacaaacgagttaagacaggctcagcacttacaatgaaaaccattttgacatatgttagaatgtgaatgtggacatgtaacaaggaagagcagcctgatctcatttttattgtaaagtgtttg

SEQ ID NO: 168726 - DNA, 540 bp, Homo sapiens
ttgaaggcatttgtattggtgcattaattcctggttcataactaaattatggaaaggagacactgactgataggaagctggttctggatagatgagggatgattatgccaatatttttcagagtcccaagatgatcaaggccagctttgatctcagtctactgagtcatgctggacgtatatatggctcggtcactccattgctgcagccattggaatgctcctgtcgggggtaacagtgtccagccttacggagcaggcctgaccaccctccgatggtgtggtgggcactgggccaggagggaagctggtggggtgtggggcaagtaccaggcaaaagaagtaccaggctctaggggcagactgctggattatgactcaagttgacgcaggaagataacaaatccagtcctctccccagaggaattgagacctaggagtggccttctcacaacttcagggtgcagggtggagaataagtaaggatcagatgcaccacacataccagcagcttgtgccaggcaatgtgcctaagatgagg

SEQ ID NO: 168727 - DNA, 271 bp, Homo sapiens
gtctgcaccacgttcccatccgcagagggagaggtctggcgaggcaggggtggaggccagggatctccaataaggattaaatcaagttttgaggatgacagattccatccagggaggaagtagccctggggtgacagtggctgcgttctccccaggagttccctttcgatttcggttttgctttctcctctgtccttcggcagtggctgctttggagtcaggggcacatgctgtccctgagtctctacaaaaagcttctggtgcggggcat

SEQ ID NO: 168728 - DNA, 467 bp, Homo sapiens
ctgctttttggccctaggcagggactacgggactcagagccgccacaggcagaagccacaggctgcccgggcccataaaatttgcgtatttccttgaggttgccattccagcaagaggccatcctcctttacccttgaacacctttccctgcttttcttagataggtagagggaggcccagcgggtggggatgggcccggggtcacccagcaagtcggggcagaaggtttcctgttccagcctgagccctgttacccggtttggcgcccaggctctgaagccaggcagccaggctgcaccctttcctggctgggagcccgtgagcaggtggcttcgcctctgtgccttgggttttcctcgcccgcaagatggggttctagcgggcctcacctcaccgcacgtggtgagatgctgaggagggaacgcccgtaaggcgctcagaacagtgcctgccactaaggaggccg

SEQ ID NO: 168729 - DNA, 527 bp, Homo sapiens
tacggagatcttgaagttctgggttatgcaacattacgtttataaatttgacaccaggtgattctacactctgaagtacttctatgggtaaacatgcaacattttagaatgttcgtagcaaatggttctgtttacaagatgcttgccaaattttatgagaatgatttgtcccttttgaaggaatgggtgaattttggagacataggcaagtatatgtataaacctcaagttaaacatgttgaagatttaggacttacatcattatttctgaaattgttctgatttttaggtttgagaccactcagcataggattgtcatttaaatttagctcttctgtcacctttcctggctcatattggctcttgtttaaactgttaacaagccaggcttgtggctcacacctgtaatccctcctgcttgaggggccaaggcaagaggatcgcttgagcccagatgttcaaagctgcaatgcactgtgattgcaccactgcattccaacatgggcagtagagtgagactctctctt

SEQ ID NO: 168730 - DNA, 382 bp, Homo sapiens
tccccaaaccagtagaagcaaatattttgtcctcagccaacaagaattcctgcaagtcaatatttggaccatcaggatgcttaataataaggctagggaaaaaaaaaaaaagctttgttagatcattgtatattagcatagatgcaggagtcaaattttcagtaccctaaagattattaatactttcaggtaacgtttccaggaggagatagcaaagcctttgagtagaaggatggactaacatgcggttggccaccattctcaggatgtcagtaatctttcaaaccacaaaacctgggaaggtaaactacttgtatatcccaggaatagtcacgtgacttatagacagccttaccatgacccttcagatcttaaaacctct

SEQ ID NO: 168731 - DNA, 450 bp, Homo sapiens
tttatgaatattgtggcagacaggactagctacttatcaaaaaccaggatcccccttccataatacagaggcagtgctggaaatggctgttcagccagagaatacctttctcagccatttgtactgttctcacaatggaatgtgagtggaagtgatgtgttcatttccaggttgagattttttttaataagtggatgaaacttctcatcttttcttccccctttgctggatacattcagagaatgacaaagctctagggcagagaatggcaaactgaggcctgtgtgcctgcagcctgtttttgtaaataaagttttattggaacatagtcatgcctatttgtttacttactgcccatggcaaccttcctgctacaacatcagagttgagtagtgacaggggcagtctcaagtatttattatctgctcccttaagaaaaagtgccaccct

SEQ ID NO: 168732 - DNA, 545 bp, Homo sapiens
tccttctcctcacccaacaccaatatttaattagtcaccaatttctatgaattccacctgctaaagctttctggcatctgcccctcttcaagttatctcctatctggactatatatagccttctaagtggtctctccattccaaaatatctttcatactactcttgaaaccatcttcttaaaataaaatattagccatgttaatctcctggtgagaatccttcaagagctcccaatcaaaaccctttgatacagcttacaggtaggtactttgtgatctggcctttccctgcaaactgtccccacatatcatttattccaaccatgccaaaaaacaggacttatactcatggtggttatgaatacatagttttctctctgcctagaaagtgttgtctcttgttatgaatactaagtacgtttttgtccattaatttaacagttttagaacacttagtagggccaggcgcggtggttcatgcctgtaatcccagcactttgggaggccgatggtggaggatcacgaggtcaggagatcaaggccat

SEQ ID NO: 168733 - DNA, 359 bp, Homo sapiens
cgggctcattgtgagagttgatgaaatgatgcgtgtaaagcatctggtgcacagaaagtgctcaataaatgtatactctgattaaggcaagaacgaggcctagtctacgatgagagtcccctggggtccccttcgggtcaacccttctggatggggaaaataaacaacttcctccactcaaaaatcaagttcacaaaaattaaaaaaattaaatcattaaataatttaaaacaaatcaagttcagctgaaagccatacttcaaggccacatggtagttcctttgctgtgcttgcaattgtccctaggcctgaaattaatttttaaaaattgcgttccttttttttttgagacagggtct

SEQ ID NO: 168734 - DNA, 507 bp, Homo sapiens
aagaactcataggtgcagccatgttcatgtagtagttttatacaactggcatcaaatccaaagcatagcttgtaactccttgatgttgagaaggtgcagctgggcattttaacaatttaacagtagaatagaaaagcaaagatttcaaaaactataattatgtttttacaactttagttttaggagcattgctcattagttgctaattaatccatatatctggtgaaacagatgaatagcatgtatttggttatcatataagcattgtgaatccaagttaacatgttactttcattctttctaatgtaattattatgctattatcaatttgttaccatgcagtaatcatgcagttttaagttactgcttaaaacccagagtgaggcatagaaatttatgtcgagctggacagagctgaatgtcagccacatggtagcaagatagatgctttgcatcagggtcatttctactattataaagcttgaaaaaggatagaacaagaagagt

SEQ ID NO: 168735 - DNA, 309 bp, Homo sapiens
tcactcagagatcagctatccatctgcccccaggatcatgtggcagggaataggtcgcttggtgaatcatacccgggcttttaaccctgccacccagaagtcacacatcacttgcgttcacatttcattgggccaagcaagcgtgatggtggaactattcaggcttgaatagagaacaacaaagccacatcgttaaaccagatggtggtggtcaaagttcatggttgggttatcaagccatggttagaaacacagctgccgatatctggggctgtaacaactgcaggtctaatgatccaaggccaggaa

SEQ ID NO: 168736 - DNA, 422 bp, Homo sapiens
tccctttatccccaacacttagcacagtgctgatgctgaatgcacttcgtcagatagttgagtgaatgatagaaagttctctagcccaaggctgccgcctcccagacaggactgagcagtctggcctgcctgtccgtggcctcccagtctagggccaggtttactgtatttttcccacaattgcagaaggtcttgggagcctcttacttcccaacctggagagtcctagattaacaaccctctgagaatcaaaaccaagtcagcctcagcctgcagcccacccgaggtgggccgatgcaccctcatgaagtggccagtgtgagttttctctgcaacttacaaatcatcatcttagagagaaaacacctgctcagaatccaacatttaaaacaataacatcttggcttttatttttttgtata

SEQ ID NO: 168737 - DNA, 299 bp, Homo sapiens
tctgcccccacctgggcaagaccaaaaagaaaaactaagcagttagtgacatgcagtgcaaccggacggaaatggactgtagaatcgaaattgtagagagatggagaagaaaatgtttggggctaggataagtgttcagaatcttaaagtgaagttgtctttgtaaacctctaggcaaaaacgagctgagttgaaaattgagtaagaaaattaagctgttaggtctcctagatctacctggagggccaggctgcgaaagattggtagtgatttttgtaagtaatactcagagcaagaat

SEQ ID NO: 168738 - DNA, 187 bp, Homo sapiens
atctttaattctatttattaaataacaggatgaccttgataaataatgctgttttctcattggtgacatactattagactaagtagttcactttatatttaatcagccattatcctgagtattattagtgtgaataagaaatacttgttagaacattgggcagtggtaatcaaaatgaatttcgaag

SEQ ID NO: 168739 - DNA, 512 bp, Homo sapiens
ttggagatcccacctgatctttactaacagatgagtacttagaaagtgcagatgttaagaaatgcacaaaccaagtttcttttggagtgtagactagaaagtatgtaatttttgttttttcacaaaggacccagccttattgtttttctgtttataaaagatagtcttattaccaaaaagaagagataagtacaaagtaatagagacatataataaataccatcttaaatccaccactgagatttagtccctgttcacatttcctttatattcttccaggattttgtctaagtagcaagtcactcaaaggcttttgtctgtgccagagatggggaaaatgaaagagaagctaaaaggttcaaaaataggagaagcaatctcctatttttgctgtggcagcaaacattaggaatgaggtcccagagccatgcatagtactgcctaatgtaattaggaagccaaacctgtctgttgccttctgccactgggaatcctcaaactatgcagcttaa

SEQ ID NO: 168740 - DNA, 426 bp, Homo sapiens
gaggaggggacatatatttcaccccaaatgctttcagccttggtgtttatgttcatgaaaagctcgtgcatagcaaacaaatagtggtaagattatggtaattggtaatggagtaaaaagaaaatggtatgtaattattagagtgggcatctttgtgcctcagtttcttctttaatgataggggtcatcatactttgcattatctgctctataaatttaaaaaagacagttgactcctaaacaatgtgggtttaggagtgcccatctcagcacagtcaaaaatccacataaaacttttgactcccccaaacttaactactggttgtctgctgttgaccaaaaggcttactgataatatattcagttgattaacatgtattttatatgttacatgtattgtatgttgtattcttacagtaaattagt

SEQ ID NO: 168741 - DNA, 217 bp, Homo sapiens
tgggctcaagcgatcctctcaactcagcctcctgagcagctgacactacaggcgcacaccaccattcctggccttgtcactcgttttattgtacttaggtgaaaatgtcccattgttgaagtagttagtaagtgtgtgtgtgtgtttttcttgagagctttttcagtctgaagtcatctgagaaagaagaattttttctttttttactgggagaata

SEQ ID NO: 168742 - DNA, 425 bp, Homo sapiens
gtgaaactaaccctggctgcccgtcctgtcaagagcttcttaccccaggacttgtcactgtgatacaacttgtcatgcatatgtttcatctttggtggaaaaggctcaaaatattcctttcattccccactagcttttatttggctccttctgcaggctgaagttgcctattttaatatatgactcttcatttattcattttcagccagcaaacaatttttaattagcctgctctttattaaggacatagagcatgttattaactaggtgcatctttgggtctttaaaaggagtgaaagagacataatcaatttgcatgtgatgtgtaggggttaaagtggtgttagtcaacatatttagagcaaatctcatcaagctccatttttaagccctgactcaacttgacgatcccacaaggcagaagg

SEQ ID NO: 168743 - DNA, 624 bp, Homo sapiens
ctcaaaaaaaaaaaaaaaaaatcaaacatagaattaccctgtggtccagcaatcccacttctgggcacatatgcaaaattattgacagcagggtctcagagagatccttacacccctgtccatagcagcctcattcacagcagccagaaggtggaacaacccaagtgtccagctacagatgaacggacttgtgaattacggcatagacatacaaatgctattccatctccagagagggttgaagttccgacacacgccacacaaaaatgaacctcgaagacatgctgagtgaaacaggtcagacacaaaaggacaaatattgtatgatcccacttagacgagcgacctagaacaggcaaattcagagacgcaaaggagtctttctgcccatgttcgcctcatctaacccctgcctgcagggtctgggggaggtcagaacgggcagttagggttgaaagtatacagagtttcaatctgggaagatgaaagagttctgagatgaagggtggtgatggttgcaaacagtgtaaatgtgtttgatgccactgacctgtacagttaaaaatggctacagtgataacttccgtgttgtgcaaattttcacaataaaaacttaatgaaagg

SEQ ID NO: 168744 - DNA, 780 bp, Homo sapiens
ctcaaaaaaaaaaaaaaaaaatcaaacatagaattaccctgtggtccagcaatcccacttctgggcacatatgcaaaattattgacagcagggtctcagagagatccttacacccctgtccatagcagcctcattcacagcagccagaaggtggaacaacccaagtgtccagctacagatgaacggacttgtgaattacggcatagacatacaaatgctattccatctccagagagggttgaagttccgacacacgccacacaaaaatgaacctcgaagacatgctgagtgaaacagagtcactgtggtctccaaggttacgatcctggttctcctcctccgcctgagcggagactcagcagcaagacacacatggccgagtccttcaccagagcccctttgcatggaccccatggtgctttcctggggaatgaggctggatgccagaaacccagcccgactcctgtgctccaaggctcaagaacactcagaacacccctctgaagaccccccttgagcagatgccctcaaggtctaaccggctcaggagggtccccagagctcggtgatgctggctcagagaacctgggtaacggaaaggagaggcagcttttcccactcactgtctctgacacaagctcattctccacagtcatgtgagtttcccaaacaccttcctccctctggcgtgtctctctcaagcctcagtccagtgaatgtgatttatgaaaggccgtgaggtcaggcccacccatggcaacagcctcagccccttccccg

SEQ ID NO: 168745 - DNA, 172 bp, Homo sapiens
ctccagtggccctcctcattcaagaatgccaaggcccctctttgtctaaaggctgactccctaccagcttcccatagagtgaagcctgacaatcaacatattccaccctcaaacacagagctcaagtcagccttccttttatagcagatacccagaaggaagaccatctaag

SEQ ID NO: 168746 - DNA, 944 bp, Homo sapiens
cagtgcctggtatcacatcacacaaaaggaacaaaagcaaaacacacaaaccagcttcaacttacacttggttactcaaaagaacaagagtcaatggtacttgtcctagcgttttggaagaggaaaacaggaacccatcaaaccaaccaatcaaccaaacaaagaataaattccacaatgaaagcacgtattttgtctttttgcattttggtgtataagccatcaatattcagcaaaatgatttctttctttaaaaaaaagtggaggaaagtagaaatttaccaaggttgttggcccggggcgttaaatttacagatttttttaacgagaaaaacacacaaaaaaagctacctcaggtgttttttacctcagcaccttgctcttgtgtttcccttagagattttgtaaaactgatagttggagcatttttttttatttttttaataaaaatgagttggaaaaaaaaaagatatcaactgccagcctggagaaggtgatagtccaagtgtgcaacagctgttctgaattgtcttccgctagccaagaacctatatggccttcttttggacaaaccttgaaaatgtttctttaaaaaaaaaaaaaaaaaagatgacaaagaaaaacagagataatattggagatgtcctgaattttaatagggtacatgccattagggctttttgcactaaaggatgaacatgtactggtttatgtggacaagccattataccaccagactgcaatgccagtttcctctacggtgaaaccccgtctctactaaaaatacaaaaaatcttagccgggcgtggtggcgggcgcctgtagtcccagctactcgggaggctaaggcaggagaatggcgtgaacccgggaggtggagcttgcagtgagccgagatagcgccactgcactccagcctgggtgacagagcaagactccgtctc

SEQ ID NO: 168747 - DNA, 741 bp, Homo sapiens
gcacgaggagagagagagagagagagagagagagagagagagagagagagagaaaaagtggaggaaagtagaaatttaccaaggttgttggcccggggcgttaaatttacagatttttttaacgagaaaaacacacaaaaaaagctacctcaggtgttttttacctcagcaccttgctcttgtgtttcccttagagattttgtaaaactgatagttggagcatttttttttatttttttaataaaaatgagttggaaaaaaaaaagatatcaactgccagcctggagaaggtgatagtccaagtgtgcaacagctgttctgaattgtcttccgctagccaagaacctatatggccttcttttggacaaaccttgaaaatgtttctttaaaaaaaaaaaaaaaaaagatgacaaagaaaaacagagataatattggagatgtcctgaattttaatagggtacatgccattagggctttttgcactaaaggatgaacatgtactggtttatgtggacaagccattataccaccagactgcaatgccagtttcctctacggtgaaaccccgtctctactaaaaatacaaaaaatcttagccgggcgtggtggcgggcgcctgtagtcccagctactcgggaggctaaggcaggagaatggcgtgaacccgggaggtggagcttgcagtgagccgagatagcgccactgcactccagcctgggtgacagagcaagactccgtctc

SEQ ID NO: 168748 - DNA, 592 bp, Homo sapiens
aacgccagggtttttcccattcccgagggttgtaaaaccgccggccagtgaatttgtaatccgcctcactataggggaattgggagctcccccgcggggggggccgttctagaactaggggatcccccgggttgcaggaattcaagcgtccaagtgtgcaacagctgttctgaattgtcttccgctagccaagaacctatatggccttcttttggacaaaccttgaaaatgtttctttaaaaaaaaaaaaaaaaaagatgacaaagaaaaacagagataatattggagatgtcctgaattttaatagggtacatgccattagggctttttgcactaaaggatgaacatgtactggtttatgtggacaagccattataccaccagactgcaatgccagtttcctctacggtgaaaccccgtctctactaaaaatacaaaaaatcttagccgggcgtggtggcgggcgcctgtagtcccagctactcgggaggctaaggcaggagaatggcgtgaacccgggaggtggagcttgcagtgagccgagatagcgccactgcactccagcctgggtgacagagcaagactccgtctc

SEQ ID NO: 168749 - DNA, 216 bp, Homo sapiens
ctttttatttcggaggaaatattcttttttctaaacttcccaatttctgaggtattgatgttagtattttggagctagattcgatataaaaattgtattgctgttagtaactgcttcggtatgttggttttgccagatgtgttcacagtcttcatgatactgttaataaatatggaggtttgtgctcttattcttttttttttatttgagacggcg

SEQ ID NO: 168750 - DNA, 410 bp, Homo sapiens
tggaaagccccattcactgactacatcttatactttgttggacacactatgccaagatgaccaacactatctgcaaaaaaaaagctgggatatcaagtattttaactgaacatatagttgcctcaaacaaaattgaagtcctgtcacaaaggaggaagaagagactccagctgtatctgccacatgatattgggagagttgttgaagagattccctgagataattcatgccaaactcttggcccaatgcctgacatgtggtgactattattattagctgggactctccccattgtcttctcagaggatcctccagcaaggtgacaaatgtaaatgcagcctcctcagtgttcagggactcccccttccaccagccactttctgtctgaatctgagtcatgctcatgactc

SEQ ID NO: 168751 - DNA, 372 bp, Homo sapiens
agcggggatagcacccagggagacagggaacaggaggcccaagctacagccaccactgctgggttgcgagggcagagcagctgagcaggctccagggccccagagtgcccgaggaaaggggagagacagtgacgttatgatctgggtctccgccgtggaggcttggggggctgtgggctgtgaggtctggcagtgagagtgccccctgcagcctggcctcctgccagggaagcagccaggagcacgaaacctacttgaaggccaagctcgaggggccctgccaccaagtcccactatcggccgagggctcctgctgcactaggctccatgctggcctgccgcggccaggcagctctcccaggctccagacct

SEQ ID NO: 168752 - DNA, 626 bp, Homo sapiens
atttagcctatcctacgtgattacacagagagaatatttggaagctggtgactggttccctgtagatcaaatgtagttaagtatgacaaaagactaataaaagagattttaccaactaaatagaaaaaattgtaactttctactgggtaatgtcgaaggagaaagaaaagaagaggacagactgcaaatgttcttagacagaattcagtgtcagctttcatgaatatcaattatattccataaatctcaacagcagacatttaataatcaataacattacataaaccaatttttatagaagtcataaatgtctaaagatgcttaaaaaaaaccttctcatcaagaaagtagacagctttacaaaaacaaacagaagatttaaaactgtaatttttcacatcccatactattaacagagagaaaaagatacataaacaggaaagtgaaaaatgatagaaaagccttgtattgttttttctttggccccatctctgcccatctcattgccagtcctgaagacagcagagttcccagtgtagaactctgatcaccacagagtgtacagatcacattttgtttccacattattgcctttgtatttttgaatcagtctggggactaaccga

SEQ ID NO: 168753 - DNA, 417 bp, Homo sapiens
ttttcagatagggtctcgctctgtcacctaggctggaatgcagtggcacgatcacggctcactgtagtctctgcctcttgggtttataagatcctcccgcctcagctttccaagcagctgggactacaggtacgtgccaccatgcttggctaatttttgtattttttgtagagacaagttcccactatgatgcccaggctggtctcaaactcctaagctcaagtgacctgcccaactcagcctcctaaagtgctgggattacacgtgcgagccactgtgctcagccaagtcagtaattttggaagctgcattacacattttaggtgaaaagcaataattactgataattattcagtagctgttctttccatttctagaactatcataacagttcacatccttggacacccatgggcc

SEQ ID NO: 168754 - DNA, 397 bp, Homo sapiens
agtttccccacctgaaaagtgaaacgctcacgttggggatgtcttgggggccctctggcagtcccactcacggggtgcaagctctccatcgatgctccctgccctgaccaccaggccatgcatggccacctctggtagtcccatgtagacacagccaccccagttagggactctgcggttggcctgtgccacagtgaggttatcacacttccttttatttataccccgtaatgcagtccatcaatcaaagatggaattgtccttttctgtttctttccattaaaaggggcatttctcagctgcgtgacaaaatgagttaggagctccatttcaaacttcagtttctggagcaggttcatttaggagcatccccactgcgaaatgaaaccggaggagg

SEQ ID NO: 168755 - DNA, 251 bp, Homo sapiens
ggagtttcctcaaaaaactgtaaagtcagaccaggtatggtggtttccaccttgtaatcccagagcttggggaggccaaggtggggagatcacttggagccaggagttcaagaccattttaagcaacacatcatgaccctgtctctacaaaacatttttaagccaggcatgatatagtgtgcctatagtcttgttacttaggggcttaggtgtgaggatggcctgagcccaggagttcaaggctacagaga

SEQ ID NO: 168756 - DNA, 170 bp, Homo sapiens
aacctcctgggtagctgagactacaagcgcacaccaccatgcctggctcttgtacctttctaaatcattgtaaaagtaataacagttttcatacagaaaagccttgagccaaatataaatcatggccaaaaagtttagtctttgatcagaagccatttttgactgttcgt

SEQ ID NO: 168757 - DNA, 224 bp, Homo sapiens
gtaaactgtaaaccaacattctccaaactgcattctgcagaccctgctctcaggagaggtgttcataaactatttaggaaaacaaaaaagttttaggtcaagtttgaggaaggctagcctaaacaaagcaaactagatttcctcactctagaatttctcagagactaacttgccaatgtgcatagcaaatctccaagagcagggtagaaaacatggctttatgt

SEQ ID NO: 168758 - DNA, 533 bp, Homo sapiens
ccccttttcagaggctgcagttgcttttattgaacccgttaaaggagatgtccaatattaatcatccagatattcgactcaagcagttagaatgcgtgttgcagattctgcagagtcagggagacagtcttgggcctggatggccattagtgcttggagtcatgggagcaatcagaaatgatcaaggagaatccttgatacgaactgcattccagtgtcttcagttggttgtgacagattttctaccaacaatgccttgtacttgcctgcaaatagttgtagatgttgcaggtagctttggcctccataaccaagaactcaatattagtttaacttcaataggtttattgtggaatatttcagattattttttccaaagaggggaaactattgaaaaagaactaaataaggaagaggcagcacagcaaaagcaggcagaagagaaaggagttgttttaaatcggccattccaccctgcaccgccatttgattgcttgtggttatgtctttatgcaaaattgggtgaactatgt

SEQ ID NO: 168759 - DNA, 271 bp, Homo sapiens
gatggagaaggctgtccccaaagtccaggcctagaatctttgactggaaagactgtcctgagagtccaggcctcctctctctgactggaaagactgtcctgagagtccaggcctcctctctctgactggaaagcctgtcctcagagtccagacctcctctctctgactggaaagactgtcctgagagtccaggcctcctctctctgactggaaagcctgtcctcagagtccagacctcctctctctgactggaaagattgtcctgagagtc

SEQ ID NO: 168760 - DNA, 353 bp, Homo sapiens
cgtggtcttatgaggttggagtgtcggggtgcaacttcaaatgatcgactgtctcggcctcccaaagtgctgggattacaagcatgagccaccatgcccgaccctgttgttatttttgaactgggacataagcctttggcagttgtgatgccactgtctccctcccctgctttatttttttccaaggcacattccatgtatttcactcatttattttcactccctcactcccttagtagaataacatctttaagaagattttttttccttttttttttgttttttgttttttttgagacagagtttcgctcttgttgcccaggctgaagtgcagtggcgtgatctcagctcac

SEQ ID NO: 168761 - DNA, 143 bp, Homo sapiens
gcaacctaacaataacaaaagtaataaatcgagactggtccttcatatcctgcgtatatgacttttctgactctgacctagggaaggcaccattatccccattttactgctaaggggaactctgctatgagatgttggaaggg

SEQ ID NO: 168762 - DNA, 227 bp, Homo sapiens
tcttctggacacacctctcagaataggacaggtagggggatggtttctatttcacattcagggctagagacttcagatcctctggggtgtcactggttctgtagggactgtttgggtcattctttttttccaggctagaccagggaagcagggagagattctttttgctagtgttatgtagggagggagaccttagagatgcctctgtgagctgtgttctggatgtc

SEQ ID NO: 168763 - DNA, 240 bp, Homo sapiens
agcgcctgtgcaggtgcatggaggaggaggagctgctgagcacagacaggatgcactccaggtagagaagctgcagctgctggctgtcactgcagaagagcagaaccgacacaaatgcagacaaaagacaaggcaaaattaaagaggtgatgtgtggaaacacgctcggaaaaatggtaggcgttactaaagtgctagttttagggggacggttagtgttatgggttgaactgtgtctct

SEQ ID NO: 168764 - DNA, 299 bp, Homo sapiens
tgacaaaaagcctatacgatatgcaagaattgtattttctcaatatcaaccatcacatttagaaaaccttcagaaagcatatgtacatagtatcttatgtgtaagtgaatgagaattttatgaataaactttttaagggaattaagacaatacaatcgtctgtatctgaaataaagcagagacaaaggcaaagattatagctatggatgaggtgaactgagtatcaatacattctaagataacatagagttaatgaaatttattaaatgatcaataccagtataataaatatcctggca

SEQ ID NO: 168765 - DNA, 543 bp, Homo sapiens
ataaaacttagctgggtgtggtttcaggcagctgtaatcccagctgtttgggaggctgaggcaggagaattgcttgaacccaggaggcggaagttgcagtgagccgagatggcaccactgcattccagcctgggcaacagagcaagacccgtctcaaaaaaaaaaaaaaatgttttatttgctgctctctttcctgattttgttttagaaaaaagccagtcttttacattatcaattacataccaatcacaatattaaatatacatactttttcttgttgattccactttttagtctgcttttatgaaacctaacttttttggagttttccttttgggatggtatgtgagcttatgaaatttgagctatttttttatatttatcaagacagtctttgatttgatttaaatatgtacttaaaagtttttccattgtagtgctagctttgagttaaaaagatacctgtgttcagattcaggaaaaaatcagtatatttaaaaacctaacatttgtgcatcagtttacaacattctgagtttttaa

SEQ ID NO: 168766 - DNA, 485 bp, Homo sapiens
tggcaacccgctcgggtccccttccacactgtggaagctttgttcttttgctctttgcaataaatcttgctactgctcactctttgggtccacgctgcttttatgagctgtaacactcaccgcgaagatctgcagcttcactcctgagcccagcaagaccacgagcccaccgggaggaatgaacaactccagacacgctaccttaagagctgtaccactcaccgcgaaggtctgcagcttcactcctgagccagcgagaccacgaacccaccagaaggaagaaactccgaacacatctgaacatcagaagggacagactccagacacgccaccttaagagctgtaacactcaccgcgagggtccacggcttcattcttgaagtcagtgagaccaagaacccaccaattccggacacagtgctgagaatcatgccttgaaatctagcagctctgttaaaaactgagcaaggtgtacttcggggttg

SEQ ID NO: 168767 - DNA, 402 bp, Homo sapiens
agctctcaatctgtgtattcaactgcaatttagacatctccacctatgtcccatggtcaccttaaaaaaaaaaacttggcctcataaggtcatcatttcccctctgctccagccaaccagcacccccagcttgtggtcaccctctcacctcagtgaacagcacctcctagccagaaaccagtgtcacactgggtttcttttatttctcttatcaagtcttatcagttctccctcccaaatacagtagttcttgaaccccactcaaatcatcctccatatagggatctgcaaagctttctgaccactcacctttatcagcaaaaaaattctaggcatacctgtacccaaaataaatgcaatttataaattcagatacatgtacttctacagcaatatagtaag

SEQ ID NO: 168768 - DNA, 182 bp, Homo sapiens
ctgaaacagttcaagaggaacgtgtgcctctagccaccaggagttccagctgaagggacataccaggctcacagatctcaggctgcgggacagaagatggatgggccaccgggcagagctcccaaggggaggcaggaggggaacctggacggggcagggctcctccagcactgcagagtggc

SEQ ID NO: 168769 - DNA, 130 bp, Homo sapiens
aggaggctcacgaggatgaatctccacaaagtcaagtctgatgtgtttgacagttcctgggatgtctctacagtagctcctcttgaaatctaaagcaacatgtccacattctaaaccactttcaaagata

SEQ ID NO: 168770 - DNA, 1048 bp, Homo sapiens
catgatggcgtgcgcctatggtcccaagtactcaggaggctgaggtgggaggatcgcttgagcccaagcggtggagttacagtgagctgagatcatgccactgtactctagcctgggtgacaaagcgagacaggcgggcggtggaaggagggaaggagagagggagggaaggaaggaaggaaggaagagtaaggaaggaagggtaaggaaggaaggagcacaacaaatgtaatatgcttgaatcatctcaaaaccatcccttcccctcccaccaccaccacccatggaaaaagtgtcttctacgaaaccagtccctggtgccaaaaaggttggggaccactgccctaattcacttggtggtgtttggcaattaaatatggaactgggccaggcgcggtggctcccacctgtaatcctagcactttgggaggccgaggcaagccgatcatttgaggtcaggagttcaagatcagcctggacaacaagagtaaaaccccgtctccgctaaaaatacaaaaattagccgggcatggtggcacgcacctatacacctataatcccagctactcgggaggctgagacacgagaatcgcttgaacctggcacctggcaggtggaggttgcagtgagctgagatcctgccactgcactccagcgtgagtaacagagcaagactctgtctccaaaaaaaaaagaaaagaaaagaaacgtggaattgtggtcattcccccaacaacaaacattttctttagaaacagcaaatggacaccccacctcctgtttccattcctctctgtatacaaagtaacacttgctttcattgctgaatctaagtgtaattgtttggaaggcatttaaaatggcaactaattttaacactgtagcactcaactgaaggggtgattacatgaacaggtataaccaggttcacacctaaacaggaaatgacaactatgtcacaactgccacctggccaacggtgattacaccatctatttataagaagcatcccggcccagcgcgttggatcacgcctgtaatcccagca

SEQ ID NO: 168771 - DNA, 351 bp, Homo sapiens
cttagttaccaattacagactctaccactacttttacccccaccctttgaaaaggttttagggctactgcatagccacaaaataaggcaggaggataagttaatcacccatctaactcaccaaacacaacataggttcactgtgaatagttatagagaatcagaacattaaaattaagagtaaaaatcaaggtgtacgtcagttttgagacatggaaaatactgtttcttaaaatgaaacggtaaaaaataaaaacaatcccagcgtaaaacaaaacccctaacttcagataatcaatgtttcttcataagacacgctttgaagaaatatttgtatttttgaatggggttc

SEQ ID NO: 168772 - DNA, 423 bp, Homo sapiens
tttggtgaagcccattagcttactggttaatagtaaaagtgcatttctggcttcatattcatatacccagatgtgtattttggaggaaaatctagtttataaggtcacagacacagcaggaaaacaaaaagaaccttttattttgactatgatcattcttctaaaggagatcttagaagaacaaatgaaaatgtgaaaacaagagtacaaactcaacatgcagagctatctgtatgataagaaccagttgccaggcacctgaaaatgtcaagtcctctgaacctgaaagggttgtgagaagagtaaagagagtgggcaaggatgtgtgtcaaatggcataagataaaaccgtatcagagggagcttcatcatactctctgaggacagtacccagtgagaaacctcagactctcaatttctaac

SEQ ID NO: 168773 - DNA, 467 bp, Homo sapiens
attcacatcttgaaaataaaaatctttacatatgattttcaatgaactaaaagttcattttactcagaatggttgaagtaagtgagtgatgtcttagacttcccggattttattttgtaactatttagattgtattgagcactctggaagatgagaaatgtaattttggaattgctccagagtgagcccactcaatgctttatatgtgacagaatcagtggattcaaaggctttcactgtgtgaggtatgggaatgattaagaaaaccattagcaaaacctgctcaaggcataattcacttgtgctctttgtcaatgctccctgcacaggtgtctgcagctcttcccatcccagactcaacagtgaggagacagctctcatcttatcatgtcctattttttccacctggattacaaagccgaatgctttacaaagagcctctataatactcttgtgttctcattcac

SEQ ID NO: 168774 - DNA, 422 bp, Homo sapiens
aatattttctcccaatcaacaggttgtccctttactctgtttactgtctttgctgtgcagaagatttttagcttaatatcttaatatagttctatcagtttttcttgttttggttttttttttgtttgtttttttgtctgcacttttgatcttttagccatgagatctttgcctatactaatgtcctgaagtgattacgctatgttttcttctagtagttttgtagtttcaggtcttatatttaagtctttcatctgtcttgagtttatttttgtatacagcaaaagataggagtctggtttcatttttctgcatatggatatccaatttccccagcatcatttattgaagaaggagtccttttcctgatgtatgttcttatagctttaatttaaaatcagttgattgggaagccaagacag

SEQ ID NO: 168775 - DNA, 214 bp, Homo sapiens
aaaatgaatatatttgtctccctaccttatgaccttattacatatcatagatcttcactcttgctttagattctaaacagaaatcaatttatgtgcttgaaatcacataaaggtaatctgattgtgtcatctactgcttacagtccattggctgttcacaattatgggtagaatcttgattatttgagtagaagccttttcaggctgacattgc

SEQ ID NO: 168776 - DNA, 840 bp, Homo sapiens
caggttcaggaggctttctgtctgggttcaagtctcattaactccccttgatagttttgtgactttgagaaggtcactttatacttcaattttctcatctatgaaatagaaatatagtcgtatgtttacttcacagggttgctatgaagacaaaatgacatagccacgtagaatgctttgtacacagtcagcatcaaatgaatggtagcttccttagtcctatgtttagtacttagtatgcacacaaaataatcactgttatgatttaattggcagagacgggagcatatgtgagtctcttcattcggtcatccacgtaaatccatttatccttaagcctttcttccattaaaccactcagtaattagactatccatccattttccatccatctatccatctattcatccttccattcatctacccaaccttctaacctaccaccatccatacatccatctaacaaactgattatctatgcaacaaatggatatctatccatcaatccaacattcttcaatttagctgtttatccattcatctggccattcattcaatcatccaactatccatctgttcattcatccatctatttatctcatctattcagctatccatccatccatccatccatccatccatccatccatccatccaaacatccaaccatccaaccatccaatcaaccatcctctttattatctatcttttcatccatccatctatttatccatccatccattgttctatcccccctgccccctgccatccatcccatttatctaaccatctgttgtttcacctttccattcaaccagccatccattcaccctataaata

SEQ ID NO: 168777 - DNA, 104 bp, Homo sapiens
ataatacccacccacccatcagcttgccggggacactcacagctctgtaaagagctctcgataaggaaaatgagcctgcactgggcctccacagcctcgtcttc

SEQ ID NO: 168778 - DNA, 279 bp, Homo sapiens
ctctaccctcccatctttcatcatctggctgccgaatctgtgcgtggctgggtctccttcagggttttgtctgctttgggaaaggttggccagtttccttgggtggaaagaagccaatgatttgcatggaggaagggatcctggtggcctgggctgttctctgacctgaattggggcttctttggtttacaagggatactagttcctggagggacgaaggaggctctgtttgcattctctggcccctcccggaactagtatcccttgtaaaaaaaaaaa

SEQ ID NO: 168779 - DNA, 318 bp, Homo sapiens
agtgttggtgctggcccagggtgaagagagacagtgagagacggcctgggagcggggagaccccgacctgctttctatcttaaacagactgggaagttgctcattacagctagcttccttgaaaacaatggcaaagaatcaggcctgccttggttccaccataggagggtggaggaggtgctgtcttactcacctgcatcctggctgggcagctggcacccgtggcactgcccatggagccgtccctccctggcagctgggagggagatgaggcagctaggcacaagggtgtggccttgagaaagaaggcaagggggg

SEQ ID NO: 168780 - DNA, 365 bp, Homo sapiens
attcccgaacctccccaaaccccgccctactgtctcttcctgtttgttccctcggaccttcagctgcttcttcactgttgaaaccatgccctggaagacatattttgaactcctgaacaagacctgctcagaggggctctcctgagtggaagccactcacatgcctggccacatgctgccccctcccccgtggacaccagctgttcccaggagttgacatatcagtggctgagcagctccgtgcatatttgttctcttattttgcaagtgtctgaggttttatgacttggcattttagaaaatcctcactgtccaggttcctcaagtagaataggtcattaaacatcagcatttgcagaagcttc

SEQ ID NO: 168781 - DNA, 508 bp, Homo sapiens
gagggtcaagggcagagcaacaaggagagccagtatttagggagtgggcggagcaacaggagccaggagagaggaaggagaacctggcttcctggggtcacaggagccaagggagggcagcttcaggagagatcaggggagtgcgtgtggaagagcaccataagaatgcagaagatgctaaggccctgagctgctgggtgacctccgagtcaatccgagtgatgggaggggctgtcagcctgcagtggatgaaggaggatggcagggaagactcaaggacccttggtgtttaaggggaggaggaggaggatgtcaacttgcagaaggagctggaaggggacaagctggaagtcctaggacagaaataaatgatgaggtgcaggtacggtggctcacacctgtaatcctagcactttgggaggtccaggcgggcaggtcacctggggtcagatgttcgaaaccagcctggccacatggcaaaaatccatctctactaaaaatacaaaaa

SEQ ID NO: 168782 - DNA, 270 bp, Homo sapiens
gtggacatttccacgagtcacataaaagccctggtgtcaattcccaagagaggccatgaactctgtcaacagaggctgatcagaaacagggatccatgcctctgcctgcacagagccggaggctgcacctgatgctgcagcctggaatacctcgggccctgccgtgccctgggccacagagtacaccatgggctcaaccttcctcaaccaaactaagtcctccaggagccaggagaactggaacaagtccctgggcgactcgtggaaatg

SEQ ID NO: 168783 - DNA, 493 bp, Homo sapiens
cacccagcctggtcttaagctatcctcctgccttggcctcctaaagtgctgggattagagacatgagccaccacgcccggcctacaccattttatataaggcacttgagtattgcagattttgggatccgatgggggccctaacttagagatatgactgtacaggcattttttaaagttagaagttaccaaatttttaatccttttctttaaagtttcttcctttggtttgtttttgttttttttgtttgtttgtttgtgtgttttgttttgttttttttttttgagacaaggtcttactctgttacccaggctggagtgcagcagcacgatctcggctcactacatactccgtctcccaggttgaagtgattctcctgcctcagcctccagagtacctggaattacaggcgcgtgccaccatgcccggcttttttttttttttttttttttttttctcgagacggaatctcagtctgtcacccaggctggag

SEQ ID NO: 168784 - DNA, 351 bp, Homo sapiens
taggggcttgagagatggggactttaaggtgaggttgtttttcaatgggtacagaatttcagtttttcaggataaaaaagttctagagatgtgttgcacaacaatgtacacatagtaaacattacaatacacttaaaaacgtttaagatcataaatttcatgttttttaacacaataaaaaaagacaaacccataaaacagaaaaaaaaggaacaaactattgatacataaacctatcgatacaaaaacctaaataaatctccagacaatatactgagtagaaaagctaatcccagattcctagctgattgccattttggttttcccagtaaacaccctttctaccccact

SEQ ID NO: 168785 - DNA, 256 bp, Homo sapiens
aaataccctcaaaggtatttcctataattgaaaagtttgcccactttcctgtgttcagtataaaatctagaaatcctgcatcagaagacctggccacaaccatcacaaaaataaggcggttatctgagaggtaagctctgagtcacaaaacctccgtactgaattcaagtaattgaagacacgagtgaagaatccatccttaactacacaggaacaattcccaggagcaaacgtagattttttttttttttttttt

SEQ ID NO: 168786 - DNA, 336 bp, Homo sapiens
atttttttgtatttttagtagagacaggttttcaccattagccaggatggtctcgatctcctgaccccgcgatctggccgccccagcctcccaaagtgctaggactacaggcgtgagccaccgcgcccggcctcaacaatcttttaaaaagttcactgcatggaaacgagaccccctgtcagttactgtggaagaggccccctgtcagttactgtggaagacacaatgctgaaaagacatggtttcggccctccaagagctcatgtgttactattccttttaaagaaaaaagaaacaggcagcccgtaaatgccaaataaatgctgtctgcaaggt

SEQ ID NO: 168787 - DNA, 213 bp, Homo sapiens
cgagactagcatgaataagaacttgccttccctgcacagcccccagctgtaagccttgggaagcctggagtttgcatggggaacacagaatcaattgttggcatggcaatatccataaagtggaccttcctgtaaactgtgatgctagtttacaagatcatttcacatgcattttttatggtcaaccttcagttagcagtaacccttaacacg

SEQ ID NO: 168788 - DNA, 339 bp, Homo sapiens
cttaacaatctctttttttggatggaacactgaaatcactggcaacaaatgcaaatataaacatgagagactaagtacaacattagagctgctgcacaggacagaacaaacgaacccaaagagaaggcatcttagactaggcatggtggctcacgaggtcaggagtttgacaccagcctggccaacatggtgaaaccccgtctctagtaatacaaaaattagctgggcacggtggtgcgtgcctgtaatcccagctactcaagaggctgaggccggagaattgcttgaacctgggaggcggaagttgcagtgagctgagatcatgctactgcactccag

SEQ ID NO: 168789 - DNA, 229 bp, Homo sapiens
gactgagatgggaagattgcttgagcctggaaggtcaaggttgcagtaagtggtgattgtactccagcatgggcgacagagcaaggccctgtctcaaaaaaaaagaaagaaatggcaacttcttcattgaaaatacaagattatttaaaacagaaatgctaaaaaattgcttctaagactataatctgaaagagggaaagactgagacagatataaaaaattcattctc

SEQ ID NO: 168790 - DNA, 321 bp, Homo sapiens
tccttaattagaagatagaactgacatctcattttctaaaaaagatcttgaaaatccctttcaggtttaaagttccgtaaagtcaaaattttagtaaatactgaaaacaataggttctcctttacaagtgaagaaaagaaatcaagcctaatgtctcatctacaactctccagaacaaagatgtttaaaactacccctatttaatgtttaaggagaacaagtgattatactcttttctattctcctgcaaaatcactcaagaattataccttacttgtgaaaatgtactctaagacttggaaatactaggaaaggatgatg

SEQ ID NO: 168791 - DNA, 555 bp, Homo sapiens
aacaatgtacataaattggccaacgtcaggcaaccatgagaggagtaaaggatccaaacttgggcagctcctgaacagccctggttctccagtactgtgtcaccctgcagcagccacaatgtttcagaatgaggaacggcccacccacaaacacactgatttatccagccccaacagagacaggaagagactgtgaatgaatggacacatgaatacattttctctccaggcaaaatccctaaaagtaaaacaattattctctattgcaggcaattaactacaggcatgtgctcccacctttacccaaaacagacgcgctgaagccagagccatggtttttataggctgattccaactttgttggacaaagagactttagggttttaccttcttccctgtcaaatatttaccaaagacctttattgccagggccctaatttgaacaaacagatgccatccttgaccatctcaaggacaaatgttaacactactatcacttgactttgagatgaaaataattatttttaaaagagaaaaaagaatgttaactacatg

SEQ ID NO: 168792 - DNA, 180 bp, Homo sapiens
gaatagaaaagacagttccgggtggggaaaaaccactactgatattagagataggagatgaccatgatatgtgcagtattttgaggaattctgatacttccatctaaaatgctgatttttttaaatttcaaaactgatgccatctactagcttcttgcaaactaatgattcaaccaattc

SEQ ID NO: 168793 - DNA, 167 bp, Homo sapiens
gagccaccaagcccggctgtgatgatcattctgctatttgatgtctcactcatgccgtcttctgccatgtgatgctgggctcctcagggttgtgtcacaagccgtctcacccttgccaggctcacctctggcccgatgcactgcacatggcccagctgcccacctga

SEQ ID NO: 168794 - DNA, 401 bp, Homo sapiens
atgatcttgctgcaatccttccattttagtaaatcttaacagtgtgattccattgttttgtccccatttcactccagaagcaaaacaagtatgaaaaccaattctacttctgtttctttcaaaacacatctaacaattaagagatgaaaaaaagaaaatgagttcactgttttagagagtattcgaattttgacaacgtgaggccaggcggagtagctctcgcctgtaatcccagcactttggaaggccgagatggatcacctgaggttgggagttcgagactagcctgataaacacggagaaaccccgtctctattaaaaatacaaaattatccgggtgtggtagtgcatgcctgtaatctcagccactcgggaagctgaggcaggagaattgcttgaac

SEQ ID NO: 168795 - DNA, 380 bp, Homo sapiens
ggacttcaacatattttggagggagcacagttcaacctaaaacagcttgacttctggagtagcccatgaaagaaaaccctggcccacttctcctcctgccctctttagccaaattatgtctgtgataaagtcagaagccgcactgtaaagacctcgggtaagccagtgagcccagctgagggagaaggcagagcgccctgtgcacacggcctctatagtgactcaagaaaacgccgcggctctgttgtgatggttcttatgcaggagaggcttataaactgatgtaagagatgcttcaaattttttcttataaataatgtccccatcttctaaagcctcctagttttaaaaaacagctctgccccagctgggtgtactaa

SEQ ID NO: 168796 - DNA, 390 bp, Homo sapiens
ggagtcgtcacttcatactcatgatcaatatcatcagtatctataattgcccagatccaggaagcataactggacagtaaaagcagcatcaggttaggctgggcatggtggcttatacctgtattcccagcattttgggaggccgaggcaggtggatcacgaggtcaggagatcaagaccatcctggctaacatggagaaaccccgtctctaccaaaaatacctaaaatttagccgggtatggtggcaaacgcctatagtcccagctacagtcccagctactcggaggctgaggcaggagaatctctagaaccaggaaggcggaggttgcagtgagccaagattgtgccactgcactccagcctgggcgacagagcaagaccccgtgtca

SEQ ID NO: 168797 - DNA, 181 bp, Homo sapiens
aagttcataactactccacgcctcagtttccccatcaaatgggagcggtgacgtgcgttagctagtgcagtaggtttaggcttaggtcctggagtcccggagggagagggcaggaggcctgggtgcgagccacagcctccaccagctgagatggcttccaggccggggcatccccgcgccc

SEQ ID NO: 168798 - DNA, 563 bp, Homo sapiens
ctaatgctttttcctttccagggtgcatcaccacccatggacctctgcttatcggattagtgatgctcactgatgtagcagtcctgcatcccttttcctgcctttcttgaccacaaagaaagggatccgggctgctggattccagtggtcctttaccagtgtgtccaacattgcgtttgtgctcaggggtgagtcctagagctgggctgggttcctgagtatttcatagcaacccagctgccccgtcaagatgcattcccataaacaacagttcttatgcaaattcgtttcagagagagtgtaggtaacatggtaccatgttctaagcaaaaagccgtctcttccctaggtgatccttaatggctctggagaggatagccttggttaaaactttgttacattaataaaaggagccaatattaaaagatattcccaaatgtcttgttttccttgttaaaattgtttttaattgtgacaaaatacacataacaaaatttaccattttaaccattgttaagcatacagttcagcggcatttaacaccttcatattgtgcaacctgg

SEQ ID NO: 168799 - DNA, 221 bp, Homo sapiens
aaaaaactctaataggaatgacagaatcagagaataaagagagcaggggtaaaccaataatcaaaaggatactggctggaaattttcagatttgaaaacagacatagttcctcgtattctaaaagcatgagccacagcaagaatcaataaaactgaatcacaggggaaccggcgcaggtcaacaaagaaaaggggaaagatcttaaaatcaaccagaaaga

SEQ ID NO: 168800 - DNA, 156 bp, Homo sapiens
agcaccactcatagatcagtggaacagaagagagaacccagaaacaaacccacatatttacatccaactgattttcaataaagacactaagaacaatcattggctgggcacagtggctcatgcctgtaatcccagcactttgggaggctgaggcag

SEQ ID NO: 168801 - DNA, 333 bp, Homo sapiens
aaactttctgtagcttgttcctgaagtatcaattttataagaaaatgtatatgtaaagaattattttgctttttaaacaagcatggatttcatagagcagcagttctcaaagtatggccttgcagaccccagggttctctgagaccctttccacggaacatgtgaagtcaagactatttcataatagtagtaaaacattatttgcatttttcactgcgttagcatttacactgatggcaccggcaacagtagataaaactctgcaccttagcaccattcaagacattggaaccaatagtagtaatgatcatagttttcattaccatgtgcatg

SEQ ID NO: 168802 - DNA, 478 bp, Homo sapiens
taaggctatcttgctgggagtttgagtcacacaaatgtatgcatttgtaaaaactcattagatgtgcatgtggtaggctgaataattgctctccaagagggtcacatcctgattcctggaagctgtgaatatgttgtttcacatggcaaaaaggactctgcagatgcgattaaactaagaatcttgagatgggagattatcctgcgttatccatgtggaactgatgtaatcacagtctttataagaagaaggcaggggatcagagtgagtaggagaggtaactatgaaagcaagaggttggtgatgtgaggaaggggtcatgagccaaggaatgctttcgaaggtgaaaaaggcaaggaaacagattgtcccttcagagataccagaagaagccagccctgattacaccttgactttggcccagccagactgattttggacttccaagagaataaatgtatgtcatttaaagacacta

SEQ ID NO: 168803 - DNA, 498 bp, Homo sapiens
gagttttgaaatgattggtatcagtactttgattttagtaaactttatattgggcaatcagaaaacaagatttccaggcttgatagaattctgattttatatctgtaaactacaaatatggaaatccctgatcttgagctcagagtatgtatatgattgttaacatttgaaaggatggaatttttattagaaaatatgcatcatattttgtgcaagatattctggctgtcttttttaacagattgcttcttagagcagtttttcttaaggaacttattacacacattcttatgtttcttgaataatttaaagcattctagaaattattttgggtaatatcagctataatagaactatataggagagtttattcttatgaagtgcagtgtaaaagttatttgagctggaggaattaggtaacttgaaatcaaaaaaaggtaagcacgttaggagaggaaagtatcaaataggttgctcttctcctaacaagtagactgg

SEQ ID NO: 168804 - DNA, 276 bp, Homo sapiens
gatgggggaggtcacctcatgtcggggtgatgaagggggacttcatggaggagtgggacttgagatacactgtgaaagttgatgccagaaacttcacagaccttgctgcgtggtgcctgtgcattgtggatactctctgtagggagttctggttatgagacaagcttggggtctagtatggtcagagcaagatataattagccagaagagaagggcttgacattgaatctgatagttagtattgctgtctaaatggtgtcacctgagtcagcagta

SEQ ID NO: 168805 - DNA, 113 bp, Homo sapiens
cccccttggcctcaggataacatccatgttcttagctccacttatgaagtcctctgtgaccaggcctcactcacatcctgacctcttctcttctctcatcccctggccacccc

SEQ ID NO: 168806 - DNA, 372 bp, Homo sapiens
ctagccccaccccaccagcccaactcgaccactactctgctctctgtctctctgaatgtgcctcgtggacatttcacatcaatggaatgccacagtgtgtgatcctctgctacagtcttctctcactcagcatcatgttttcaagggtgatccatgttgtggcacacgtcggtacttgaaaaaacagtgaaagacaattttccctaagtagtaaaaggcaacttccctaaatgatccatttgctgaaaattcaacacccttcggttggtacattcattgagtttccaaaagtaaaaactaaaattttaaaaaatcattaagcactaaacaatgaaaattttaagtaaactttttttttaggacgatgtctca

SEQ ID NO: 168807 - DNA, 274 bp, Homo sapiens
gtaacaccaaagagattaagcacagaaagtgatattgattaaaaagttgaaagtaaaatctaccttggctggaactgaacattcagatccatctctagaggaaaatctaacatgaatcatatggttcctattttgactagttcatagcatatcaattagcaacttatgacttgaaaatactttttctcagctgcatttgactacctaaaatcctaccgagcacgctgtttggcatgtcttactcctctgaaatcatcatctactttctaaaaac

SEQ ID NO: 168808 - DNA, 522 bp, Homo sapiens
tccctaatatttgggcaccggtatccactgtttgcggcaaataaacattcaacagtcttgatgctgaatgccagttttaagggaaatttgtgtctatttatggctatgaagtgtgggtaggtgggagatgattccatggcaagtcaaacttgcccaaaattcattgagaaaaagctcttgatcactgtgtctcaacaatcagaagatgtctgagttggaaagtatctattttttgtttattttcacagataaaaggtatagaatcagccccatggaaacaccttctgtgcctaaatatattctatgcctcctgcaagtaaacaaacaaatacacaaagaaatacatgaacatgttccaggaaacaaaccaaaccaaacaactattttccatatactcctggcttttccatatactccagaacttcgcttctggaggcgaatgttctcaacagctacacagagttctgtaaaacccccaaatgtgacatgtgcctgtggctgctggcatcccttttccctcca

SEQ ID NO: 168809 - DNA, 356 bp, Homo sapiens
tgtcaaaacttagttctttgaaagaataataaaactaacatctaacaaaagcaaacaaaaagaactacaaaaaaaagcaagagagacaacagatgttatatagattaatcatacatgaatttattatgagttactttatgctaacaaattcggacatagggatgaaatgaacaaattcctttaaaaaatgaaactgaaaaaaacagaatcaagaagaaatagaaaacctgaatagttttgtaagcaataaagaaactatcagtagttaaaatgccacaaccatatgcttttatgggcttgttcaaccagtcaagaaataaatattacaccaacaattccagagtctagaaaatgtg

SEQ ID NO: 168810 - DNA, 391 bp, Homo sapiens
gtgggtgtgctgggtatgatctgtgggtgtgctgggtgtgatctgtgtgtgtgctgggtgtgatctgtgggtgtgctaggtgtaatgtgtgtgtgctgagtgtgatctgtgctgggtgtgctggatgtgatccatgctcggtgtgatctgtgggtgtgctgggtgtgatctgtgtgtgatctgtgcatgtgctgggtgtgatctgtgtgtgtgctgggtgtgagctgtgtgtgctgggtgtgatctgtgtgtggtgggtgtgatctgtgcatgtgctgggtgtgatgtgtgtgtgctgggtgtgagctgtgtgtgctgggtgtgatctgtgtgtgtgctgggtgtgatctgtgtgtgctgactgtgatctgtgtgtgtgctgggtgtgatc

SEQ ID NO: 168811 - DNA, 207 bp, Homo sapiens
ttcatgattacaatggcctttactttcattcttctctatttttctatggtcatacttgttctttacatcaactggagatgttctgcagcagaaactagtatgctgttttctgatcatagcctcttctccctttaactctgttattcgtaagatgtcactttaagcaaatgaagtttactagtccctctgcaactgccttttttgccc

SEQ ID NO: 168812 - DNA, 525 bp, Homo sapiens
  misc_feature (431)..(431): n is a, c, g, or t
aaaaatgtttctttctctgtgtgtgcagcccactttaaaggaaagggtgctcagagcacacaattataaacagatgagtatgaacttaacattttgccactctccttattccacattcacccaagttaaagcaaattatatattaacctcaatcccacagttttctgccagctccacaaccttgggccgtagtgaggaatcgacaacagtccacagcagcccagttgcaactgcaacaacaccctcgcctgcccgctccacaacctcaggcctcgttgaagaatctacgacctaccacagcagcccgggctcaactcaaacaatgcactttccctgaaagcgacacaacttcaggccgtggtgaagaatcaacaacttcccacagcagcacaacacaacacaatatcttcagctcctaagcacatatctgnccttgttgaagaactaccagctacacagcagcccgggctcaaatgaacaacaacttccctgaagctccaaactcaggcatagcaaggaggtcac

SEQ ID NO: 168813 - DNA, 236 bp, Homo sapiens
ccgtagcctacaagactgcaagaatcctagcccgccacacagcctgccaggtggtgcctggtctgactgctgcggtgtgaggcaggtgtgttgctgccgcccctgtaggtgtgagtcccagcctctgtgtgcagcagcgtgcaggtactagccagtgtttcccagtttatttttgtcagaagtagtaatctgccgcagcaaggcccggccagagccagaatccgagcttcccctag

SEQ ID NO: 168814 - DNA, 521 bp, Homo sapiens
agccatctcccttactggtcagggcttaagacaatccatgcttgatagttccctggcaactattggcacagtgttgggcatgagaactcatgggtcaaataagactgaagagaaggatttttgttctatggttgggagagtttttgtcccttgctcactgaacatgaacaagaaaaaatgtagctctagatgctgttgacagtcaatttgcaatcgtgaggaaagccagcctggtacaacaccagcacatgcagaagggccaagctgggaacatttcagagcaacagagcccaggctatgatgtgcctagactttctgctatgtggggtaatacatttttttttattgtttgcacctctgtgggtctaacacatcttaattgacacagaaccttaaagaaaataagaatcctgtggtcttgccaggtatagtagagcttctgaggtaggtttgcatggggaaaactcagattttcaatgttggctgtatttgtataatgcagttaaagtgtttacttctta

SEQ ID NO: 168815 - DNA, 220 bp, Homo sapiens
tatgcagggggaggagcatgcagggggaggagctatgcagggggaggagctatgcaggggggaggagcttggtctcatgttcggggtggaacttgggattctatctgggaggcgagaaaccagctagcgggactctctctcgctttgctgagagtccctgtttccctttttttccttcttgcccaataaattccatttttctcactcttcaaagtgtctg

SEQ ID NO: 168816 - DNA, 604 bp, Homo sapiens
  misc_feature (506)..(506): n is a, c, g, or t
  misc_feature (541)..(542): n is a, c, g, or t
tccccaccaatgaggaactgtgagtcaattaaatctctttcctttataagttacccagtctcagatatttctatatagcagtgtaagaatggactaatacagtctgaatggacatttcttcaaagatgatacaaaaatggcccatgcacatataaaaagatgctcaagaatgttgaatgttggcccccactctcttctggcttgtagggtttctgccgagagatccactgttagtctgatgggcttccctttgagggtaacccgacctttctctctggctgcccttaacattttttccttcatttcaactttggtgaatctgacaattatgtgtcttggagttgctcttctcgaggagtatctctgtggtgttctctgtatttcctgaatctggatatgaaatcctggtttgaaaattcttttctttaagaatgttgaatgttggtccccactctcttctggcttgtagagtttcttctgagagatcagctgttagtctgattggnttccctttgtgggtaacccgatccttctctctggnntgccttatcattttttccttcatttcaactttgatgaatctgacaattcctcatcctgggta

SEQ ID NO: 168817 - DNA, 331 bp, Homo sapiens
atctggggtaaacacacggatacccagagccaagaatggggctgtgggataaacacatgctgaggccagctttaatgcaatcagtcccagtgtccaggaaaggggtttgtgacaagacataattagtcctagcatgcagccaaggagcatgtcatgggcacagcttgtcctagcacttaggaaggcacctgtctagcaaagggaatagatctcagtgtcccaccgtgggtttggagagaggccacccgagcacggggctcctgcaagcatccccggtgatgtgcctgctacttgttgaagaagaagattgaaaacatctctagttctcagc

SEQ ID NO: 168818 - DNA, 269 bp, Homo sapiens
ttgcactccagcctgggtgacaagagtgaaactccatctcaaaacaaacaacaaaccacccatatctagtgaacgtacatataagtggaccatacacaatacatttttttttttttttgagatggagtcttgctctgtagccaggctgtagtgcagtggcatgatcttggctcactgcaacctctgcctctccagttcaagcgattctcctgcctcagcctcccaagtagctgggatttcaggcgcgccaccattcccagctaattttt

SEQ ID NO: 168819 - DNA, 137 bp, Homo sapiens
acaaacatttgttaaaagatattattttgctttacactttttctctcagaaataaacagatgcttgaattcccacagtgctgcttgagcctcacaccatgtcatcctgccaggcacccagatccagttctagagttt

SEQ ID NO: 168820 - DNA, 844 bp, Homo sapiens
agtgaatctgtctctctagtgtgagcaggatgttcctctttccttgcaaagctgtaagagttagaggcccctgcatggccaggggctggccgtcttgctgcctgcccactttagggtgtgactgtcttgttccccgcccactttgggggtgtggccgtcttactccccacccactggggggtgtggccatcctgctccccgcccactggggcatggccatcctgttccctgccctctggggagtggccatcctacctcctgcccactggggcatggccacctgctccccacctactggggttgaccatcctgctccctgcccactggggctggccatactgctccctgcccaccgggggtgtggccatcctgctccctgcccactggggctggccatactgttccccacccactagggctggccatcttgctccccgcccactgggagcatggctgtcctgctccccatggagcagaacaggtggggcctggagagggatgggcccaggggctgcacaggctgccaacaggtccaccgttgctggcttctgtgtggcgctaactcacgatctctcacagggatgcagccaagatgctggccaggtggggctgccatcctctgaaggcttggctggggctggagctgtgtggacagcacatggtgtctgtctctcctggcagccttggcctctgtgctgagcccaggtctctgtcacaggctgctgggctctgccccgtgggccccagctttcttctggagggctgtggttagagagacttggcctgccctggacctacagaacttctcttctatggggtagaggtggatctaaaaacgtgacca

SEQ ID NO: 168821 - DNA, 245 bp, Homo sapiens
aaaaaactataaaatacttagcaataagcttattataagatgtaagatctctacactaaaactgaataacattgatgatgaaatttaaatggtgagatatactatgttcatgaatttgaagatctgctttgctaagatggtaattctgaactgatctatagattcaatgaaatcccaatcataaccccactaggtttttgttgttgtttttaaagaaatagacaagctaatgataatttatatgg

SEQ ID NO: 168822 - DNA, 360 bp, Homo sapiens
tatggtgatacttgacattttccattctccctctaaaacatactatttaagcatctcatgttactatattcccactagaaaattatctacaacttgggtgatttttgacaaaagctttaggaaaaccagggaaatggctccatgtcctaaggccaatttgacttttattcccttttagctaaacctttccccaaaatgtaggttttggaacatattttgctacatacacatagacttatatttttagtttaacatggactagatactgcaaaactggttttgaacaggatgtttttattacataatcttttaagtaaccttaaattttgtgtcgaattaaaagtaaagggcctagagcag

SEQ ID NO: 168823 - DNA, 204 bp, Homo sapiens
ggaagctagggtgacctttaaaggcaaattcatgacctagtgcacatataagctaagctaaacttggccaagtctcctaacatggtgtttatacaagtcttttctgttacatgggagtgtaaaaataagtccttcatgaaatacaaaatatttcttaatgagaatgttctttgtttcaaaattattgatggtcataactgactt

SEQ ID NO: 168824 - DNA, 342 bp, Homo sapiens
ccatttctcccatccaagtactaaccaggcccaaccctgcttggcttccaagatcagaggagatcgggcacatccaggatggtatgtctgtagagtgttctgctatttctttcccactattccatccatttttttctaagagaagcaatgtctatagatacaccaacatctcctaagtctctcgtcttctgtcctactttcccaaaaataatagtcttatcttccttaaaaagggaaaggtcaaataagtagaaaggtgaggattttggtccctcccacagtggcagaccggagccctctgtctatatcctgggcaaactgggcagggccattcagtgccta

SEQ ID NO: 168825 - DNA, 134 bp, Homo sapiens
agctccaacttgaaaatcttcataaccatagtatggatcttcatatccaccacgatagttatggtaatcataaccataataatcataataatcttcatatccataataatctggaggatatccataaccacctc

SEQ ID NO: 168826 - DNA, 411 bp, Homo sapiens
agagtgtcgtggtccattcagggacagccaatgtcctgtgacctcagggcacttggtgggagactgctctaggggctcggacctccagcgtctcccctctggggtcccctaaagctgtgggatgggcctcccctgcccctcctccccgtcttgcccagcaggtgagcttttcccgctccttggagcctcgaggggccgggaggcaggggaccagcttgcatgggccaggctgaggagcctccagccccggctttgatgaccgagcgccctctgtcctgtacccaccccctgccgacttcagcggctgggaaagcaaaaagggccttttctccaagcaggagctgtggccaactcccgcctgacaatggggcatttatgtggagggagggcgcccctcctgtggccacagcc

SEQ ID NO: 168827 - DNA, 168 bp, Homo sapiens
aggtaattaaatatgtaccaaagatctatgtcttggcctttggcaaatttaacagtaccagtctaaagaaagagaaacaaataatatggtaggttagatgtcattcaaaataaagtttcataactgttctgttgtaagtataaactacattccactataagaaattta

SEQ ID NO: 168828 - DNA, 550 bp, Homo sapiens
atttgtttgttttgtagagatggggtctcactctgttgcccaggctgctcttaaactcctgggctcaagcgatgctcccaaagtgctgagattccaggtgtgagccactgcacctggcccctgtcctgcattttacagatgaagaaaacaagacactggtaggttaggaacttacccctcccaacaaatgacagagccaggattcagacccaggtgatctatgtgcttatgtttttgaccattatgttttatgctttcttacttttctggaagtgacaggaatttgctagaagggtagggccagaatcacatgtagactcctaagaacctggtattgaatcattgatattttgaagcaagggcataatttgatcatggtcatgttttagaaagagaaccatggcagtggtgtgtaggaaagaaagagatggaggggaaggaggctggaggctggaggctgggaggccagttagaaagcagttactacagacctacatggagtttggagtttgaaagcagacggagggggaataaagacgagagaacaaaa

SEQ ID NO: 168829 - DNA, 480 bp, Homo sapiens
accacgcctctattaaaagtacaaaaattagccaggcggtagttgcgcacgcctgtaatcccagctactcagggggctgtggcaggagaagcgcttgagcctggggaggcagaggttgcagggagccgacatcactgcaactccagactgggtggcagagaccctgtctcaaaaaaaaaagagttctcagtgaatgttgcatggttacaagttggagaacagaatattctgttattggaggaagaaatacactgatgcgcataatcacaaagcaatgacataggtgtttgctgtgttctcaggtataccactccgtgttctgataaactttctcagttttgctaatctggtttaaataaaagggactaaaatctgagatttgtaatgaaaggagggggtatgccctcaaaatctctgaacatatttatctgatcttacaaatttgtcaaaattgagctaagtttgtactacttggagttt

SEQ ID NO: 168830 - DNA, 356 bp, Homo sapiens
cagggccccgtgtggccctgagcaagtcatcctgggcacaggctccagcccagggcacctgctggggcctcacctctccagggcctggggctgctgtccagccttggcagcaatgacccctgtcctgccaccagctggggcccttccttctcacccttcagcccgggcaggcatctgcagcccccgcccatcacgcctcggtcccctgactctcccagcagctttttattggctgcgggtggttggagggggcaggcaggggtgcccggccagtgccttggcagctccctaaggcccccaagaccctgccctggcctcccaaatccgccaatattagaaaggatttgtgtccccga

SEQ ID NO: 168831 - DNA, 325 bp, Homo sapiens
acctcctccctggggagagccacggtcagagcggcctcctcccaggacgaagtgttgggctttggggctcagtgagagggatgtgcccaagggagggaaccggatagggtgccaggaaacccttcagagcgcatgtccttatgagctggagacgaagctgagcaaagtgtccacacacacgtgcaccctcgcacacgcatacacatatgggcagccccacgcggcggctacccccacggtgcacgctcacactctgtgtgtgaaggcgcacctggggtctaggccacagaggccggccgggtgcctgcagacaaaaggtggccgt

SEQ ID NO: 168832 - DNA, 230 bp, Homo sapiens
cagctttatgatacacgcagggaacaacagatcagaagaaagggggacaaggagagaggggtagattcagagagtgaggatacacagagggctcaaaacatgctgctttacttcatagttcagcctctgtccctgcttctaacccagtgcctagcacagagtaggtaccaaataatgagtgattcattgattaactgatcaatgttaaggaacaagacagggtggtatga

SEQ ID NO: 168833 - DNA, 543 bp, Homo sapiens
taggtcggtacctcacttatgccggggcagatggtgtttttaatctcaagataaactaattttcacctatttccttatcttccatatacgcctcaagaaaaacccatgtgtattgagtggcctctctatcccacagcagctctgggtattttgcaaaggatattacctgagtccccacagtcccctatgaggcagatggtgccatctgcagtttacatatgaaggagggtgttagggtgaggttaaggatgttgcctgatgtcccagagctggaatgggggcccagcatccccagacagagcgctcagatctccagacattgccaggtgccatgccttcaacatggcagctggcagatctggactctcccttcctcatcttcctggcggtgcctcctccaggcaggcttgtgctccacctttgctggagctgttgggcagagcttgctagtgatgtcctgtatctggtctgggggcccttggcttcatctggaaacttggcttcccctgatctcccatccacgtgccacatcgactctcttcc

SEQ ID NO: 168834 - DNA, 160 bp, Homo sapiens
taatactgtattttttctgcaccttttctatatttaggtatgtttaggtacacacaaatactcctcattatgttacaattgactgcagcattcagtacagcaacatgctatacagatttgcaacttaggcacacacaagcggctataccatacagtttag

SEQ ID NO: 168835 - DNA, 286 bp, Homo sapiens
acatgttttcaggttcacattaattttgacatttagggaatgctgctgacataggaaagtctcatacacctataaagttattttgccattactgtagattaagttgtaaaacaagggtagagccatcacattgaaattaatttagacaggaagaatctatataaatttgatgcatagcaaactctgacataatttggtttattttgaagtctggcatatttttcatcactttttattttacgggtaaatcataatatatcatatttttcaataaaagtattttctt

SEQ ID NO: 168836 - DNA, 405 bp, Homo sapiens
cttatagggccagactgtacatattttaggcttgtaggtatatgatgttggtcacaattattccacctcagctgtttactgtgcaagcagccataggcaatgcataaacaaaagggactggctatgtaaaaataaagctttacttataaacaggtggcctaggggccatagttggttgacccctactgtagaaggttttggtagtgatagtttttttggactcaaattattttgcatgcacattagacaacagagttaattcaatattatatactaaccaaagtgaaataataactcacaagaaaaacacctttgataaaaaaatcagaatgacacatcaaacaatctgaatacgaagaattaatgtgagctctatgactatctctagcatcataaaactttcaa

SEQ ID NO: 168837 - DNA, 321 bp, Homo sapiens
tgaggcaggagaatcacttgaacctgggaggcagaagttgaagtgagctggattgcgccactgcactccagcccgagcaacagtgtgggactccatctcaaaaaaaaaaaaaaagagagaaattatccagtctgaacaacagagagaaaatattctgtaagcacaaacatagcctcagggacctgtgggggtataaaaaagagctaacattcatgtcactggagttacagaaggagagaagaaagagggaggggcccaaaaagtacttgaataaataacggctaagaactttttaaatgtggcaagagacccaaaactgca

SEQ ID NO: 168838 - DNA, 480 bp, Homo sapiens
ctacactgtcagctgtgctggttaaagactaacagcctacttaatgccgagcctgcctttatccatcagtccagtagacaggttcttcccgacagactgcgcaagccaggaggggagaattccacatctggcctcctggaggggtgttgggagcaacgtgcatttgccttggttgaatccacccccaacaacacacagacacaccacaagaggctggagagtgagatttagtcattatttccattgcaaaccatttctgagcatcattaaaaatcttcacttgagtttgtgcaaggagggcaggtgcaccagaccgtgaacaagcacattgtcagcctggccttgtctgcccagtcggcctcaacaggagacaagctagaatatgcatgagacagcccgacttccccaggggagctcgaaagtgacgcgaaccccgcctgggctcacccagggctctgcctgcctcgacaacccttccct

SEQ ID NO: 168839 - DNA, 313 bp, Homo sapiens
tgtgagctccttgatgccatcactggcctcaggatttcatcaaacctccgaaccccctcatgattctcgatttggctgataatcttgatgagcactgtaagctcctggagggcattgattatatttatcttcttcactagtgtaaatccagtgtctataagtcttactacataggaggttctcaatgaatgaagtgttttttgaatgtatgaatgaaaataaattattggaaaatgaatgaagggtaagagttggaaaagctttcagagaacatttagtctctctcctttttttaacagtgtggaaactgagt

SEQ ID NO: 168840 - DNA, 547 bp, Homo sapiens
cagaatcacttccatcttagcccagcagtaggcatactccaggatgccaggcaatcaggcagagctttccaagcaacttcctggggcaccctggggtgctgggtagaccaaggaatgggcaagggcccctgtgggaggctcagttgacatccacggatggcctgcacagcagggccgggaggaccagcactgacttgctatcctagaacatacacacagctacacctggattctcccctgaccaacagcccccgaccacccacaaccacttctttctacttccttttcctcagctgacttgagcagagggtgtgtgcacatatgcagcccacttccactccttcccctggggccacctgcacccaccctgccctcgtgcccacctccttctcagacactcccatctcagccccgtggagagtcctccctccaccttcctcaccaggacccagccggagcagtgaggtactggcctctttcccaacaccaccaggccctgcgcccccagacccatgcccctgttttgcgtttcttggcaggatttccc

SEQ ID NO: 168841 - DNA, 357 bp, Homo sapiens
cagaatcacttccatcttagcccagcagtaggcatactccaggatgccaggcaatcaggcagagctttccaagcaacttcctggggcaccctggggtgctgggtagaccaaggaatgggcaagggcccctgtgggaggctcagttgacatccacggatggcctgcacagcagggccgggaggaccagcactgacttgctatcctagaacatacacacagctacacctggattctcccctgaccaacagcccccgaccacccacaaccacttctttctacttccttttcctcagctgacttgagcagagggtgtgtgataaatacagagcctacagacccatgccgcaaatcctgtgg

SEQ ID NO: 168842 - DNA, 329 bp, Homo sapiens
ggtcggtcatggaacccgagcgtgcatggacccccgaccacccacaaccacttctttctacttccttttcctcagctgacttgagcagagggtgtgtgcacatatgcagcccacttccactccttcccctggggccacctgcacccaccctgccctcgtgcccacctccttctcagacactcccatctcagccccgtggagagtcctccctccaccttcctcaccaggacccagccggagcagtgaggtactggcctctttcccaacaccaccaggccctgcgcccccagacccatgcccctgttttgcgtttcttggcaggatttccc

SEQ ID NO: 168843 - DNA, 239 bp, Homo sapiens
agttaagaacatcaattgaaattacttcaaatgtcctgaaaattcttaatttctcagattaatgttttaattaaatggttgatctttggtaacgtgcaagagtactataaaaccactttctttattttactagctacagtttttctaagtactacagttaatgcttgatgcctgtatttggaacacagagcttccctggaggaaaagattggctttgtcctattttctctctttttttt

SEQ ID NO: 168844 - DNA, 440 bp, Homo sapiens
ccatcaccatcaccatccaaagtcactcagcccatcaccatcactatccaaagtcaccagcctcttcaccatcactatcaccaggcccttcaccatcatccgaagtcacccagacccatgaccatcaccatccaaagtcttccagacccatcatcatcaccatttgaggtcacccagacccatcaccatcaccatccaaagtcacccagcccatcaccatcactatccaaagtgaccagcccctttaccatcactatccaaagtcacccagacccatcaccatcaccacccaaagtcacccagccccttcaccatctccatccaaagtcacccaacctgtcaccatcagcacatcactggcttcctcccctcagtgtgcgcctcagtctgaagtgatctcacttacttgtttgaggttctcactgctgctggccccgctg

SEQ ID NO: 168845 - DNA, 312 bp, Homo sapiens
aacttggttgggcttaggaaggtaccaggagagtgcaccttctagtacttgaaatgtccctccattttgaggacacaggagtggcctacctttcatctaacaaagacaagagaattgaacgctgattgtctttgtctttgaagggtttattgctttacctcttcacttcacctggctttggcacctctgtcatttcttcatttactgttttttctagcatacttttaacttctttctgtactttctctttccaactgctgtccacatgccacctgtgtatagaatcccaagaaaacataacccaccagatcg

SEQ ID NO: 168846 - DNA, 329 bp, Homo sapiens
agaaatgaggatgccagagaccagcctgacggagccgccccagaggaagggaaccccacagagctcccgggagtgggaagagctgttgacccggctggggcccagggacccagtgcagcagcagcagcagcaggcagaacctcgcagggcggaaaggatgccggctgtctcagctcagttcggtgaacacctggaccaggtggaatggtgaaattagaggcagatggagttaggagacatccaaatgtgggattggtaggacatggaaacgggctcacagcctgcttcggttatgtctgagtgcaaatcatggcgaatcttcacagccg

SEQ ID NO: 168847 - DNA, 487 bp, Homo sapiens
cactaacggctcatttttctcagttcctattacctaatacagcatgtatggctgtcaacaaaaaagtacaaggtataccaaaaggcaagagaaaacactctgaaaagacaaattgatgatcagaaccagactcagataggacatagacagggaatttaaagaagaagacattgatgcagccaagaaacaggaaacaaagctcaacatcactgatcattagagaaatgcaaatcaaaaccaccgtgagataccatgtgttgagggcccaaatggaaaaaaaatagacagtatgtaagaacagatggataaagtaagcagacaaatggaaactgtatgaaggaatcagaaggacatgctagaaataaaaatcacagagtagaaaggaagaatgccttcaatgagttcatcagtagactgcacatggccaaggagagaatcagtgagcttgaatacagatgaatataatgtcccaaactgaaatgtaaag

SEQ ID NO: 168848 - DNA, 398 bp, Homo sapiens
ttataaattgaatcagtttaatggggttggacatacccagacctttaaggaatttcaggaatgaagggctgaggaataccaggctgaggaataccaaacatttttagagaagtttagagacagaaacgtattttaaaaagttgtcgttctcttggcattaaaactaagcaaggcaaaaagatccccagattctgaattgattaaaaggcaaactttaagtcccatttttttcttctcatgaatttttagcatttattggaacatcatctgagcctgcaactgtggataagctaaaacttgctgagcatatataaaaactcacaatatggttcaaggtagaaacaacaataaaatgaaattcaaattaatcaattttccccagtgtctatggaggtggg

SEQ ID NO: 168849 - DNA, 568 bp, Homo sapiens
agagcaatgcatggtccaaaatgtaatttagtgattcatttaagtaggagatggtcaaatatattgtaaatgtgcaataaagagtggcttttaatttttttaatgtctgaataaagtattgttataaataggcttatcgattttagaaagaaaacctgacatttttaattacagtaatcattaatttttttcattattaaaatttaaaaataagagaactgaatcattagaacatggaattggggcaggtaacccaattcaaaaaaggaaaaactggagcagagacttaagcttatttattcagttattctggtggtctttgtgaaacctgggacaaagtttttattatgaattactaatccagtattactacactatgatgtcatatatctggtaattcaataagcaaacttttacataaaataggtgactctctcgtggcactaaaaatactaccactatccaaaaacattgggatcaactgggctttaacagtttcaatctatgaaaagccaaaatttaagctaattgctactaactgtatttcaataaaagcacttgactgttg

SEQ ID NO: 168850 - DNA, 388 bp, Homo sapiens
tgccttcttcattaagcgcacacacacaccccttagttgacttttaagatatttccaaggctgtaacacttgtagactcatatagtatgaataaagtatgcaattacagtgagtagacagaacagaatgacgaggtcggctttggatggatttttttcttcagagtcgagaagtttggaactggatttagaatgaggtgacaggtgtgaattgtcagcaagcagtcaggaggagggatgtggcctggaggattgcttaagcttgggaggggaggttgcagtgagctgtgatcgtgccactgtactccggcctgggtgacagagtaagactgtgtctcaaaaaaaaagaaaaagtaaaaaggtcaaaactttgtttcatgcacaacttg

SEQ ID NO: 168851 - DNA, 534 bp, Homo sapiens
aggttagaagtgtaaataatagtcctattttatagagtagagatctcagtgcacacagtggttaaatgatttcttctggtagcagtggtgggagtgtcacctgatagttgtaataacaataccaaaaggaaatcttaagtagggtctttgctgtcaggccagaccaactttacaaaccaggctttaacaggtgaatggaattgtggaaagtggaagaccttgagtcaactctgacttcagctgtcttgatagttgtgaggtctcattgcatcagtagatatgggaagacagcatataatctgcatttagccattcagcattcatttccgataaattatttactgatttattttgcttattttctgtttagcaaataaacacaaaaagtatcgagaatgaaagctccttgaggtcagagacttatttattaggcactgaacaaatacatgttaaatgaattatgaatttattgagaacccccttttggtcccttgccgggttttggggacaagacgaaaactcttttttcaaaaa

SEQ ID NO: 168852 - DNA, 638 bp, Homo sapiens
agcaaccctgagacactttacagccctagaacctaaaaggtcaaaaggcagtcttattctcaaaatacattttattacccaatctgctcccgacattaaataaaactccaaaaattaaattccggccctcaaaccccacaacaggatttaattaacctcgccttcaaggtgtacaataatagaaaaaagttgcaattccttgcctccactgtgagacaaaccccagccacatctccagcacacaagaacttccaaacgcctaaactgcacagcggccaggcattcctccagaacctcctcccccaggagcttgctacatgtgctggaaatctggccactgggccaaggaatgcccgcagcccgggattcctcctaagccacgtcccatctgtgtgggaccccactgaaaattggactgttcaactcacctggcagccactcccagagcccctggaactctggcccaaggctctctgactgactccttcccagatcttctcggcttagcggctaaagactgactgcccgatcgcctcggaagccccctagaccatcacggacgccgagctttaggtaactctcacagtggagggtaagtccgtccccttcttaatcaatacggaggctacccactccac

SEQ ID NO: 168853 - DNA, 465 bp, Homo sapiens
cttaaaagaaactgagtctccttatagagaaatcgttatacatcttgtaaacctgagtttgcaaatgttgatacttggaggccctcaatggaatgaaatggagaagcaaaattttttaagtagcaaagtgccttgtccaaacattagtcttttccagagacttctataagagggaaccccaggacagactgcccccttaggaccccggggacggtttttctgataaggatacgatttctctgctagggacacaactacatctccctcccacattctgaagggccaggaagcctttgccacgcttggtgcttcttcctccatcaaatgctttctgaatcaactggatctgccgctgagcacggtaaggcggatgatctggaagctttccaggtgctttaggaaagaagcggcatttcagccacggtttttggccttcataatcaatgtcagcctctaatgctgtct

SEQ ID NO: 168854 - DNA, 157 bp, Homo sapiens
atgaggaaactgaggtgcagaaagggctactagagtagtaaggccaggattggaatccaggctggctgactacagaacctgcaaaatcaacctctccattaccctgctaagaatagaagatactactccacagccatccttatattaaatccaatcc

SEQ ID NO: 168855 - DNA, 675 bp, Homo sapiens
  misc_feature (181)..(181): n is a, c, g, or t
aggatcaggaactttgtactatggccgagtcccatcagttttccctgacagccagtattagataatcatttacagccatagccaccatgcatctgtatgcaaaaccctcacattataacattggaattggctttatatgaaagctacaattacagcctctcatctcctctcactctatatnaagagtgggatctacaaagccatacacggaaactggtcatttcaaccttgcctaacaggggttcttttctcatgctttttaaggaaggagcaggaatagaaattctcggagtccttatcagtaagtaatgatcaggaatgttccattgatgctgctataaacctctagcataacagcaaggtgacaaagaattttctaaaatcaggcccaaatagcaggaaagaaacacttagctcgggatgagttcaagaaccaaaaatgggctaagttgtgctgatttaggtcagaaacagggtcaaagttgcctctttcagagatgagaattagatataacaagtaattggccgggcacagtagctcacgcctgtaaccccagcactttgggaggccgaggcgggtggatcacttgaggtcaggagcttgagaccagcctggtcaatatggtgaaatcccatccctactaaaaatacaaaaattagccaggtgtggtggtg

SEQ ID NO: 168856 - DNA, 630 bp, Homo sapiens
aggatcaggaactttgtactatggccgagtcccatcagttttccctgacagccagtattagataatcatttacagccatagccaccatgcatctgtatgcaaaaccctcacattataacattggaattggctttatatgaaagctacaattacagcctctcatctcctctcactctttcaaccttgcctaacaggggttcttttctcatgctttttaaggaaggagcaggaatagaaattctcggagtccttatcagtaagtaatgatcaggaatgttccattgatgctgctataaacctctagcataacagcaaggtgacaaagaattttctaaaatcaggcccaaatagcaggaaagaaacacttagctcgggatgagttcaagaaccaaaaatgggctaagttgtgctgatttaggtcagaaacagggtcaaagttgcctctttcagagatgagaattagatataacaagtaattggccgggcacagtagctcacgcctgtaaccccagcactttgggaggccgaggcgggtggatcacttgaggtcaggagcttgagaccagcctggtcaatatggtgaaatcccatccctactaaaaatacaaaaattagccaggtgtggtggtg

SEQ ID NO: 168857 - DNA, 251 bp, Homo sapiens
catgactggaaacttccttcccatccactgcctggatccatccacctccccacaaaggcttcctgagcatctcctccgtgtgagcactggctcaatgcacaggacgatgtagttcctgcccatatggaacttaggttttgagtgacacgtgggacattggaagaggagagcaggtggctaaagagcatcatacagaacagggctcagggaagtcccaggtgatagaatctcaaagagaagggctgagggtg

SEQ ID NO: 168858 - DNA, 835 bp, Homo sapiens
gatgatgattggttacaaagactctctgttggtgatggtttctgagaactggaagatggagtctagctctgttgcccaggctggagtataatggcacgatctcggctcactgtaacctccgcctcccgggttcaagcgattcttttgcctcagcctcccaagtagctgggagtacaggcgcccaacaccacgcctagccaatttttgtattatagagatggggtttcactgtgttaaccagaatggtcttgatctcctgacctcgtgatccacctgcctcggcctcccaaagtgctgggattacaggcgtgagccactgcacccggccaagtacttacctttgtaagaaatcataagattctcatttttttctccattaactacataaagcaggacaatggttggcaccattgcttcctcactgaactgtggatgggtctcagcatgcaaaggaagtagaaagtgaatgggaggacggcggctgttgctcagaagttccttccataatttgatttattaacactatttgggttgttcatggcttggttttccctccctttttcctccagtgaacggtgacttgacagaggtacataggaggctacttgttctcttgttggctgcttgtatttgctttctggaaggttattgttttcaaggatcttaagcacctggattaggacagttaaaaaccatttgttagcttggaaaatgtcatcttcctctttatcctgctgtcctggctgtgtgcttccttctctcccttcctgtatctctcttccttacagattgcttgcgttacgtatctatgagatgtccgtctgtcagagtgttt

SEQ ID NO: 168859 - DNA, 222 bp, Homo sapiens
ccagcctttagatctatgagacaagaaatataatgtttggccaccttatttttggtactttattacagcagccctaggaaactaatatagcctactatttattaggctatgttcaggtgcttggaatacatcattcaacaaaatacagtttttagcctcattctagtggagagtaatcgaccaggagccaaaatacctgttagaatgtaatatatattgtgg

SEQ ID NO: 168860 - DNA, 373 bp, Homo sapiens
tgttatctatgttaaaaacaacgatgatgttatctatattttaaaaagcaacctaagaaacaatgactggttataattcaactatagctacatcttagcagaaaagcaagctaagagataatgactggttatggtttatgcctacagcttgacagaaaggtgtgcggggggtgagacaatcaattcttagtgaccaccttctatcgaactgactatatgcaggcaatcatgcatctacgaagagaaggacaaaggaaaaggaaaataagtaaaacaaatgattttactacacctgtatcctagcagagtccaggcctctgtctcagttgttaccttgtggccttttattaactttacaaagtcagttttagtc

SEQ ID NO: 168861 - DNA, 282 bp, Homo sapiens
gtcaaaatttttgccaaatatatccaaaatcaaagaattataatgcattccatccaaggaccaataacagtcctccactggcacaagtaagtgagaactaacattctctaaagaatatagcacgtgatgggaaatgtagcttaccagcttatgtttgctccttcctcaaaatattactgggttatctgtcaggaatgggcataggctaccttggtcccaaaaatgtcaatcttaacattaaaatccaatgctatcaggccaggagtgttcctaaaattctgg

SEQ ID NO: 168862 - DNA, 386 bp, Homo sapiens
ttaaagggaaaatcttggaactgagactcccaatattatagctggcatataattttttaaacaactgattaagttcaaaaattttattttgacctctgaatttgttatacactcactttgcctactcttagaaagtgaaaatttccagattgttgaagattctctactataataatctaatatccataatctacggatgtgacagaaggatggaaaaattgctatgaatgtgattccctctggaggcaaaaggcggaaatgtctttaggaaacaaatcataaatttccttagctggagaaagcgtgaaatataaaatctaaacatgaaaaatttccacatagttgatgtaaagttaacttgatggggaagagacagctgcaaacta

SEQ ID NO: 168863 - DNA, 587 bp, Homo sapiens
ataaacagtattcacatttaaatccactagtgtcaagaagcagcatattaaatcaaggagatatgcttttttgcctttatgatgaacaaaaactgaaaacatccaaacacttttacccagaaattccatctctaggaacttatcataaggcaaaaatcacaactagccataaaacatgttcatctcagtttgttaactaaatattgggaaccacctaacagctggtagctggttaaataatttagaatagatctatgaaatttcatgctattatcagtgatgtggtaagaaatatgtttaatgacttggacatatgcttgcaatgtattaactgaaaaactcagagcactcaggagtatttctaatacatatagtttgtcaatagacaaagacaccataatgtttaaagttgttatttcttgatggcatgattcctggtgacatttcccctgcacccaatattttgcattctctgtgttttaaaggttttctcttgacatgtattacttatcataaactttacacatttaaaacaaaccctgcatataataatacaaaaattataaattaatgtaatataaatataa

SEQ ID NO: 168864 - DNA, 132 bp, Homo sapiens
gacgttaacactgaggcaaactgggtaaagtttcaaaataaaaagctttaaaagagagacagacagatttccctagataaaccccagtattccatcaagttctgtaattctacaaccctacgaaaattactt

SEQ ID NO: 168865 - DNA, 960 bp, Homo sapiens
tgacccagcatttctactaggtctacacccaacatccactcaaaaacgtgtacacgatgttcatggcagcattaacctaacagtgaaaggtggaaacaacccagatgtacatcagctgatgaaaaggatggacaaaacgtggcgtgtggtgcatttacacagcaggacaaggctctgccacaggaaggaaggaggcactccacaggctacgacacagagaaactcagccgaagaattcggacgccaaagatcacatgtcgtaggttccactgttaggaaatgtctataaaagacaaattcacagagacactggagacatggctgccagggcgggggtgctggggagagtaaagagtgagttcttaaacacagggttcctttggaggcaatgaaaatgttcggaaattaaattatggcaatagttgcgcaactctgtaaatatataaaaaccacttaaccgtacacttaaatgagtgcattttatggcatgtaaattagatcgcaataaagaggtctaaacattaaagaagtctggaaaaaaataagcagagacattaaaaaaaagaactgcaggctctaaaagctctccccatacatcaaaatgccaagtgcaaagcggtcacttcagacgccaccacagctccacactgggaagacgtgaggccaccacatctcaggtgtctttattttggacagaatcaagtctctgtggtgaggccctctcaggatgggcccccactctatcctgtacagacatcctttccttcctgccctcagagggcactgccagccacacccagggactctccccaccaaacacagacagggctgcgtgtggccacggcacaagagctggtctggggcagtgcccctgcatctgccatgctgtgccctctgtccccaccccactgctggccactgcagagctcccctggccctccaccccagttcccaccctgg

SEQ ID NO: 168866 - DNA, 176 bp, Homo sapiens
gtaggctctgaggctacataacttcacttccactgcattctcttggtcaaagcagcagacaaggctgctcggacacaaagagtggagagacgccttcgttgctcttgtcccatctgtgtccagttcattcctacgaagacagccactctctaggagagccccgaccaggaaagaag

SEQ ID NO: 168867 - DNA, 376 bp, Homo sapiens
  misc_feature (31)..(32): n is a, c, g, or t
  misc_feature (35)..(35): n is a, c, g, or t
ggtcgactactactactaaattcgcggccgnntcnacgtacccctgaagcaaccagtatccttctctggcactttctttcttgactttatgcattgccttttttgtttgtttgttttgctttttgagatggagtcttgatcttgtcgcccaggctagagtgcaatggcacgatctcagatcacagcaacctccacttcccgggttcaagcgattctcctgccccagcctcccgagtagctgggattacaggcatgcgccaccacgcctggctaattttatgcattgcctcttatccctcataagctgtatccagctctgtaccaagacaagagaccccttagctcaaaggtacatctgataggcatcactgttaaa

SEQ ID NO: 168868 - DNA, 601 bp, Homo sapiens
tttctacacatttcaggttaagaaagaaaaacatgcgtttattttgtcttaaacatgaaataatgttttaagcattctaaaaagtacttacaaatggattaaacacattggcgttctttatagttttactctggttcttttttttgtgacttgttattcatagtctttgcaatgccgccctctagtgatcgatttccaaaaatgcattaattaacttgtaagcctgttacagtctttctcttttgactctactgatcctttgccacagcctttgtttggtgttctcttttattgctcttccattagttattcttattctcctttaatggcattagggaaagatcagaagtttcaggagcaaaaaaaaaaaaaaaaatacatatatatacacatttgactatgaatccttaaaacttgtccatttaccagtctgggcatagggcaagttacctgtccagagttcttactgggaatgaatgagaatgtctttttgtggcacctgacacagacagcaaagagcaggcattcaacatataccagctgtctcttccaccctcttctccccaacattgctgagagtagggatcagtactgttttttt

SEQ ID NO: 168869 - DNA, 463 bp, Homo sapiens
caaaaaaaaaaaaaaaaaattaattgcacatgaagtatacaagttcgatctgtgaaaccaccatcacagtgaagataattaacacatccatcattccacaaaatttccttacactttcttgtaatcccttctccctcccattcctgctttctttaaactatagtttagtttgaattttctataattttatataaataaaatcatataacatgtatacttttgagtctggcttctttcattctgcacgactgtattaaggttcactcatgttgttgtttgtatcaatagttcattccttttcgttgccaagtaatattcctttgtagggattaactatattttgtgtatttattcacttgttgatagacatttgtattatttcccattggggctattacaaataaagctactgtaaacttttatgtgcccacatctttataaagacagatgcttttactttatt

SEQ ID NO: 168870 - DNA, 223 bp, Homo sapiens
ggatgatgaggaaaggagagaaagaaagaagtcatggactcagtaagggaggaggggctccatgaatatcaaaaagtgtttatgttggaagtcactggaaaagcaggataaatattacttaatggggcaatactggaggcattcccattgaggtcagaaacaggccggatgcccagtatcatttatctctatttaacactgcattaaaggttctaaccagttc

SEQ ID NO: 168871 - DNA, 121 bp, Homo sapiens
agtgttttttttctcctcctctatttgtgttgacttttagctacttgtgctattcattttccagaatgattcactcattccatcctgtctctcccagtttaactttctttggtgggttttc

SEQ ID NO: 168872 - DNA, 163 bp, Homo sapiens
tgggcaggctaaagctaattgtatccttttttcttttttctttcttctttctttttttctttctttctttcttcctttctttcttcctttctttctttcttctttcttctttctttcagagtcttgctctatcaaccaggctggagtgcagtgtcaagatctc

SEQ ID NO: 168873 - DNA, 161 bp, Homo sapiens
acttactcttcttgcacattgtctaccctcatcgtcagcaccaggatgtagactgggtgaagaaaagagtctttgttgttcacttctgcatcccccatacctgcagtgctgcctggcgtgcactcgatgctaagtgagctgaaggaggtgcaggtgcatga

SEQ ID NO: 168874 - DNA, 425 bp, Homo sapiens
ctccctccttctcccgaggccacaccaagtctcaagtccccttgtatttcctgctaaataaatattttcacatctgtttcctcctgtttatctctgactctgctgctttgtttagatctttgcaattactaactggaaataatgaagcctctccggtcccttacgtttctgtctttctccctccaatattatcttactctctgccagagtttctaaagcccaaatttgataatgttactcttttggaaaaaaaactatcagtgacttttcattgcttgctggataaagttcttagtacttagcaaggcacgcaagatcgtttacaatctgacggcagcctagcttcctgccttatgttccttagcccttgaacaggctgcccctggcctggactgcctgcccccctccgcccgcccccactctct

SEQ ID NO: 168875 - DNA, 432 bp, Homo sapiens
aatgccagataaagacagaagaaagaaagaaaacaaaagcttcaggccaatatctctgataaacatagttgtgaatattctcaaaaaatactagccaactaaatttgacaatacatcaaaaagttatacaccatgatcaagtgggatatattcttagaatgcaagtttggtttaaaatatataggtaaatgtgataaaggacattaacagaataagttcaacatcctttcataataaaaattctcaaccaaatttgtgtagaatttttttcaacaccataaaagccatgtatgaaagactcccagataatataatcaatggggataaactgaaagctttttctcaaagatctggtagaaggcaaggaggcccacccacctcacttctattctacctagcactggaagtactagcaagagtaactagacaaga

SEQ ID NO: 168876 - DNA, 297 bp, Homo sapiens
agtcactgagggaagagatgggggcaaaaggggtgcaactgtggctaatgccagatccaaagatcaggaagaggaaggagaactgaggtggagcagggctttcaaattcctcaacgctatgctgttcccttcctgaaatcttgctcatgctgttcatttgtatgcagtagaagagacgagatgtgcaggagaaggggcgagatgcctatatgaagagacttcagtgctaaaagtgaatgaatggcagaatagcttttagataaacttatacagatttttttaaacttcatgcatatg

SEQ ID NO: 168877 - DNA, 583 bp, Homo sapiens
tgctatctttatgttcacgagtacccaatgtttagctcccacttataagtgaaaacatgtggcatttggtccagcaatcccattactgtgcatataactaaaaaaatgtataaatcgttcacccaaaaagacacatgtacttgtatgttcatcacagcactattcacaatagcaaagacatggaatccagttaggtgcccatcaaaggtggactggataaagaaaatgtggtacatatacaccatggaatactatgcagccataaaaaagaatgaaatcatgtcctttgcagtaacacggatgcagctggaggccattatcttaaacaaatcaacacaggaacatctctgaactttcagtcagcctccccaaattctcttacagtgaccattctcaagcctcagcatcacacaatatattcatgtaacaaacctgcacaggtactgcctgaatcaagaataaaagttgaaattattaaaaaatgtccagggatggtactaaaaaggaaacataaattagggagagagactgagaggccagtgtacccagagcaataataaattaagctagaaaccaaatagat

SEQ ID NO: 168878 - DNA, 186 bp, Homo sapiens
aatttttaggcagtttatattcctgttgactagggttttttgcctttttcttaacttaagaaagttgagtgataaactgataattttttaaaaaaagaagacaattcacagagatttagtaaactttctgactctaaaaaatggtagtataaaaggtaatcaaaaactgttccctatgtgtgataa

SEQ ID NO: 168879 - DNA, 172 bp, Homo sapiens
caaataatgacaacagcaatacccacgttgtagtgctgttctgaggattcacttaaaataatccttgtaaaagcacagtgcctggttcaaggtaagcaatgaatgtcagccagcatcctccccaacctgcccctcctctgctctcactcctagtacttcctgcaggactgtg

SEQ ID NO: 168880 - DNA, 1031 bp, Homo sapiens
ctgagatgacagtcggcgctgagatgacggccattaagagggctgagcagaggcgacgtggtcgggggatgatgcaggcgctcagcttcctcagaggaagagcaactgctgtcggagtttgcagagatgggagagctggaagagctaggagagcttgcagacactgtaaccaaggggctgcatcccagaggctcctggctcctgcctttcccttggaatgacggccattaagagggctgagcagaggcgacgtggtcgggggatgatgcagtcgctcagcttcctcagaggaagagcaactgctgtcggagtttgcagagatgggagagctggaagagctaggagagcttgcagacagggcagaatgtcagcagctgccatctcgtctcccgttaggtggaatctcagagccctcatctgagtaaggattgtggtaggattcagtgcgaactcacacaaaccactcagcagaggctgctaccacctaaaggaaacaggaggacagacggtaccagacaacgagacggcctgattaagacaacacacccactcccagcctgtccccacgttttcagcagcacaaaggcagaaagaaaaacacaaagtgtcaccgtcttcaacgaccgaaaagggaaagaacatgaatctgaaattcaaatgcccgtctgtgatctcggtaagcctggagccatgcaaagaataagactttcagcaagagcctcaccaaagccaagaaacacgtccccacctgcttgttcctgtgtccaccctccagaaaggccaagggtgccccatgaaatcttagctccacaaagcctgcattgagatggcccagcccctgctttctgatgctctgatgaaggtctgaatggttacaaatagggatatctgcgtctgaagccctcgctggcaggtgctgaatgccgtctgcccacggagcgcatctgtagctaggacctggagggtacctgtctgggctcactcaagtggagcctgagtgtgtccagatcagagaaggccagggaacaaat

SEQ ID NO: 168881 - DNA, 103 bp, Homo sapiens
gctaagatggaggctccagagctactttgagaattcctctattgaataagctccaatactcctggcctcagatgaatacagcctaggatgactttgctcacac

SEQ ID NO: 168882 - DNA, 355 bp, Homo sapiens
ccggtacatctaaaaagcaagaagcaataagatatctttgtcagataaaactaagttccttttcttttcggcttttgtttttgtggggttttttggtggctgctgttgttgtatttttttccttgagacaggtctcactctatccatcaggctggagtgcggtaccacaatcagggctcactgcagcctcaatcacctaggctcaggtgatcctcccacctctgcctcccaaagtgctgggattacaggcgtgagccaccgtgcccaggctagtaaccactgtttatctaataatttgtactcagggtgttaatagagcacgttaattgattttttgaatattgaaccaggcttg

SEQ ID NO: 168883 - DNA, 400 bp, Homo sapiens
aggctgcatcatgcctttctttgagaaacgccctgaggcatctatttgctgcctgcctcttcgctgtgacgttctgtctcatgtagcagcgatggcgtcttttggaccattgccctgaatcgggaataggatgggtgtttgggtgtttgctcctggcgccctgtggggatgcacacagcatagccgggcaggttgccggctgcttgtagacttgcggcttttcaggacacactggcacctgccgtctgaccttatctgcagggtattttattgctcaagttaactgaagcagagatgagtgacagtactaagaccacccaggcctctcgcccctggacagttcccagttagctctaaagatgctcatttggtcagcccatatctgcggagaactgctcgg

SEQ ID NO: 168884 - DNA, 382 bp, Homo sapiens
agcttactgcaacctctgcctcccacgttcaagcaattctcctgcctcagcctcccaagtagtgggattacaggcgagagccactgtgcctggcctacagaagtactttctatatcataatctggcaaccatttgtgtgtatttttttcagttgtgatgtacaaacaataaagtgcttaagtgaattttttttttaaccaatgtatctactaagattaagttatggaaagtttccagcattcttgaaggctccctcgtgtcccttctcccttaataaccaatcctccatatctgttctgactctttaccataaataatttttgcatgtaattgtttttattgttttttaagattatctttgattgacccctccatatctatg

SEQ ID NO: 168885 - DNA, 597 bp, Homo sapiens
tgcttgctgatgtgtaggagacagaaataattagtgttctccttggctggcttcttatgtagttggtgagtgaatttaaaacatataacaagttaaacaatgtcaagcattaggtgagtgagaattaagaagttcaaaatgtaaaagctcggagaatatatgtatgtggacatgagagtgtaggaagaacctgatgcagccgcatgagagtctaagaggatccagacagaatggttagagataaaagcataaggtatactgtcaacgagcatgagcattactgtagaagcagaacataatgaactatcagtaactggggcatttatgaaggtgtgaagatgctttcacctggtactaaaaggcctggcaaactgtaaccccaactagatcttcaaagatttcctgttacttccacatatagaattcatatatcctaagcactaattataattacctgaaaacacacttttagagatttcttatcctcacttttttgtttgtttttgatcttttctacactccattttcacctattgaaatactatcactcttctaaaatttaactcaaataatgccttcatgcatgtttcagttcaa

SEQ ID NO: 168886 - DNA, 197 bp, Homo sapiens
attggcgttgtaggtgggatcattcatgcattgcaggatgcttagcatctctagcacccagagtgcaagtatgggtagcacaacaatcagaagatgccctctgtttgtagagaggagtggtatcacagcttccactagagatgagaactgttaaagtttgagagacctctagagcactaacagataggaactaaagt

SEQ ID NO: 168887 - DNA, 393 bp, Homo sapiens
tcccatgtgtgctagaagagacctgggggaaggtaattgaattgtgggggtggggcttccctgtgctattctcatgatactgaataagtctcacaagacctgatggtttttaaaggggagttcccctgcacaagctctcttgcctgctgccatgtaagacgtgtcttgcttccccttcatttgctgctatgattgtgtggactccccagtcatgtggaactatgagtccattaagcctctttcctttaaaattacccagtctcaggtattagcagtgtgagaagagactaatacagtgacctagctctccctcttgctttttctcaactctttcttcttgtctttatcttccttctggtactttgactctttcctttcctctttttctttctt

SEQ ID NO: 168888 - DNA, 618 bp, Homo sapiens
ccggggtgctgggcctgtgtgggcaaggatagggggaaaggggctagccctgggcttgctcctatcagagggcgctcaccatgctagaatgggtatgctactacttgctcaggagacctctaagggtaaggacggtcagaatgggctccaaatggtttaggcttcaatgttgatctcccagacctagacctgcactcgggccctgcttgagagagtgaaggattggagatgcacataggcctgagccctggggtgctgaccaaaggcacagctacctccgtacttccagagggaggttcgattttctagatctaggctgctttgaccaccttgaaatcctactctttctggtcaactcctagtttaagagtcttcttaggagctgggcacagtggcatgtacctgtaatgccagctactttcagatgaaggtttgaggccagaagttcgaggctatagtgcactatgattgcacctgtgaatagccactgcattccagcctgggcaacatagcaagaccctgcctcaaaaggaaaaaaaaaaaagtctcctcaaacacaaggctttctggaagcctcccctcattcctgatctctcctgcccactcccagcctgttgg

SEQ ID NO: 168889 - DNA, 424 bp, Homo sapiens
attaacttgcatgaaaggagagatccaaacccaggcagtcggagccaaagcctgtgttcttacctcccaaactttccttctcatcagcttcattcaatagcaaacaaactcctagtcttggtcctgcgccaggtctgctttttctcagaccagtggcgcctaccttcagcacagaccagtgccaagaagggagatggtacaactgagttggaaattaggctgtgtacaatgaagtggctcagacatggggataagggtggggtgctgacagtgtctgataaaagcacccattgggccaggcgcagtggctcagccctgtaatcctatactttgggaggccaaggcgggtggattgcctgagctcaggagttcgagacgagcctgggcaacagtgacacacccatctctactaaaatacaaaaaa

SEQ ID NO: 168890 - DNA, 349 bp, Homo sapiens
caacgagccggctgggacacagagagtggtgggtttccctgtgctcagagagtccttcaacatcccggtggcaggcggggaagcaggtcccacagtcagccctagccggcagggatggcgggcaggagtcctgagtgtcccccacacccaagcatcaccagggtctgtgagtacatggggcctccctaaggcgctctcaccaaaactgtctcattcaaagctcaggacactgcagggaggtggctgtggccctggggatgggatgtgaggaggtgaggactgtggttccactttgctgatgggaaaacgagacacagagcatcagaacactggccacagtgcaaatcca

SEQ ID NO: 168891 - DNA, 458 bp, Homo sapiens
tgctaacatctggaggctgctgtccagtttacgtaatctcttgctgcagaggaggaacacgggatccccagccagatggtccgtgggtgacttcacagcacatgtgctacctccaagagtaagatgctgacggggttaaaagagtgggatgcaaaaccttccttgtattcttacagggtgagaggcagtggtttgggtgctcccagggatctgttttcttttgaaagcatcttttttttttctgtccagcctaggatcaaatgtttctatgtctctctcattctgtcattcattcattcaacatttatttagcacttatttatgtgttaggttcttcattcccatggtccacatgaagaaaatggaccccaaaggaacaaaagcaacaaagataaaaattccttctcctcccatgggggtgggaggtgaagaacgaagcaagcaaacactcatagaga

SEQ ID NO: 168892 - DNA, 518 bp, Homo sapiens
atggaaatgggatattcatccaactcagagccaacatgatgtcaaaatataaagttataaagaaagaggtaaaaatctatgcctgcttcattccttaggaaaccattactgacttcaacaaatctccaggttcttgagactctaatgggtgattaacctatgaattgctaggaacactcatgaagttagaaaatagcttcctcactaaatatggaaaggaaaaactggtacaagccactgcaaaaacacaccaaaatataaagaccaatgacactatgatgaaactgcatcaactagcgtgtgctagctagcatcatgatgacaggatcaaattcacacataacaatattaaccttaaatgtaaatgggctaaatgctccgattaaaagacacagactggcaaattagataaacaggcaagacccactggtgcactgtattcagggacccatctcacatgtaaagacacacacaggctcaaaagagatggaggaaaatttaccaagcaaatggaaagc

SEQ ID NO: 168893 - DNA, 270 bp, Homo sapiens
gttaaactattcgaggtttcatttatatttgggaaaactcttgttaaataaaacaggtagaagagccctcttaaaatccctgaagaatgtatgacacaaatttctatcattaatatataataaagattcttttttttgtattttgtttgttgttgttttttcctgtattatattttgcttaatctccctggctgcataattgagttacctttatttttaacttttactttaggttcagagatacatgtgcaggtttggtatataggtagg

SEQ ID NO: 168894 - DNA, 506 bp, Homo sapiens
gtttaagaagcctgagattttcacaagaaccagcaaaaccaggagtggagagttggggagatagagaagtaggcctaaaactccctcttcttgagtcttttttgacttaatacaccattgggtctgtcctggtgctatggcctatcacaaaggactgttttaagagagaagcaagccacagccttgccagataagtctccaacaccagcagaaaagcacggaccctgatctgtgggaggcaagggtctccccattatttctggaggcaaatggtgccttctagtgaaatggtgccaccatttgctgatgggggtgcctgttctcaggatgtgtggaaactcaggcctgagggtttctacatggtttattcaatctaactgcatacctagcttggcagaatggaggtggacaaaagtgctgaaaggatgagggtaggcttttagggcaaatcaagtcacaaagcagatgattgagggaggttacaaagcttaggcagagttaaagtt

SEQ ID NO: 168895 - DNA, 183 bp, Homo sapiens
cagagatctaaacagggtccgcctcccccatgcttggctctgattgacatctttgatgtccaaattatgtgctgaattctaaggatggaaaaaaggctgagattctattttaggcagataatgaacatggaagacatcaatttccccgccccacgctttttctgttccgttgcatttcttctt

SEQ ID NO: 168896 - DNA, 460 bp, Homo sapiens
gtctgtggtcccactgcagcgaaggaaactgtcctcttacaggataaagagtgttatatgaagaaaggaaacaggaccaaaagcaagtaaataggggtggcataaacttagagatagaaatatgttcaggtttgcaaaaattcgaggaacaataaataaaacttttaaagtgtatttaacaaagagaaacaaagatgcagcagcctactgggtgtagtttagtcagcagtgatctattactgaaagattacttagaaaaaaccaagctcctcaacctcagttttacttgtgtctttttgcagaggagagtagggagaggagtaggagggaaggagagactccttagcaagagaaagagaagcccaaagtgggagaacataattatattctaaatagtttcccaactctgataacttgcatcccagtgttctgtggaagatgttcaaattgcattgctgat

SEQ ID NO: 168897 - DNA, 270 bp, Homo sapiens
tccataaattacactgaattctcccaacacacactttaaatgttttgctcttttctctcagtctctatatttttatgagatcatctggaaaaaaaaaagacctgatttgtggcgtgttgttgctttgttaaggtaaagttttactacaaacccctcataatagagtttgtatttgttttgagggaaactttgtatttgaggaaataatagtctagtttgtgctatagaactagagacagaaagtattttcaagtgttgggcgataaatgt

SEQ ID NO: 168898 - DNA, 558 bp, Homo sapiens
tcactcaacttcttacaccaattttgttttatttaaacctcttttctgccccccaatacttgattattttgaagcagatctcagatatcatatttcatggtaatatttatatagagagatatatattagtatttatctctaaaaggtaagaactcttttaaaaaaaaacagcactatgattgtatctgaaaaaattaactgatttattggaaggtatattttaaataaatctataaataaaaaccttgggtccagttaacaaataccataaggccttttccctccagattctactgacccttgccttctccatgcagattctgacaagatttgatctgcctaattaagttaacctactgacagacttgatatgcctaagtataattattaagtagtaatttatttttactgtttttattaattcaaggaatatcctggctatcaggactctttggcaaccagattttccaatagatgcttccaaacaaaagtctaattagcctttataaccttgacatagacagatgaattcttttagatgttttagatattaacata

SEQ ID NO: 168899 - DNA, 405 bp, Homo sapiens
agttattttgtagaaggtctctcagtttaggtctgtctgatgtttcctcctgatcagattcaggttattcacttttgacaggaataccactgaaatgatgctgagttcttctcagtgtaacgagatctagagacacacactgtcagtttgttccttattggcagtgtgaaccttgaggatttcattgtagtggcatttggcattactccattatagttactattttaccattttaaattaaaactatctggccgggcgtagtagctcatgtctgtaatcccagcactttaggaggctgaggcgggcaaattgcttgaggtcagaagtttgaaaccatcctagccaacataacatggtgaaacgccatctctataaaaaatacaaaaaattagcctggcgtggtgg

SEQ ID NO: 168900 - DNA, 548 bp, Homo sapiens
tatttccaagtaaggtcgcattcacagataccaggggttaggccttcagcatgtcttttgggagggcacaattcaacctgcaacacttggtctggaaggaagatcatgtaaaggattactcggtcaaccttgagctggtgatgctggcagagatggtagggactagaaaggcagattcacacccacagtgggtatggtgaacatagatgggtgctcctccatggtggaaggtgtccaatgccattgacctttcgccaagtgactagttggtctcctcaaggcacaatgccactgagggccccgcattggcccttgctactgacaagttgggtgttctgctataactgcagctggttgagactttatgatgaagagttcatgcctttgagctcacacaaagctactcacgttgctatcatggcatccccatcatggggagccatagagcagcaagcatgcctaggagagatactggctggcatggcagtaggaacagtccagtccagctgtggttcagcagctcttctggtggcatcaacacacagcac

SEQ ID NO: 168901 - DNA, 201 bp, Homo sapiens
gtcaagtggtctgggctcccttccccctaatggtggatcgagaaactgcgcccgaaactagcagtagggacattccgcaggtgcagcgagtgcgacaggctggggccctgcctccagcgctcgaccactgggatcctcaaccccgcgcccgggtcactgagccaccccctccccacgccgctcagcgtctgattgcggccg

SEQ ID NO: 168902 - DNA, 201 bp, Homo sapiens
ctttagagtatagcccgcagtgaaaatttcatgcatgttatcaaatattgttaatttttattctcctcagacctcagtttcctcatctgtaagctcatgaaaggggaggggaattgtgctggattacatgactggggtcatagtttacccgtaaagtttttcattctagtatgtctgctctctgtttacaagtgtgtaaac

SEQ ID NO: 168903 - DNA, 167 bp, Homo sapiens
ggagctaccacaaggacctgctgccaccagtcgtcactctctgaataacagacacatggtatgcatcagagtcattactgccttacccacagggagagaagcagcaggcctctgttgctccattcacttcaagggtaggttatgagcatctaccatgcatcaggcac

SEQ ID NO: 168904 - DNA, 285 bp, Homo sapiens
agagtcttttgtgccccactctgacttcaatctgaatacctttgattttcgtaaattgactaattttcattccacataggacattgttttacaaaagttttacgataaaagtgacatttccaaagcctgaaatcagtgtaagccataaattctattactctttcaaagataagtccccccaatgatacagtattatttgaaaaaatctgaaagtcactgctttaagaattgtaattcaaaatgtgtcatatctacgggcttcatttaaacaccaaccaacaaact

SEQ ID NO: 168905 - DNA, 161 bp, Homo sapiens
atcctcatgtcggaattgaaaacaaaacttagaaagtaaatagcacaacaaaatttgaacatagatctacctgaagcctgagcttttctccattcttttttttctgcctatctttccttccttctctctctcttttttggacttcatcacacgattattcc

SEQ ID NO: 168906 - DNA, 320 bp, Homo sapiens
agaatgcaagtttcacacaaacttttaagataaaacaggaaacgaatgacatttcatgcctgagattgacccccgtggaccacacctgcaggctggggatatatgtccataatctcccaccttccgggagatttggcagagtcctggtcatggtggaaggcgatgccttccttgtcccttccctccctgtgtttttgcggggcattcctacataactataaacctccaggaagaaggaggaaaatactttcctattaaaatgccaggctcacggtaggctttgggtgagacacttgggcagagggcccagctcccggtat

SEQ ID NO: 168907 - DNA, 379 bp, Homo sapiens
acgcagttcttggtgccacgactgggagacagtcctcaggccctcccctcagggagctcactgtccggggagggacagccagcaatagttcctggccggccaggagaggcagaggcagaggaagggaagggtcagctgccttgaggtccctgcctgctaacctgacggtatgctttcaccatgccggtgaccccagccccaggaccacgagcaactcgcctggctcccttctctccgtctgcctcctggccgcggggcccggagagctgggagccagagggtgtaaatgaagggcagagctgtttgggtgactccatgctctgcttctccccgagggaagccaatggtgcttaccatttacaaggcttgttacagctgc

SEQ ID NO: 168908 - DNA, 255 bp, Homo sapiens
atccttgtccttgagtgcccaacacggaacctggctgtaaggcagggctcagtgcccgccatgcatttgaaagagcagctgcctcagacctcagacttagtctccttcataggaggtgtttctctcccgcgagctctgcccccatcccaggaaaggcagccagaagctgaacgcccagaccctgcgctatacaaatatcagtaaacaaatagggtgactttttttctttaaattcagacgtgttggggataacat

SEQ ID NO: 168909 - DNA, 351 bp, Homo sapiens
ggactattggatgcctatgacattactataaatatcaataatattacttcttcctatgatattactgtaaatctatatatttggactattagaaatgaaacactaagaggttgttttaaattctcagaagcctgatttgtaattttacctaggaagaagcccaatctactttagcatgaatgccttcaagtggagttaatattctctatcaaatacgagctttgaatcttaccaggtaattcaaaaatacttgtataacattcgataattctttagcaaatagcaaggaaagattgaccagggtgacatttgcatttttagggcaagagttaacttattgttttgtccata

SEQ ID NO: 168910 - DNA, 161 bp, Homo sapiens
gactcttcctggcttgtcggccaccttcttaccgtgtgctcacatggcctgtttgtgtgagcacaggaggcagagggcaagctctctggtgtctcttcttccaaggccactaatcctataatgagcaccctactctcatgacgtcatctaacctgaaatta

SEQ ID NO: 168911 - DNA, 444 bp, Homo sapiens
atttactgtggactcaggacattggaagcttaaagtatttgtaagtaatctctgatacgctcccaagctatgcagctatgaaagcaaggaaaaacttagcagaaaacacaattttggtgctctctgccgtgcttttgaggaaaaatagtgcttgccattcagcattcacaaagcttgctggagggccagagccgcttcttcactgcaggacaggctctgccctgcggttgctgtttccttgcagacggccactgtgcctaggatgtgggagtctcagatatttcataaatggatcatggctttgtctttttctcaatttcttttgacaagaaattgtttaccatgtagatgtcttcaagaacttcacctgtgagtcctgcattacttctgtctggacacatcacattgtttttgttgtttctttagatggaggatgtggtgtct

SEQ ID NO: 168912 - DNA, 402 bp, Homo sapiens
ggaggatctgaaggagcacgctggtgcctttgctcctgtaggatgctgtggagaaggatccctgtatcttatgtataggttccatgatctctagaagcaccattgcaagcccattttacaaatagggaagacaggagtgaggggcttgcccagggccacttggctggatactcacccaggccaagcttgcccagccctgacaattcactgtcaccaccctttactcctgatgaccacagcccagaaggacagggattgtgtaacattctaagaaaatcatgctgccatgcaggaaggagacagacctagactcagccaatagcagctgaggggtaaagttgcttcaaaagaattcttggcttcttggtattatttggtttgcccagagactccacaccccac

SEQ ID NO: 168913 - DNA, 210 bp, Homo sapiens
ctaggaataagtgataagaaggggacagcacctgttttgaagacaatatatcataatgagtaaaataaacacagaggcaatttcaagagtgtgacatgagccaggaaaaggataagcataagattctttggaagactaaggtgatgagagacacctttcttttttttttttgagacggagtctcgctctgtcacccaggctggagtgcag

SEQ ID NO: 168914 - DNA, 370 bp, Homo sapiens
tgccaaaaaaaaaaaaaaattatttagagtattttggggtgatatataaaatcataacagcttaaaacggaatacaacgaaaaagacaatttttaaatagttaaaagtgttggcgagatagaggaagtcaatcatagtcttggaataacatttagatttcagaatttgagtttttatgtttgttttgacaaaatggttcttttgctttcttcaacaagaggtttaaggctttgaactttttgaaactttgatataattgttgaagttttttaaacaaatcctatagaaataggagactgctaatatgaagaagatagaacatactattacagcaaatttatttactcacaaaaattgcttttccaaggta

SEQ ID NO: 168915 - DNA, 424 bp, Homo sapiens
tgcaatcagtacagtgaactaaatggggcaggtttaagtggcaattttggctcaaatgccagctcagccaccagtaaagatgatgggttcagaagggttgggatcatttagagaagtgtttgttttctgaggctgaaagtgggagctgtaatctggaacctttcatgcaacatgtgtttctggttcttcagattcaattgttttttgatagagacattgcaaattatgaaagcacagctcatgacctagaagttttgcagcacgatcgtttcccttctggacaacttcctacaagactctgggttgaaaacagcaggatgaatccaggcagaaaggagatgctttgaatctgattttttcctgcaacttccttttccaaaataaataaataaataaataaataaataaaaatagcggaatgatt

SEQ ID NO: 168916 - DNA, 364 bp, Homo sapiens
tgagaatgttattctggatcaatgcctagccccccaaattggctggctgccaagactgatggtaccacacatgtaccaaaagtatttgaaaagacttaactcacaaaatgagactttctggggagaacagggcagtcacccacactggttcacaatggtttgcatggaggggaggggcgggtggcactgatatttgtcatggttagtgaatgggctgggttgaaggttcccacatggcaggctggttttgtgtgatttgaacttcccaggggtgccaggacttaatccaacatgaagttttacttattataaaagccctatgtcctttttacataaaggaaaaatttattattacagaaaagta

SEQ ID NO: 168917 - DNA, 966 bp, Homo sapiens
ttctaaagaatgttcaattcagtcctgtctctaccagtttacatctatggaattactaatggggaataataagcttctatgtgagaattgtactaaaaacaaacagaagtaccaagaagaaaccagttttgcagcaaaagaaagtagaaggagtttatactaatgccaggaagcaattgctcatttctgctgttccagctgtcctaattctccacctgaaaagatttcatcaggctggcttgagtcttcgtaaagtaaacagacatgtagattttccacttatgctcgatttagcaccattctgctctgctacttgtaaggtttgaaagcggctgatagtgaatcagcaggccagtgggtccatgttagtgacacttacttacaggtggttccagaatcaagagcacttagtgcacaagcctaccttcttttctatgaaagagtattataactattaatggtaatgattatttaggtcatttgtttttgaatgccacagtgataactataatatataatgtgcctttctagtcttccctcttctgtaggaatagcatgttcctcaaatggtcctgaactttttcaccattttggtgaacccttttaaagtaaatttactcaatgctttaaaattcatagtcttaaaataaatgtgaattttgtttccaggtatttattctggggtacaaaaacttcccagaatttacagtaggaaaggaaacccctttatgatgtggcttattattacaagcattcagaaatgatgctggctaagtcaaatcattccttgagacagtgattcctaaatgtaatgccaccttcctgaactctcacatattctatatcatggttattttaaaaaatatatttttagccttttgtaaccttagtcttgttttgagcaatcatattccatgttttatgtgcttttatatttttataataaatattaaagtaaaactatta

SEQ ID NO: 168918 - DNA, 1120 bp, Homo sapiens
ttctaaagaatgttcaattcagtcctgtctctaccagtttacatctatggaattactaatggggaataataagcttctatgtgagaattgtactaaaaacaaacagaagtaccaagaagaaaccagttttgcagcaaaagaaagtagaaggagtttatactaatgccaggaagcaattgctcatttctgctgttccagctgtcctaattctccacctgaaaagatttcatcaggctggcttgagtcttcgtaaagtaaacagacatgtagattttccacttatgctcgatttagcaccattctgctctgctacttgtaagaatgcaagtgtgggagataaagttctctacggtctctatggcatagtggaacatagtggctcgatgagagaaggccactacactgcttatgtgaaagtgagaacaccctccaggaaattatcggaacataacactaaaaagaaaaatgtgcctggtttgaaagcggctgatagtgaatcagcaggccagtgggtccatgttagtgacacttacttacaggtggttccagaatcaagagcacttagtgcacaagcctaccttcttttctatgaaagagtattataactattaatggtaatgattatttaggtcatttgtttttgaatgccacagtgataactataatatataatgtgcctttctagtcttccctcttctgtaggaatagcatgttcctcaaatggtcctgaactttttcaccattttggtgaacccttttaaagtaaatttactcaatgctttaaaattcatagtcttaaaataaatgtgaattttgtttccaggtatttattctggggtacaaaaacttcccagaatttacagtaggaaaggaaacccctttatgatgtggcttattattacaagcattcagaaatgatgctggctaagtcaaatcattccttgagacagtgattcctaaatgtaatgccaccttcctgaactctcacatattctatatcatggttattttaaaaaatatatttttagccttttgtaaccttagtcttgttttgagcaatcatattccatgttttatgtgcttttatatttttataataaatattaaagtaaaactatta

SEQ ID NO: 168919 - DNA, 290 bp, Homo sapiens
tgggtttgggccgcgggtgggcttctccaggatgcgctcccttctggcctcttcccggtaggactccgagcccctcacccgcacccgcgatggggcagaggacctgtgtgggcctagcctcgcgagcgcacagagacacaggagcgccgggcgcacgcagacaggtgctcacgagctgggcaggtgcacaggaaggcacaggtgtgcccacagaggcaggggcacccccactcgcgggaaaagcaaatacaggaacacagaacggccccggccccgactgcagctttggc

SEQ ID NO: 168920 - DNA, 481 bp, Homo sapiens
tgaaaatcagaataagttttcataatatataattgtctcaatgtctggaagtaattctgcatgatcagtggcttcatatttttagatacttagatgtacccatttaaacgtcattttctttcacaaagaaactcagcgttttaaagaaggttcaaatagaagctttaaagagtccaagaatattatttcaaagccgtcgtcctctttcagaatgttagagctatcagcagaaagagtcggtacactgagaaaataaagctaaaccatccacagatggccaaacggaattttcattttggaagatattttatttctgctcttttcaagtctatctaaataaacctgatgtccctggaggcaggcatgagactaattagtgaggctaaaactgatcaactgcagaagccccatctctgaagttacggcgtgctggagagagtctaacagatgagtctttcctctgaagccccacagaaatgtg

SEQ ID NO: 168921 - DNA, 390 bp, Homo sapiens
agggttataaatatcagcagccaaactcttggttggctgtggagaacaactgagagactgtagtctccccttaaaggcacagaacaaggaagctccctgaagtatgtccacaaaggaagttcctcttctctttggcaatgcatcatcaaccaaacacctgcatcaacaactgacaactgtacgtaaattccagccagggaaagtgaccaggaggtgttaagccagacacagattaaggccagcaaaaataaagaatccagagcctggcttaaaggaaagctgacttagaagtggttgttgccactacacacagtcataatcagattatcagaaggctgcttgttacataaatatttaactagtaacctattccacctgaattctaagttt

SEQ ID NO: 168922 - DNA, 423 bp, Homo sapiens
ccaccccctaccccgtcccctgcaagcctgcaacaccccgcacccagacccgcaatccaggcggaggataaagggttgcagcggagggcgcagagcagatgctcagggcggggcagagggggcgggaagctggcgccacggtcgcggcgagggcgagcagccgcgcgctcccggtgctaggaggaatgcccgcagagcggaggctggcaggcgcgagaggccctaagcgcgcagtccgaccaaggggagttttacaggtcagcgccgagccgaattaggggactcaagccttagacccttgatttacacaaaagagaacccgaccctgcaaccggcgacagatggcgcccggacacgccgagcagccaccaatgcaaggctgcgatcgctgccctacttgcgcggccccacatgcgcggccgc

SEQ ID NO: 168923 - DNA, 978 bp, Homo sapiens
gagaccatcctaatttgaaatgttttatcctcttttcagcccttacttttggtttggaaaatgcacttagcacatccatagagtgcctgcttatcccctggggctggctgcttctgacagataccccaggctcttaggcttcttcccttttttctcctttatagttctcgcctcttttctaaagcttcttaatctgctctgagggaagccaaatcacaggaatgccaaaataattcagcatctggaaagggaaaagaagggtgggaaaggaaagggcaagccattcatgagtcccatgtccattcttgcaagtggaatccacacgttgattatttttattctaagcctggagcagtgtggaaagaaagcaaaggttagaaacaaagagttctggataatgaaaataatcacacagtgatagtaataataatgatgatgaaattagtatttattgagaacttagagtatctctgccactataaattattttaaacactttaaaaaacccaatctctataagaactccatgaggtatgtcctgatatcattactgttttatagtaaggaaattgtggtttagagatgttaaataactgaaatcacacagcttttaactgttggagcctggactcaaatccaggcagtctgacttcagagtctaagctcataatcactgtgatctgaaatcttcgttgtcctaaatgtatcagttcaaggctcttggacaagtcacttcaactccttaagccttggtttccttgtcagttgaagataatattacatgccttgactttaaaatatgtcatctcaattgcagttttatgttctttgcaaagagttattttacatgaagcactgctaaggaagttttaggcctttggcaagatgcaggtttgattttgtgggaatgttttggcagaactccaactctgtaatagctattttatttccctacttctcagatgtttccttaaaaga

SEQ ID NO: 168924 - DNA, 464 bp, Homo sapiens
taggataggaaaccatgttatttcttgggtaacatcatcactactatcatttttgtttccttgcttgataagagtgataaggcatgatcagcagtaatgaagggaataaaaaggtttgaaaatcctgtcttaaaagtaacttttgagaaggttaaggataaaatggtaataaagacataagctgagagaaaatattggctgaaattatgagttatataaacactttaagttgtacacaagccagtaaaaaagatattagacaggtagacacatatcaaaaatatttcacaaaatagaaagttgcttggaaataaacatagaaaatgttattttgatagttcaaaaaaatgaaaatttaatttttaaatttcttattataaacattttctatctatttgctgagaaggccctacagtcattgatacttaagtagcaataaacatgtctggtatccagatgttgaa

SEQ ID NO: 168925 - DNA, 231 bp, Homo sapiens
tggtagcttcgcccacctctctctggacaagctctgtccacttttagggccatggagggaagagcagacctgacctctgacagctgctgtgcttgcatcagagatgccagcagagttcacggggagctaccagcctatgcccagcccccaaggggcctggggtctgggatatgccgcagagaggcctggaacattaccttacctgctttcttaactaccgaggcagccagg

SEQ ID NO: 168926 - DNA, 284 bp, Homo sapiens
actactgatgtggccagcttgttttcaggcttaacactaatcatgatctaacagaataaaaaatgagagctaataaatttcctgtacactcgctacgtgactaaaaatgaaacagacgggaattactaatcagtcacttacaacgtggtttaactttaaccctttactttcatttttaggacttcttgtctattccaatctagctacttttcacaggggacctaagccatcacatggaattaaaagggggtcctagggcaactaaaattttctggcttgggcta

SEQ ID NO: 168927 - DNA, 441 bp, Homo sapiens
ttttcgttctggttcaggttacattgtaaatggacgacgacggccagggtcaaatgtgtatacctgcagttcgaatggaagaggagctcccgtttcaattgcacactgataagcgataattcccatttcttacctcagtctaatgactgggttgatgaccaagtctagagtgacacttcttggctttccctcttcttcagccccaattctatccccaataaccattcagcagtgaaaagaaagacaagaagggaataaagagttatacctcctttctaccagtaagaactcaatattcctttctccctacttctcaggaggtacagggaatgataaacctttctatgttgcaatgctatgttaggaatattccagattatgaattagatagggtttgtgagacagaaatctacctacgacgtaatatctataggaaagtat

SEQ ID NO: 168928 - DNA, 263 bp, Homo sapiens
aattgtgcagggactgcttgagtctttgtttttgttggtctgctaagaatgtgggtcagcataaggtagcgattcctgaacttatcacttgatcctttacaaagagggggcaatggaagcaacatggcttgtgaaactgtattccttaaagtagtgaacagatcaagtaacaaaaagagaatatctgcgtggaagctatacagtgggggcaagttattgatattgatacttacaggttagtattgatcaattaaaaaaagtga

SEQ ID NO: 168929 - DNA, 287 bp, Homo sapiens
gggaagaaaggaaaggagggaagaggagataagaaaatgatgtaaaatattaacagttggggaatttggatgaaaggtatatagggtgatattcactgcgttaatgttttaacttttctgtagacttgacaaattttacattaaaaagttgaatgaagaaaaaagaattcaccaggatatcatttgataacttctaaatgtaattttttttgagacagggtctcgctctgtcacctaggctggagtgcagtgacatgattttggctcactgcaacctccaccttctg

SEQ ID NO: 168930 - DNA, 405 bp, Homo sapiens
cagagacatctcaagagctttttacatcttaactgttaacagctttatgaattttaatggttcaggaaaagtttatttttcaccacaggcccagatggaaatcgctgccatcaggaatagctgaaatccccagctgtgataaaggagcagatttctaggcagaggaaatcagagtatgacctactggtgctgccatctgttcccctatgtggacccaagagctggggggttcctgtgggacccaggaaccatcagctgtgggtttgtgttttattggatttaattcagccaagcttcctgacttccaggcttccacagtcactcttgaatgtttggctctatcagatactgctactatatgctttttgataattttttattaataataaagttaattaaaattaa

SEQ ID NO: 168931 - DNA, 278 bp, Homo sapiens
gttttgccagcggagaatgacaaagtgaatgaagtttgacaggtgatggtgtttgcaaaggagatgaaacagaggagggagggttggggatgagaaatgaaacttgaggggaagcctgaggtttgactgtgaggacgagaggagtcggggagcagagaggccggggtgtcttatgggtcatccactaggagagtgacacaagtagtggtatagagagacacaagaccttggtgcacaagacctcagtgaaagcaaatacaggggaaataccatgacat

SEQ ID NO: 168932 - DNA, 176 bp, Homo sapiens
tggtgggtaggaaaaggtaaaaaactatacctgtaagaggtagagtattctaccaaggaggaagatgttcattcagaactaattccatcagaaatcctaattagaaatattagctaccagtaacagataaaaggaggtaacctttgttctcattctggtcaatttcaggaagagat

SEQ ID NO: 168933 - DNA, 543 bp, Homo sapiens
  misc_feature (514)..(514): n is a, c, g, or t
ccctgttgcagcgatgaagtatccaggtcacctggagaaagctgacataagagcaggcacacagcaggaagctttgatcctcatcttctctctggctgcagccctcagctcttgtgcaccaactctgaccaatgactaggactggctgctcggagtacagctgtattgagaaagattctgaggctgggtctgcattcagcaggaaaaaaaatgaagtaattgtttggtaatgcctgacataggcctaagaatgggggaaacggtaaccctcctgccaggttttgtagaattttctctaattcattttctttagagatacggtaaggacccgcccccacccaaatgggtaaaaggcaaagcctggtttccatttttttgtaaagcctcagatcacaggggcacctgagccattagtgtcccaatggcagggcaaggcaggcatgtctataaatctccagttttttgtttgcttattttcttctttaaactgcttacaatttctcctctttcatcnctcccatgggtaccgacaggaggtgtaac

SEQ ID NO: 168934 - DNA, 574 bp, Homo sapiens
tagttactgactgggaaggtgccaaggttctacctacacctaagaagtccctagcagcacgggcgccactggaatttcccacttgtcgctgctgttgatgcaaggaaatcgcaacataagaggaaaatggggttggagccacgaggcttgcttttgccacttatcttccagagttcattctgctacatggacagaagataactggagtgaaatagatatttccctatgttccttctgcatttggttggtcaatgtcaaagtaaggaccaaattccatctgatagctaagcgcacagaaggggctcggctctgggagcagtgagggtgttggcggatctgtatggcaatactcttaagacagcttccaccaggatgtgagcctcctgcttgggacctctgccccagctttcatagcatgccatggtccctttagaaggaagcccgaagtgcacattgaaagctgacctctgcttcattcagcactgcagctgcctggggccacttccactgacctcatcagcccctacaatcggaattcagccttgaaatctagacacttttttgtgctcatgtt

SEQ ID NO: 168935 - DNA, 514 bp, Homo sapiens
ccaggctgattgttgggagaaggacgtttaaagccttcgtattttatctaatgatcctgcccggatccgtctctactgcatgggcacccttattttaggaacatgtgagatttgagaaagacattgtagcaaataactattcaggttcattcggggtttagatctttggataaactgtgtggagcgcgagtagccaagcctagcatgctcgatgactggatctgaagctaaacaagttctagcaaacactaaccacgtggcctgcttagagtccccttgatgtgctggtcagaacccgaaagacgtgtgacaagcggaagaagacataaaggcgtcttaaattgtgtgatctgaggaaattcagttttgaaagaacagaatgtatttaaaacaacttttttttaaacgtaggaactaacaattttaaaaattcaatttaattttgatttatgtcgtgttgtcacaacagctaaaggttattattattgatgagagttcgttacagtgaattgaa

SEQ ID NO: 168936 - DNA, 350 bp, Homo sapiens
ggagctgactctctcctttggaaattgtgccttccaaaaatatatcttacactgcctgtacctgcatgcaataggttttggttcttaccaactgcagcttcagtctgaacttgagttctaccctcatggatgcaaatcaaaacagctcagaatcaagtctgggaagcaagtcgaagtggtttgatttgcatggggagcttttgtctctgcatgaaggcagccaaattccctaggctccccagccctccggaaatatgctttacaggacccgggggcccaggcccagtcgggtgggtgtgatttgaatgttctctgctacagctgctgcaccgggccctggtcactgctgt

SEQ ID NO: 168937 - DNA, 396 bp, Homo sapiens
ggtcttcaaacacagatcatacctcatgtggcaccagcagactcataccggggagaagccctatgagtgcagtgaatgtgggaaggccttctgtgagagcgcagcgctgattcaccactatgtcatccacactggagagaagccctttgagtgcctcgagtgtgggaaggctttccgtaggagtgcggcatacctgcagcatcagagattacacacgggagagaaactctataaatgtaaggaatgttggaaagctttcggttgtaggtcactttttattgtccatcagagaattcatacaggtgagaagccatacaagtgtgaggcgtgtgggaaaggctttacccgtaatatagatctgcatattcatttcagagttcacacgggggagaaaca

SEQ ID NO: 168938 - DNA, 384 bp, Homo sapiens
caactacagtgtagtgatttaaggacatggtttttctgaagacgcagacaattcacagtcaggacttccaagctccagaccagtgtaaccaacatatactctgcatctccacttggttatctcaaaagtatctcaaacccaacatgtgtgaacctaacctcttgctcttcccgccaaattattatttgccctgtgttccctcctgttggagggcaccaagatctatgcggttatacaaataagaagtctaggaagtcatcttggacactttgatctgctccattctccttcatctgactcaaccaggtctgttgattttttaccttctaaatatcttttgaatcctgtcaatttcctccatctttctcagtaccacctgggtcc

SEQ ID NO: 168939 - DNA, 201 bp, Homo sapiens
agagatggggtttcagcatgttggccaggctggtctcgaacttctgacctcaggtgatccacatgcctcggcctcccaaagtgctgggattataggcgtgagtcaccgcatctggctcgtattcccattttataaaccaaaaaactaaacctcagacaggactcagttgtggctgatttgatgactggcgaatttctttct

SEQ ID NO: 168940 - DNA, 653 bp, Homo sapiens
ccttttccagcctctgccagagacttccagatgcagctcccctggaggccatgaagaccaagaagaaactcaacacacaggaaatgctgcctcttatctgtcctgggaaagacacagacccagtcacactgagcccaccacagggtgcagagcacccttccatctggtcacatccggcttctcatgacatccaagtcatcgcacagacacgtgacagacttggccctgggactctggccttggccacgaggctgctgctggttctccctgctggaacccgggaagccggatagagaagcttcccctggcattcttacaccacccttcccaacacgcccggccagcccactcctgggggcctccctgcctccccttggggaagtaatggcagcccttaatccttaccctgttccgggctttgttcccagtgtcttacatctataatcccattgaagcttcacagcaaagctaggaggtaagtatcattgttatccccatcatcatgaggaaattgaggcccaggaggttaaggaaggtgtgaccacagcagatcccccatatgacgtcggctagtttgtgtggagaggtggggataaagcagttgtggaagtcataacgccatgagtgtgagcagcaaggcagtggctccccat

SEQ ID NO: 168941 - DNA, 966 bp, Homo sapiens
gtattcgcagcagcatcagaatctgtccctctgtacagctgccctcatgtatatactgaggtagaggatcgtttgaacatggatcttgatagagctagcttagatctaatgattcgactttggaactggaacaagatgcttcatcagccaagctactgaatgaaaaagacatgaacaaaattaaagaaaaaatccgaaggctctgtgaaactgtacacaacaagcatcttgatctagaaaatataacgactgggcatttagctatggagacattattatcccttacttctaaacgagcaggagactggtttaaagaagaactccggcttttgggtggtctggatcatattgtagataaagtaaaagaatgtgtggatcatttaagtagagatgaggatgaagagaaactggtagcctcactatggggagcagagagatgttctcacgagttttagaaagtgtaatgcggcatacatcccgaaaatcaaagctacgggatagcatataaagattccaacttatggtcatcaagtagagccatcccaagcatagggcacgaaccgctcagggagcccaccggggcgagggacgccaatgtaggcgacaggaagaccagggcaacaaagcgatatccagtagcacacgggaacagcacagggcacacaggcggcccacaacacacatcaaagtgacccaacagacaggagacaccacgcaacaagcgaaacaagatccacgaaacaaatggtatgacaagacgctgcaaacagtaccaaccgtgctatgctcctgcctcgtctgcgcctacctccggaacaagacacgaaaacgacaataccaaggacgacaaaagacaggagtagaagaacaaaacgaacaaacaaacagcagcagaagaacaaagaacagacaacaagaaacaaacaaagaaaaaaaaaagaacaccaaatagaacagcaagaaaca

SEQ ID NO: 168942 - DNA, 431 bp, Homo sapiens
gagataagatatcaaattttacataattcttactttgtaactataatttcttttactcactcttttaatcatataaatcaaaatctcacagacatttactagttagggatttttaccccttacataaacaaacactggcttcctaaagggaatattttgggttgtcataacttcattcaagcatttttcagttaagttaaaagcaaaagtaaaatcactgcaaaaatatagctgccattgtacatctactactgctgagtaataatgcatgaatgaagacagccccttacccatagccagtcgcttgagagaaacttgaataagcaaatcaagcacaagcaacagaggcagacagaggatgattgcatgggtcgctgaataattgacattgccttaacagttgaatattttcagtgtattctaattctgag

SEQ ID NO: 168943 - DNA, 266 bp, Homo sapiens
tagaacttctgagacagaggccagctctgtgacggtggacttactcttgagagatataaagctgaggctgctagagccacctggttaccacgaggagagagactgcctcaggatagagccaacatagcaaaagtgacccagagaaatatatagagagaaaccaaacctttgtgatgtaatttaatggcttgaaccagcagtacctgaagccagcttgtcctagacttttgagttgcgtgagccagcaaattgcctgattgtctgag

SEQ ID NO: 168944 - DNA, 429 bp, Homo sapiens
acaggacccaacatcatgccctgccccctactccagccccccttactcatgctccagctgctctccttgagatacaccatgctgtttaatgcttcctcctctgcctgaaatgacctccaccccttcccatgcagagaacttctactcatccatcaagacccaggttaagagtcccctcttctgctaggcaccctcattgcccacttaaatccagcatcttcctcatctcttgtcccagtgaacagtaccccccgaccctgcactgtttggtctgtgcctgccctcactccatcctgggtagggtcactcctgtggccccagtggagttggatgggagcaggcctgtggccagtgtcctgttaagcccttagtggagcagctaaggtcagacccaggtcgacgcggccgcgaatttagtagtagtagacc

SEQ ID NO: 168945 - DNA, 208 bp, Homo sapiens
aatgaaattttacatggacacaaatatctaggtgcagggaaaattaaagctgagatattcagactcactgccagttggaggaaaaaaatcagttataacgcattttttggaatagagggaaataatttgataagtacaactttttgtttgaggtgtagctaatgttagacatgactgagctgttctacacataagtgttgaatagtga

SEQ ID NO: 168946 - DNA, 434 bp, Homo sapiens
cttgaaaggtggagctattgtctccttctggggcagggagcaaatttgttttccaaacagtgtaataaatgtttccctctgggcagagtttgggcgtgtttgctagcagtcccattagaagagtggggatttcctaagtttggagttcctcagctttggcacaaacccagttgtgcactgcatacccctggacccacattcacatggctcccttgatacttggggagtcaggaaaactgatgtgaatgtaaaacttatgtcactacctgccatgccatcagtaagaaagtcagttgtctcagacataaggtgtctcatgtatctgccaagtttgatgaaagggtagaaagctagtgtgtagcttgcaagtaggataaaagctcacactcttaacagttcttggccaccctagatctgggacagaggacaatagg

SEQ ID NO: 168947 - DNA, 374 bp, Homo sapiens
actttcacaaataatagacagttattcttgttttccttctagaaacattgaatttttttcctctgctttgcatcatttgagataggtccttaagaagcagctaagacctggaactctagcacggtggaaagctgaggcaggaggatatcttgagttcaggaatttgagaccagcctgggcaacacagtgagaccccatctctgcaaaaaaaacaaaaaattagccaggcgtggtggcatgcacctgtagtcccagctactcaggaggctggctggaaggatcacatgaggctgggagattgaggctgcagtgagctgcaatcacaccactgtactccagccctccagcctgggtgacagagcaggatcctgtta

SEQ ID NO: 168948 - DNA, 162 bp, Homo sapiens
ctcctattcgcccctccctcaccttatccttaaacaactactaacctgttttctgtctctgtagatttccctattctggactttcatatgaatggtatacaatatgcagcctcttgtgactggcttctttcacttaatgtaatgttttcaaggtccattcat

SEQ ID NO: 168949 - DNA, 281 bp, Homo sapiens
atcacccccgacacctttgttcctgcctcactgcaaatcccttacaagttgtgaatggtgaggttgctgggacttcaaggtcactatgtgtgtggtcctaacaagggaagtggagtcaggctggcaggagcaggggaaagcagaaagaaaaagcagataaactgttaagtctgcctttcttcctggtccagggcgtgtagccctcctgtgcaaataactcacaatcttcctgcacttatcaccagacactgtggctgatagaaaaatgaaagttagctcac

SEQ ID NO: 168950 - DNA, 396 bp, Homo sapiens
gttcttgtcacaggaacaactcatgatggatgtgaaggcttactttcaaaaaatttatcacaaattgattccattcatcacttcatatataccttattctactaagtaacacaagatattaaaaactgccaagtctccacgcatccattcactatcagcagcaataaagattacatgtgctgagtgctcaccgcacgccatactatactcagcttttctattatcttactttaaacctccttacaactccaaggagggtgtcattcctttttgttgttgttgttgagatggtgtctcgctctgtcgcccaggctggagtgcagtggtgcggtcctagctcactgcaacctccgcctcccgggctcaagcaattctcctgcctcagcctcccgagta

SEQ ID NO: 168951 - DNA, 301 bp, Homo sapiens
cgtacaaggccccgccaggttcgaggggaataaaaggagctgagcccagcctttgttctggcttcattctcggctctgcgcagacagtgggatcagacaccagaggcaggagagtgacggatggaaagataaggagggaagattcctgaatcagcgtcctggataaggtggtttgaccccaggactgagcattctgagttgtacctgaaagagggcagcccagggtgggcaggtggctgtgccacctcaaggaggctggcactggggtcatccatgtgggcaaatgcgggccttgtacgga

SEQ ID NO: 168952 - DNA, 567 bp, Homo sapiens
gaccttgagggttggccactttcttttggttaataaaatgtgtgtgaacttgatatttgctgccagagcggaagctttcagtggtgtggtttggtgagacctgcttcagccttgacctcccccgtgagaacagcacaccttagagagttgctcttccttcagtcctggctcctggaaggagacgataattgtggctgagccaaatccagcacagctgagcccatcagagtcacagctgacccacagtcaacctgcagccctcatgaaacataagcaagaaataaatagtttttaaaaccattgagaatttggtgttgtttgttgctgcaccaaaagctgaccagtacggagtctgaacacgagtctggttgactccaaaaccattttagaaactctctgtgaaaatggacactacttccaggatgatgtctaatatggtttgggtctgtatacccacccaaatctcatgtcaaattgtaattctcagtgttgcaggaggggccaggtgggaagtgattggatcaccggtggggcggacttcccctttgctgttctcatgatagtgag

SEQ ID NO: 168953 - DNA, 192 bp, Homo sapiens
gaatttcctagaagtagatcctaaggcaaagattcaaatataaaaattttatttggagataactctaggatattaatttgactgccagttcttccttagggtgctaatcccaggaaacaccagtagaggagtggggaacagagataggaaaggaatgcagcagttaaagggactttcatcaagaaagtttcc

SEQ ID NO: 168954 - DNA, 324 bp, Homo sapiens
tgagccaccatgcccggcccttcttttttcttttgagacagggtcttgctccatcacctaggctgcagtgcagtggtgcaatcacaggtcgctgcagcttcgacctcctaggcttaagcgatcctcttgcctcagcctccctagtaactgggactacagacacgcactaccacatctggctaattaaaaaaatgttttgtagggatagaggctcactttgatgcccaggctggtctcaaactcctgacctgaagtgatcctcccacctccgctttccaaaactctgacgttataggcatgagccatcatgccgggagattactg

SEQ ID NO: 168955 - DNA, 349 bp, Homo sapiens
tgcctgtggtactctcaatattacaagagcaaaccatgaagtcaggtctatttaaatgttaaatttgttatttccagggtttgtgtcttgttataatttctcttagtttctgattaacctaattgtgggataatagctatttggcagaactaaaacgtttatcttttctagtactctggagaggtaacaaactcatagcatacataggcttggcaattgtggctcaattgtggtaaggacagaacacttctcaacctaaccttctttattagtgctaacaaagatgtcagttatgccagggatttgctcaccagtaaacaaagccaatatagttaagcatattggtttt

SEQ ID NO: 168956 - DNA, 627 bp, Homo sapiens
ttagtgggtgcagcacaccagcatggcacatgtatacatatgtaactaacctgcacattgtgcacatgtaccctaaaacttaaaagtatataaaaaaaaaaagggggggtatacacacaatcaggtgtcaagcagtggcacctcgtgcaaaataataaactcatctaagatcctagcagttcattctgaaaataaagctggaaatatatcttggatatgtaaaatgtgagtgtaaaaattaatgaaactaagcaatgggaatatgagtagtaaattatttgagaaaatattataacatttacttttttaaatttcaaaactatatttccttatttaaaactgaaaatttttgtgtacatataggaaactaattgtgtcatttttctttttgttacaatatagagtgatgtttcaaaacacaaacataataggtagagtcaattacttaggggagtctaaacctggaggtaacattagaaatagaaataataaaatgcagtgtttttggatttgtctgttaagattattttaatccagatcatatttaatggtttacatagttgtatatcaaatttggtttcagaaataaattatacagtaaatttaaaaatgcaaaaaatgtatatt

SEQ ID NO: 168957 - DNA, 645 bp, Homo sapiens
tgactgtcacggggctgtgtcctctggtcctggactctccctcccccaggcagtgtctggtctggatgctgtcactcggcatgaggggtacgcgggaactgggctgagagtggctggctgtggccagcactttgggagggatgttggggcaggcccgtgggttggggcatggtctgtggaggccttgcctctgggcctgtgtttccccatctgcagtagagaattggacttgatttttgtaccctgttagttctaaggtcctgatcctgaggaagtcactgggaccagagaggctatgagagcctgagatgggtgacctctgaaggaggggagctggtctggccgcccctctaggcctcagtttccccatctgtgcagtgggcagcctgcagttcacactttcatttagatgctgacctctttctttcctttctttctgttttgagacggagtcttgctctgtcgcccaggctggagtgcagtggcgtgatcttggctcactgcaaactccgcctgggcaacagagtgagaccccgtctcggggggaaaaaaaaagaaccctggagtttacttcctgccaggtgacctcctgggggagggagccttcaagcgagcctggccagaagcggggagaggttgggtgct

SEQ ID NO: 168958 - DNA, 432 bp, Homo sapiens
ctgagagtggctggctgtggccagcactttgggagggatgttggggcaggcccgtgggttggggcatggtctgtggaggccttgcctctgggcctgtgtttccccatctgcagtagagaattggacttgatttttgtaccctgttagttctaaggtcctgatcctgaggaagtcactgggaccagagaggctatgagagcctgagatgggtgacctctgaaggaggggagctggtctggccgcccctctaggcctcagtttccccatctgtgcagtgggcagcctgcagttcacactttcatttagatgctgacctctttctttcctttctttctgttttgagacggagtcttgctctgtcgcccaggctggagtgcagtggcgtgatcttggctcactgcaaactccgcctcccaggttcacaccattctc

SEQ ID NO: 168959 - DNA, 484 bp, Homo sapiens
gttgataatgcactgctgctctttgtatattatgagctctatgttgtctcttctgacgcttgcccttgggcatgccatgtggatttctttttgtctgcttacttgccatttgagtgactgttaaatcaccttctcaggtctgaagttaaaaacaggtagatgtcacaggcgtgtctggtgaacagaaatcactcatccactgtggctctgttaaacgggggtagaagcttctccttccctctcctgtcctatggctctcagtactggagcataaccatctcagcacacctgcacctgcaatcacgttcttgctgtcacagccccaaaactgtggagactacacttgtcacaatgtggtaagtcatctgtagttcccatgcttcctcagagcaccccccactttcctcttggaggtggaagctgtgagtaaatgtaagaaaaaaatcatcagtggaagaatgtaccttaactacagtataaagca

SEQ ID NO: 168960 - DNA, 691 bp, Homo sapiens
aattttaaaaattaaaaaaagtatgagctgggcatgatggctgcacagctgtagtgccagctacttcagaggctgaggtgggaagatcacttgagcccaggagttcagggctgcaatgagctatgactgtgccttgggtgatacagcaggaccctgtctcaaaaaacaaaacaagaacaacaaagacaaagacacgcagagtgaatgtgaacctgtgtatcacggggaagttatttgaagatacatctcaacagctatggaaatatcaagccctttgtacacagtgattccacttctgagaatctaaaccccaaataatccaacatggagaagaagccttagaggaactgatgttcatcctgcagtggccaaaattgctcaaacctgaaaagccagccttagtaatcaagatgagggtgtaattagcacaatcccgatgaatctcatttgtgaaattgcagacagccattacaaatattgtttacagcaagatgagttaatttttgtagcacacacacaaaaccataatgtgtaatgcaaaattataatgtgtaatgcaaaactaggttgcaaaagcaacccaattactgagatgacaggagccagcacccactgtcccccatggccacactgttggtaatgtcacacatgatctctccggagggcaatttggaaattcctactacaatgt

SEQ ID NO: 168961 - DNA, 152 bp, Homo sapiens
atatgtggctcagtcaaaattacgcaggctggttcagctgcagttcaagtggcgtatggcgtgtggcctggggtgttgctgggcaacattactgcctgtccagctgcatgccgagggtggtgtttaccttaaagagtacaccctggtctaag

SEQ ID NO: 168962 - DNA, 210 bp, Homo sapiens
gaaaacttaggttttcatcgataatacataggagatggaagtatttgaaagctgtgaaatgacagtgatatgtctaaagaatatgacattggcggcgggcgcggtggctcacgcctgtaatcccagcactttgggaggcggaggcgggcggatcacgaggtcaggagatcgagaccatcctggctaacacggtgaaacctcgtctctacc

SEQ ID NO: 168963 - DNA, 393 bp, Homo sapiens
tctgctgagtttgctccctccccactctaaagcaggttttctcagcccttttggtgccatggactcctcagaatgtctttaaatatacagcattgcaaagtacaccaatggtgttgaagtatagttctcaatataaaagccagcactttgggaggccgaggtgggcagatcacctgaggtcaggagtttgaaaccagcctgaccaacatggtgaaaccacgtctctactaaaaatacaaaaaattgctgggcatggcggcaggggcctgtaagcccagctacttgggaggctgagacaggagaattgcttgaactcaggaggcagaggtttcagtgagccgagactgtgccattgcactccagcctggacaacaagagcaaaactctgtctca

SEQ ID NO: 168964 - DNA, 321 bp, Homo sapiens
catctttgcaggtggctgtctgcaaaccaggaagtttcctcatggaatcagattggccagctccttgattttagatgtttagcttccagaattatgagaaataaatgtctgttgtttaagccacctaactggtggtattttgttacagtggtgcaaaccaagatgggggcgggggggtgcggggagaaatagagacagagagacagagagagacagagacagagatggagggaagcaggttttcctgaattatggggttttattttttcagaaatttctatatttttacaatgagaatatcttcaacagatattttcaaca

SEQ ID NO: 168965 - DNA, 402 bp, Homo sapiens
tttgcactcctataatcagtatttaacaaacagtcatttcccttcaggatttttttttttttaatctttaaaagaacacaggggtggggagagagaagcaaaataagcttgaagcatccatgaactaagcactgccttttcaatttgagtagtcctttttttctgcttggactttcaattttgaatgacaatggctttcccagtcttttgccagcttaggtaacaaaggtagggaagcaggataaaaactggttgccccccaaacatagcactattaacctaattatacagaagctataaaaatgttttttttgtttttttttttctgagaaagggtcttgctctgtcacccagactggcgagcagtagcgcaaacactcatcactgagtcttgatctcctg

SEQ ID NO: 168966 - DNA, 222 bp, Homo sapiens
tggatccagagacagggaacagcatacttaggtctgagctaataaaaatagataagaatcaatcttagacaatagttattgcagtgtctcaatgcaaaaaacaacatgaggtatgtgggtccaactttgggagcttccttccagcaggatacagacacactgcaatatatttagagaagagggcccaaggcagggcagggaacagaaaccctgtcctatggg

SEQ ID NO: 168967 - DNA, 601 bp, Homo sapiens
agaaacatttcgcccacacagctgcagataccacaagaaaatggtgccagcaagaatgaaaatgcaaccccaaaggcctccacgaagccacccagcggcgaacacagcccgacagccggtgcgcagcaaaaacacaacttgagagtgcggccatttccttaggtatcatgacaacagcgttgctttctcctctccacagaatctgaaaccactataaccctacttttcttgactactcagggtcatgtgaccaacacgaacgtgtttatgacaggggcctcttgaccataacgcaaccgcatcacggtcagcgtgtcagatacctggagaggacctcacagaagctctgggatctgtccagaacccacacaccagcaggcatcttgctcctcacagcagcagctgtgagtgaagaccaacagcagagatgggctgcagcagctctcccttcctcccataaggagtcatcagggacctctctgaagacaggtgtgtgccctgtggccagacaaaaaggccttgggtggtggttcacaactgtaatcatagcacttcaggaggacaaagtgggagcatcacttgagcccaggagtctgagact

SEQ ID NO: 168968 - DNA, 383 bp, Homo sapiens
tacacgtcagcattatcaccgtgacgaggtgactacatgagggtgagtccaggaggcaagaattattgggggctatcatggaggtttgataacataattggtaagaaattcagatacacctcagacttgattgtggcataccagtgtgttgtaaaacttgtgagaatggcttgccttagaaagacaagtagtccatccagtgtcttattcttatgttaagttgggattgctattttgttacccttgggcctctatatacaaagcctctcatagtaatagatctaattgggttgaagtttagtattatgtatatgccctctgcttttattagtagattttactttcgtgaaaggaacatataaacttcattattgcatttttgt

SEQ ID NO: 168969 - DNA, 667 bp, Homo sapiens
ggataatcattacagatttggggacattgttgcccatggtgtggcatattaaagaacaaaataactccattagtttgacctttctgtgaacatttgctacttttgcaatggaatcatgcaagtatataaaattgcttttattacagacatctctgtattccacctgcctttttttattttccatttgcagtctgttcagttcaggaagctgctataacacttggtgccagtgttcccaaactctaaataatgtgttttccatttgcactaaccatcaggaaactagaatttctggtttcctcaggtatgtgtagtggtcattagtgttacgtgaaagtctcatagcatttgattataacataaggtatttagaaaaagaaagttttctgttttaagttagctctcatgttcttttgtattctatatgaatcaagtaaatgctttagggatattaacctggaaaaattattgactttgtaagttcacaattcatgtaaagaaatttttataaaatatgggagaatttaaacatttgacaggaagagaacaactttttaaatttgagatatattgagttcagagaggttagtgatagctggaaattttattcgccctagtaattattttgtttacattaaaaaatctgtaataaagctacaaaatagta

SEQ ID NO: 168970 - DNA, 364 bp, Homo sapiens
ctactagaaagacaggggatgtaaaaaccaggagagaaggcaaacacttggagtgggacactggccaatgttgctgcaatgtaatagaaaagggagaagtcataacacataagatagagaggtggcatgagtccaatcccatatggctttgtaaagcacccttaattgagtatgaagctattggaggtccttcaggagagaaatgaccttatctgttttatgttttaaaatactcactctgacctagtattagggttctcccccaaaacagaaacaatgggagctgtgtaggtaggtaaagagagagatttattgtggaaattggctcacaggattatagaggctgagaaatcccatgatatac

SEQ ID NO: 168971 - DNA, 341 bp, Homo sapiens
tggatgtcctattctcatctcagatcattatgttcaccacaaagacttggtagttttcttctgagtaaactgcatgcactttattcagggtcctgctggcccaaattgggactggatcagttagaggaggcttccatccagatgaagctcgctgccaggctcccagctaggcaagtggagcagaagctggatttcaaactgtgcctgccccttggctgagctgctttgtgcagtgcacagtgtgcacaaatgtcaatggtggtgctgagcttattgcaagtagtaatgtttccttcacaaatgaaaaattctactatgtttattttttttcaagtagcccc

SEQ ID NO: 168972 - DNA, 531 bp, Homo sapiens
actcgctgaccattaaatgcaaggaaagctctcttaaaatggacacagcactaactagaaaagaaaaatacatataaactcttgagtcttaaagctacaaatctgactgtaaaaattgacacagattgaaaagacgcctgagacaagacaaacataacaagattggtaccatgagcagaggatgagtgagcaaatcttcgtctgtatttacagccactccccgttgttcacattactgcctgagcacctcctgtcagatcagcggcgacattagattcttacaggagcatgaaccctattgtgaactgtgcatgcgaaggatctaggttgcacactccttaggagaatctaatgcctgatctgtccctgtctcccatcacctccagatgggactatctagtttgcaggaaaacaagctcagggctcccatttaagtgggataattattaagctgtatagttatttcattatatattacaatgtaatgataatagaaataaagtgcacaataaatgtgcttgaatcatcctg

SEQ ID NO: 168973 - DNA, 321 bp, Homo sapiens
atggggaacacagctgccaggtacaccaggtatgcccccttaacacatgtagggtacaccccaaagcacttccagatcaaggcctcggctgggcccatcgcctcaacagcttttgcttcagtaagaatggggcacacgtaactgaaggtctgtgaagtttctgtcctctcgatggccacaggtgtgtctgtacagctgtgagccatgtgtacccactagacttgagggaaagacaagcctgtggttcagaacttcccttgaattaaaacccctggcaaaactggcaatgggctctaatgaggagtggatacacacagacaa

SEQ ID NO: 168974 - DNA, 297 bp, Homo sapiens
tttcacatcagtatcatatcacattgctggagatcagctttttatcaacacagggagacatctccatgtagtggtgagctcagactatggagtcagaaagacctgggtttgaatcccaattatggctcttaatatgtgtgtgaccttgggcaagtcactcaacctctctgagcctcagtttccttttctgtaaaacaagaatactgtccaggattgtttatgactattgggaataacatactaagtgtccagtacagtggcaacgtattacatataggtgctcaatagagttatctt

SEQ ID NO: 168975 - DNA, 256 bp, Homo sapiens
cttataaagttgctgatgatccctttaagtgttactaattggaaaatccataatttctgggacctcgtgtgtattgcttcccattgtatctctagattctaatgtaagtgcctggcatgtagtaggtgttcaataaatattcattaaatgaatgtaccaatgaaatgtaatatatatgactctgtcatgtaggaaatccctgctattgttaagttcaaatacataaactatacttactctgtcaacttgttcctgt

SEQ ID NO: 168976 - DNA, 484 bp, Homo sapiens
ccccatctctacaaaaaaatacaaacattagatgggcgtggtggcgtgcacttgtagtgctagctactctgtaggctgaggtgggaggatcacctgaggctgggaagttgaagctgcagtgagccatgattgtaccactgcaacccagcctgggtgacatgacaaaagacatgaaaaaaaaagagagagaaagccctcttcttctcttcttagcatttcattctccttttttgatgtttgtaaaacaattagagagtcctgtgcaaagctgatatttaacttacccccagatgccaatagcactcaccagtctttgtgaaaacactgcccctgcctttactaccaaggatgcacctgacccctggggcaggcagtgatactgcccagaaaagaaacactggggccgggcgcagtggctcatgcctgtaatcccagcactttgggaggccgaggcgggtggatcacctgaggtcagaaattcaaa

SEQ ID NO: 168977 - DNA, 382 bp, Homo sapiens
caagaataccactagtaaaaaatgtttaacaatatttctgctacctagtgccagggtcttttgattccttacgttccatctgggatgaggttcttcctcattgtaagtcctgcagtgagcaatccattccccaaactctgaaaggttctgaaacagaatactgtattttttcacctgatgttaaaatcaaggggtccaatcatttgcagcagattttattttcaaacaggttttttaatgaataaaatggagaaacaatgagattaattttatgtaaaacaatctgaaatttaaaatctgctcgtccctcatacgtaaatttacaaaccaccaaaacaaccaaacaaccaacaaaccaacaacaaaacagtgtctattaaga

SEQ ID NO: 168978 - DNA, 413 bp, Homo sapiens
agggacactttgcagtgtaatagaagatcaccggacatcaaaaaggaactgtcccatagagccaggatatgtgaggggagagtggtacaagtgggtattagaaaggtagttaggggccaggtgcggtggctcatgcatgtaatcccagcactttgggaagctgaggtgggcagatcatctgagttcaggagttcgagaccagcctggccaacatggtgaaaccccatctctacttaaaatacaaaaattagccaggtgtggtggcaggcgcctgtaatcccagctacttgggaggctgaggcaggagagtggcttgaacctaggaggcgaaggttgcagtgagctgagatcatgccactgcactccagcctgggcaacagagttagatgccaacacacacacacacacacaca

SEQ ID NO: 168979 - DNA, 287 bp, Homo sapiens
tgcggtaagctattcggttcaataattataactacagttaaactgctgctaaatcaattttaacatatggctcaatcttgtattttacaaatcatttgaagatatcaatctttgaatttctttattgaaaggaaatctaccatatgcttcaatatttaaaacaatatgtctcactcccaatcacaatcctttctgtatctcatttcttcaaacatttcaatacaaaatttttttttagttttatacccttccttccaactagatttaacaattgaactggtttgccg

SEQ ID NO: 168980 - DNA, 272 bp, Homo sapiens
ttgggtaggggtggataaagggaaaattcaaggcatcaaaactgaactgtcaatgaaacctgtaattaatgtaaaaaaatcatcagtaagtttaagtagaccaaaaaaaaaaaaaaaaaagagggagttggaaagtttggaggaaacccgggccgggccggtgtcagttttcccactttaaaaaaaaggtgagggaagagaggaattggaccaactttttggtatcggcaaatgtgctactcctgggaaaggtggggggaccctctaaaagt

SEQ ID NO: 168981 - DNA, 361 bp, Homo sapiens
atgtgttgggctgaataattcatgatgcagtactaattttgactctggagaaaattgctttctcactgtgccaaaagctaggcagtgagaccaaaaatcaaagaggaagctaaatggaggggagaaaacaccctaaatcaacaccatatcaaattgacaaactgtttaaggctgcaaaatgtattgtcaaaacatgtgagtagatattttaaaccttacctaaaattgagcatatttatgcctacttattttgagcaataataggtagatattaaataattattttcaaaagtagctccttgatattaatgcagagagttccagtaaggaagtaagcatttgcatttcattggaacttggt

SEQ ID NO: 168982 - DNA, 378 bp, Homo sapiens
ggaagttacaccttaaatcagttgccaagaataaagcaaatccttggttttgcatagagaggtgaaggatatcacctttatcctgatgttattgtgtgtggtgaaatgtagtcaggtaaggctttgactttggtgtttagccagctttttttttttgggagacagtcttgttcggttgcccaggccagagtgcagtggcgcgatgttggcttactgcaagctccgcctcctgagttcacgccattctcttgcctcagctacttaggaagctgaggcgggagaattgcttgaacccgggaggcggaggttgcagtgagccgagattgtgccattgcactccagcctgggtaacagagtgagattctgcttaaaaaggat

SEQ ID NO: 168983 - DNA, 182 bp, Homo sapiens
agcaaacacaaaaataagtgtttttgttttgatctaagtgacttagcacaaataaagacttctgaagataaatgtttaaaagaacctacagaaggagcagggcccacgccccctgcctgtggatatgcatgtgttattttaatatccaggccccaggtctccagctctacagcccccgtagg

SEQ ID NO: 168984 - DNA, 309 bp, Homo sapiens
taggcctggtagctcccacctgtaatcccagtgctttgggaggcccaggcaggaggaccatttgaggccagtttgagaccattctgggcaacatagccagagcctgtctctaccaaaacagacaaacaaacaaaaaaacaaaaaattaacaacactttgaaaatgtttaaaaacattttttaaaaataactcacaggctatacaaaaataggctgtgggcaacatacagtcctaggatcatagtttgctgatctctagcctaggcttcaagtagaacaaagaaaaaaaatcaactgtgccctatcctga

SEQ ID NO: 168985 - DNA, 428 bp, Homo sapiens
ggtaagccattcaagtctctccaggtgtgagtgtgtacatctgcactttgaaggcattggacgaggtgatttctgtactagtttcctgtggctgccctaacaaagtaccccaaattgggtggcttaaaacaaatctattctctttcagttcacaggctagaagttttcaatcaagttcatgggcagggccatgcttacattgatggctctaaggaaaaatctttccttgcctcttcctagcttctaatcattgctggcaattcttggcatttcttggcttgtagctacatcactccaatttctgcctgcattttcacatggccatctttcctctgtatgtctttgtgtctctcctcttcttataaaaacaccattcattttgcattaagggcccaccctacttcaatatgacctcctcttaactgatt

SEQ ID NO: 168986 - DNA, 347 bp, Homo sapiens
attcgatggtgtttccattcgattcattcgatgttgattccattagcttccgttggatgatgattccattcgggtccattcgatgatgatcacactggatttcattccataattctattcgattccattcgatgatgattccattcatttccatccgatgatgattccattcgattccgttcaatgattattccattcgagtccattcgatgattccattcgattccattcgatgatgattgcattcgagtccatggattattccattccattccattagatgattccattcgggtccattcgatgtcgacgcggccgcgaatttagtagtagtagtaggcggccgc

SEQ ID NO: 168987 - DNA, 454 bp, Homo sapiens
ctaggaacagctcaaggatttgcacagcagaatgaaagaggagctgtcactgagttccttaggactcacagcttgaaaggaaggaggaggcccacagggggcctgaggaccaagcccagcaggggacgctgagcacttccacagcccagggggtgggaccagagctcttaaagccacagatctcctctgcaggcacagagaccctcacagcagggatccattcacaccagtcacccttggagactgctatttatgctaaagaaatttatcccactgcattgtatgcttcttgtccagagttctcttggatcccttgtttacggccttagtcttatattgtgagcagtggaatggacaggccatttaagagggcagggatggctaatgatgggtctgttagccctgcagtcagtctttcctttgtgaaccaaacccaatttgggtgcatttgcta

SEQ ID NO: 168988 - DNA, 525 bp, Homo sapiens
gtttgggctttggacagagtactgtggctatttgtgtgtggaactcaggaagaggaggaactagaggtggggagatgagctaagaggccactgagggtaccacaggtgagaggtgacaagctcccaatcccagaccatggtggctgcagaatgtgaaaacttctcaagagatacaagaagcaggactcataatatacaggaggccatgatggttgcatttggaaggaagagaaggaaggaaagcaggaacacatctttccctggtttccagctcacatgggttcacccgttgaagcatagactagggggagccagcaggttcaggaggcagccagtggcttcattttggacaccttgatgtgaggtctgagtatatgtttccagtaagaagttcagtggcaggtccatagctactgaaggaaagattggtggtggaattatcaacgcaggacgtggcctggagacgactcatgagtatgttcaaatcatgagtatgatggagaccaacacagacccaggatgcgc

SEQ ID NO: 168989 - DNA, 507 bp, Homo sapiens
cgctcccccatccctgctctgctctgaggtgccagccagagccgctcagggtcctccgtccggtttcccgtgggcctaacagcagggccctggggccactacccgcacctccctgcctccatctcagaaactgaagcctgggagccccctgggccacctgagtctgggagacgcaagccaatcccggggacaggccccggccccttcctagtgaggggcacgctctggtcaatcgtggggcagagaaatttgctttttaacataaaacgtatcctttgtccctagaatggcaggctacctccctgccttattctgtgaagatgtagttcttttattagcagagcttactttgaaggtagaataacaataaatatataagcagttggagagtaaaatcactacagtattcaagtctaaatatattacaaatgccaagttttattggaaaattatatataaaattcttatatacattttagtaagcctccatcttagtatctaaaactt

SEQ ID NO: 168990 - DNA, 416 bp, Homo sapiens
tgtgttctcagcagttatatttcaaatggcttgaaaaaaattaatggaataaaattttgcatctgatgggttacgtttagccagcaaaagggattttacctggggctccattaaagcctgcactcctaagtcctattctcaatcccaccatcaccattgtgcctccatcaacagatttttatttaagccaatgcgtttagagtacaattccgtggtgaataacctttaaggttacatttgccttttccctgcttcttgcaaacagtgcgtaatccacaagcacatttgttggctgtaaaggtgtacaacagcaatttttgcaatgacagtgcggagagggaatatgagatctgtgtgctaatgagctgacactgcagaggctggggcggtgtagtgtggagtgcactacaagtgca

SEQ ID NO: 168991 - DNA, 502 bp, Homo sapiens
ctgcttggagaaaatgaaagttagcaaaaatcacctttctccagatgaatcgttgtgggaaagtaagtttagcagaatgtgctgtcaacttggttgagataaggcagttggaggactggcattattaaattttctgtggtgcaattaggggtcctcctaagtgcaggtgagctgtggtgaggagttaatgtatgctcagtaaatatgtgctgaatgcatgagcaaggcagttattaatctggttatcattggggattcacaaatttcactttatatcttgtaacaaatctcaaattgtgcccctgaaacatctggattttgaaaagtgattccaatccattgtcatgggtggcactattcccagaaatcaacaaaggaaatccaagccactgagggtttttaaaaaattttgagtattaactagactgttatactcttctgtgtttatatgtagtaccaataatcaagacaataaatccatctttaacaataatataaaaag

SEQ ID NO: 168992 - DNA, 600 bp, Homo sapiens
gcatttgtgtgaaaattcttttaaatattttatccacaccagcagattaaaagggacacaaaaaatacctttaaatgcatctatgagtttttgagctagaaagtaagacatgcaaaatctctaaatttgaaaagaagatgagatgaaaaaaataagaaataaagaaaagctgagatttgaccaatttgtcaattgcgactcatagaggagattcttgccatatggaaatactgtagttagtaaacgatagttttcccctcaggatattcaagcacaatatctatttgagaaaggcaatttatttcttaattttgaagaaagatcctacggactgataaactgtgaaaggacccaacagtgtaatctagagtgagtcaaaggcaattcgactttctgatactggcctttaccacagctgagagtaggactgtgtaatcgttaatcagtctgcatgtactggtatacttaatattaaaggtttccaaaaacagaggaagggtacataagatggataacatatattccagagggaaaaaattcataagctacctgtgtcagaaaactaatttttgttgatggtggggattaattactatgata

SEQ ID NO: 168993 - DNA, 462 bp, Homo sapiens
acgcagggtcggattttaaacaggatatccagccggagacgaaggtaactgttgtcttggtcactgctaagaagcacctgatcgtgcaagacataccgctcatgagaaagaaatgttttcaactctttgtggcaccctgctgggacaggctctgcctggtcattccatcccaggggtgattaaccatcccagtgttagggcctgggactttgctaatgtgctttcaggtcaaccacaaacatatttctaagatttcttagctaatggtgcatttgcgaggtcattccaggctaagaccaggaggattaaaagatctgattccttcctgaggctcttagttgtaaaggaccaaagaagccgtaaaacaaagatttattcagtttcagccggccagttcaatggcgcagccccgtaagaccaggaaaaaagaaacatctggccagaaaagtacacttgtttaca

SEQ ID NO: 168994 - DNA, 217 bp, Homo sapiens
gagcagtccccaatttttaaatttaatcactcaagaacatagatcaacctgatcctgagctctagtgaggcagtaactcttcaaaaaatgtttgttctgcctttcttagtagatgactgctatggtgagaaaatcacctaaaatctgcaaatcctcaagttcccttaagtaaaaaatggccatgtttatcgttatactagttgttttctatttttcc

SEQ ID NO: 168995 - DNA, 506 bp, Homo sapiens
cccctattcccgccacagtaagcacagcactgcttgcaactagaacttcattcattaattttttacaaaagcaggtgagaaacataatagaggaaaatgtagtcctagcagcaacaacatgaaggctgaatgagtggctcccacagcacagccgaaacccacccctttaagtgacggagaagctgaggaacagctctaatccacggatcgccaggagacagcacagctggaaggacctgagccttgcccctgggcttctgccatctaaacataggaaacacttgtggctttccactaatgatgacactgaatccagtattcctcccactcctttttcaaaatagcagtgggtataaaaagtcaaagttgtgcagacaagtgagaaaaagaaacagacatccgcagaccctcaggcccattccaggcagaaccgcccgctccccacacccgctgctggggtccacactttctccttctcattcaggactcttgatcgcggggcctat

SEQ ID NO: 168996 - DNA, 199 bp, Homo sapiens
ggccatcaccagctataactaaacaatgataagaccatacctataactggcatttactattagactcaccataaactatgggcactgacactgacagctgtctctgggcacctccctcatcctgagctgacctggcaatgtccagatcactcccaagaatgtgactttaaatatcctgaccttgacaatcccaaggcct

SEQ ID NO: 168997 - DNA, 109 bp, Homo sapiens
cttggactttaaaagtcatgaccttattcccaggaaagcgctagcaactgaagagaacactcagaaagggcctcattaatcaaaaaaccttcatggaggacacctgtgg

SEQ ID NO: 168998 - DNA, 377 bp, Homo sapiens
tactctagaggatcccgacacttgaaacgtaagacagaggttgcagtgagaccagatcgtgccactgcactccagcctgggtgccagagcgagactccatctcaaaaaaaaaaattgagaatccaaagatggctgtaagctagatctttaaatacttgaaatatacttcgtaaagatcacagaaaaacactctctaaagagaggttacagaatgttcaaaagcccaggggtgggaaaatgctgggggaattcaaggaaattaaaggagactagtgtcactgtaacttagtactcaagaaataggaaaggcaggcaggagttagatcataaaggtcattatagtcttacgtttcagtgtcgggtcctctagacacccc

SEQ ID NO: 168999 - DNA, 287 bp, Homo sapiens
taggaggaactgtcttggctctgagttgggagacagcagagctaggattgcagctgatctgggtccccactccacagtctttggattatgccctgtgccctttgtaagaagagccaataagaagggctataggaaccatgtcataagagtaaccttcaaaggaataggaaggtttctcctggcgcagggaagtgttttaagaggtgagcatgagacttgacccagagtcttttaagtcccttacagtagacagtggtgggcctgtctggagctcattgctgtggatt

SEQ ID NO: 169000 - DNA, 232 bp, Homo sapiens
tccctataaaagagagagaacatagctatttcttccatctcttcccccttgacgggatgaggaagagctgggaaatagagatatgtcacccctaagcttttctctgctgctgtccctaacctcagtgccttggtacagtccagcagtggggcaccatcaacagaatttgtttttaaaaaacgtttagaaactttatttggaaataatattagtcttacatagaagttgcatt

SEQ ID NO: 169001 - DNA, 500 bp, Homo sapiens
aagactaaagattccttgaaactcgaaacctagcacctagcacagaacacaagcaagcgttcaaacattcgatcaaatataaaatacgcagtagttctaaagggtcatgcttttcactatattcactggcccctgctgtacaagtttgaaggggaaactcctccatttgcagaaaatggtaagaaaataggaaagcatttctgtttcactcacaactaagtcttttttctaaacctgtttgcctaagtttcaattttcttttatccataaaaagatggaagggaattaaatttgtagatgccaaatctggactacccgacctacttgatcccaatccaaaaaatctgttaggtctagagtaaggactgagaattagtaacattttttaaaattccttagatgattctgatgatcaacaatccattcacccaccaaatgttagggtacacactaagcagtttttattctaataaaactgatgtgtcatctgcctggctgac

SEQ ID NO: 169002 - DNA, 158 bp, Homo sapiens
ggtgaaacgcctgcttatgtctcccacccacttttctgctgtgctcttgtgctcttgtgagtctcagcactaatctctgtcaggggtgtgcatcttgaatagctgcttccagtttgtaactgacttttcacttcctttaagatgtctttctttttttc

SEQ ID NO: 169003 - DNA, 343 bp, Homo sapiens
gagaccaatatgccttgagttcgttctgtgtctaactagctgctttcagcaggggaaatacatgtgggacccttgtgctgtcagctagactgccaagcaggctgagccttctgggcaaaggaggcatgatgtgctgtcttcagtgcttggggtggctgatttacctcattgagtgccacgtcctaaaattccgtccaaattacgggaggattcttgaggcaacaggaaaactgtactgaattactcttcttgtaatgaaagcgtccttgttttccatttatcagctcctaaaaacatctactcctcaatgggacagaagcctagataaaaaattcagttgtat

SEQ ID NO: 169004 - DNA, 555 bp, Homo sapiens
ataaacctgttagtctttatctgaaggtaaatggtggtttatggatgcttctctttgggaagtgactgaccaaattcagaccctttgctgctttgtgttttctgacaggtgaggttctgaactaggttaattctctggcaaatccaagagtaggcattgtgttctctgtggtacccttaccatccttctagtcagcctcaggctctgtctcatttgctcatgcatgcacacatacactatgtgttaggaatgcctgtgtaccctggcttttaacagattacactgaaaaacacaaatctgagctgatttttacttagaaatagtttgccacaaattcagtttaagcaattaagcgttggagcttataattaaatgttgattttcccgtcttttggggaacataggtactgcttttaaaaaatgcactttgggccaggcatggtggcttgcacctgtaatcccagcattttgggaggctgaggctggtggatcacatgaggtcagcagttcgagaccagcctggccaaaaaggtgaaatcctgtctctactaaaaa

SEQ ID NO: 169005 - DNA, 950 bp, Homo sapiens
  misc_feature (744)..(744): n is a, c, g, or t
  misc_feature (749)..(749): n is a, c, g, or t
  misc_feature (753)..(754): n is a, c, g, or t
  misc_feature (758)..(758): n is a, c, g, or t
  misc_feature (762)..(762): n is a, c, g, or t
  misc_feature (765)..(765): n is a, c, g, or t
  misc_feature (772)..(772): n is a, c, g, or t
ctttctctgtgactagctggcagtgtcagctgtttgctctgagccaggctcccttgaggcacagcccatgcatcctctctcttcttcctcacagcagccctgtggtgggtgacttgcccaagatcactcaatttatcagtaatggagcttacttcatcagcttccttgcctgcttttataaattaggttctattggaatgtagccagccccgtctcaatcccctgggctaacaaaagaatcagaagaggctggccacaaaggttagccccaaaccctgcaatgccccttctgggagcttcattgaggtctagaatacagatttggaaaggcgctctatggggcactatgtaagaccatgctgccctgagcagtcactcccattgctttggggcatctgaagctctgacttccagtcagattcagtataaagaaaaatggcttggctgggcgcagtggctcatgactgtaatcccagcactttaggaggccgaggcgggcagatcatgaggtcaggagatcaagaccatcctggctaacatggtgaaacccggtctttactaaaaatacagaaaattagctgggcatggtggtgggcacctgtagtcccaactactcgggaggctgaggcaggagaatggcgtgaggcaggaggcggagcttgcagtgagccgagattgcaccactgcactccagcctgggcaccagagcgagactctctctcaaaaaaaaaaaaaacaaaaggngggcncgcnnaaanaacnccngaagggngccaagagtgtaaacagtacaccaacataacgtgtgacaagagtggtccccaatagagaagcgcgattaatacgcaaaggaacggaccgcgatgtacacagcacgcactggcaaacgtggagatgggaaacatgaggaaggacacctaccacggggggcacacaatggacaaatacca

SEQ ID NO: 169006 - DNA, 890 bp, Homo sapiens
  misc_feature (684)..(684): n is a, c, g, or t
  misc_feature (689)..(689): n is a, c, g, or t
  misc_feature (693)..(694): n is a, c, g, or t
  misc_feature (698)..(698): n is a, c, g, or t
  misc_feature (702)..(702): n is a, c, g, or t
  misc_feature (705)..(705): n is a, c, g, or t
  misc_feature (712)..(712): n is a, c, g, or t
agagagagagagagagagagagacttcctcacagcagccctgtggtgggtgacttgcccaagatcactcaatttatcagtaatggagcttacttcatcagcttccttgcctgcttttataaattaggttctattggaatgtagccagccccgtctcaatcccctgggctaacaaaagaatcagaagaggctggccacaaaggttagccccaaaccctgcaatgccccttctgggagcttcattgaggtctagaatacagatttggaaaggcgctctatggggcactatgtaagaccatgctgccctgagcagtcactcccattgctttggggcatctgaagctctgacttccagtcagattcagtataaagaaaaatggcttggctgggcgcagtggctcatgactgtaatcccagcactttaggaggccgaggcgggcagatcatgaggtcaggagatcaagaccatcctggctaacatggtgaaacccggtctttactaaaaatacagaaaattagctgggcatggtggtgggcacctgtagtcccaactactcgggaggctgaggcaggagaatggcgtgaggcaggaggcggagcttgcagtgagccgagattgcaccactgcactccagcctgggcaccagagcgagactctctctcaaaaaaaaaaaaaacaaaaggngggcncgcnnaaanaacnccngaagggngccaagagtgtaaacagtacaccaacataacgtgtgacaagagtggtccccaatagagaagcgcgattaatacgcaaaggaacggaccgcgatgtacacagcacgcactggcaaacgtggagatgggaaacatgaggaaggacacctaccacggggggcacacaatggacaaatacca

SEQ ID NO: 169007 - DNA, 201 bp, Homo sapiens
cctataccatttccaaattcttacacacatcacccttctcattagttctgcctgttttgcacttcaatacaatcaggaatatcctgtgaatttttagtaaactgcacttcatttatatttcagggaaagagaacactctcaaaaggtcctctattaaaagaggaaggaaatgagagaaccagggccaggaaacacagggcc

SEQ ID NO: 169008 - DNA, 500 bp, Homo sapiens
tgtctaacatcagcctggagaacaatgggtattccacagaatgtaaatgattgagggaataatgaaggagtgagccagttagtcagtgatttgtgtaacagagaggggaaagaagatcaaagttggcaacatgttatgatcatttaagaaaactatcttctcaactagtacagagaccagattaaaacatgaacaaagaagaaactattccttcctctactttctcttcctccttctcccagtgtacttatattccaaattggttttggctggagattctcggtttaggatcactagggaaatggaagacgctgcctaaggtaacgtgagagttaagcacgttctccttttgtctgttgtgaccctgactgtctaacaaacaaacgtgacttctgaagcctgatccgaaacaatcaggagctgagcgagaaaacaaaacagaggtctgaggcacagctcctgggcaggctctcccgcatcctgcagtaatgttagagata

SEQ ID NO: 169009 - DNA, 107 bp, Homo sapiens
cgacggaggactcaccataggcaagaatggggagttaataagaaggcaagagaagtagatgttagattataaagaaccttaaatccaagtgaaatgcttgaacttta

SEQ ID NO: 169010 - DNA, 568 bp, Homo sapiens
caactcatcaggaagcatgcagtgtcaagttttattagttgtgcctactttgaccatttgattaaagtggtgctgccagagagctccatagtaaaggtacatcttttcctttgcagtgccactttacctttcacgtgatatatgcaataagaacataatattaaaaatcatgtagattataactgctgttttaacatttttctaaaataaaacatacaattttagttcaggaaatgttaatcattatattgtcattaatcgccattgcattttctctttttttcaacagattattactatttttatttttgagatggagtcttattgtgttgttcaggctggactacaatggcacaatcatagctcactacttgggcttaagctatcttcccacctcagcctcctaagtagctagtactacaggtgtgtgccaccatgcccagctgttttcgtttgttctttttttttgtagagatgtagtcttcctatgttgcccaggctggtctttttagttttaaaaaaatcattttagcctagctttattgaatgcttactgtgtaccaggtgc

SEQ ID NO: 169011 - DNA, 362 bp, Homo sapiens
ttataaagttgttgtgaagattaaatgaaataatcaccttacataagctagttaatgtaggtgaattgccaagcataatgcctggtgaaagactgtgtgtgtgtgtgtgtgtgtacgcgcgagggtacattgctcacgttttctctccattcccacgaaagtattaacccagaagtatacaacttcacgcttcagttaccaccatcctcctcattacttttctggcctaaactctcttccagtgtagtctgttctctttgcccaactctcatatgaatcaactttaaagcactcatgcttattcccatcttctcctgactctccttacaggtttaatttgccttactcattttgctcttaat

SEQ ID NO: 169012 - DNA, 427 bp, Homo sapiens
cctgcagggctctttccactgcttcttctacttttatattttgcttagctcactaaatccagttcggctctaggtaaagctaaatccttctcccatgatctggattttcaggttccccagtgaggatatgtgtttggaggcagacttttccctctctcacacttttggaactgcagtggccagctgcttctttcaaagggtctgtgaattctttcagttttcctggtacgctcctgcagtgagtggttcttggagcaaaagttcacggtgtgagtctccacacgctgttctgtctgtccaagtgggagttccacattagtcctgtctcctatccgtcagattttaacgcttttgctcacttttgctttacatttgtgtggaatatcttttttcacccctttaccttgggtttattattattattatt

SEQ ID NO: 169013 - DNA, 400 bp, Homo sapiens
ggatggtgggaatgggccagaaagacagctatgttggggatgaggctcagagcatgcgagggatcctaactctcaaactaccccattgcacactgcatcaccaccaactgggatgacatggagaagatctggcaccactccttctacatatgagctgcgtgttgcaccttaagagcaccccaccctgctcacagaggctcccctaaattccatggccaacaggaagaggggtggcctgacctgtggatgccgaggaaacgtcggtgacaggaagacgggtggtgtcatctgtggtagctgaggaaaggccggtgacaggaagaggggtggcgtgacctgtggatactgaggaattgtcggtgacaggaagaggggtggcgtgaccggtggatgctgagga

SEQ ID NO: 169014 - DNA, 392 bp, Homo sapiens
tgagactacagcccaataaagcacatcccctaacctcaagatgtctacggtccgcggctgaaattctaaattatgggaaaaagaatcacgtcaaaacttaaactgtgcctgccagggccccacctccctcaccacgagggtctaatgatcagggtccacattctgtcccacgtgttacggacagttcaagggatcatttgtctcaaattcatgaaaaattctgccacaaagatcaatggataaaggacagttaattcttaaaggacactaagtatgtgacagacattactcacgcacttcattctcacaaccaccttccaaggcaagtgtccttagtccctcctagacactgagaagcagcggagcagagaccacgctgggcacacagtggg

SEQ ID NO: 169015 - DNA, 966 bp, Homo sapiens
tccctccagcaaagactgagtctagctgaaaaataagtgagttcatggaagaattcagaccaggaaatcatagggttttttgtttgtgtgtttttgttttcagttatcttggtgtttcacaagaattcatttgatattctgaatgaattggaaagttattcattatagtgactgctccactttaaatatggggacacatcccaaagagaagcattacaaacagaaatctgcccaacaaggatcatacattataaggatcttatattataataccatatttgtcctttccaaatcctgatgctgtgattacttgaggctaaatgggaacagcagaaagtgtttaaagatgggtcctactgggagtggtagctcacacttgtaatcccagcactttgggaggatgaggctggaggattgcttgagccctggagttccagacctcaagccagggcaacatagcgaaactccatctctacataaagtgaaaaaattagctgggtgtggtggtgtacacacgtggtcccagctacgtaggaggccaaggcgggaggatcgctcaaaccttaggaggttgaggctgcagtgagccatgttcacatcactgcacttcagcctgggtgacagagagcaagactctgtctcaaaataactaactaaataaataaaaataaagatgggtctcagggttccacaggggctgccatgacccatgacccatgactggaggagggggcttcttaggtcaggtactctgatgtaattcaaagaattacagaggcctcatccagttcattcagacctcacaatgaagctgcagaagtggccatttgatcagggagaactgtcggagcgtacaagacggtgaactgaatgaacgctgaggtttgactgcttattccttgatgaaccctgtgagtctttgcttccctgtgccttggtctgaacgtgggagagaaagaggtagcc

SEQ ID NO: 169016 - DNA, 560 bp, Homo sapiens
agtgccctgggttgaaggagtcttggtgagttaaacacccattattgtctttggctgtaaatgaactcaaggtcactaggaagtgagtggaaagtcagatgaactctgtctctcagaggcaggccaagggcaaagaaggcacagaagccacttcaaaactttcaggccttttgggaggaaagggtgggtatggaatgaggctgactttcaaagatgaagctgtgacagatcagaaatctgtatttttgagccagactatgtctgtgtctaggtttgcctttgtctttttgttgtcagaatttcattaaactaattattcattcatgtatgagtgtcttctacagccaggaactctttagacaagattctggccctgatgacacttacgttttagttgccaatacagataataaatataagaagtaaacaaaggccgggcatgctggctcacacctgtaatcccagcactttaggaggctgaggaggtcagatcatttgaggtcaggagttcaagaccagcctggccagtatggtgaaatcctgtctttactaaaaataca

SEQ ID NO: 169017 - DNA, 342 bp, Homo sapiens
tttttttcctctatatccttagtaaccggatctcctcgaattccgtgcacacgaagactcaggggagggggccgagtggacttcaccccgcatgagacgtctggcaaaataagaaggctctcgcaaaacctaacaaccaaatatgcaaagccccaaatgaaaaccaccacctcctcgaacctcagaggtctgggggcgtccggctggaactggggtttaaaaaaagaaaatgtttacaaagtataacaagatgtttgatgggtggaaaaatgtatccacgagttacatccccccgtttccttgcaaagccccgctggtcttcctctccttttcttctgccaa

SEQ ID NO: 169018 - DNA, 165 bp, Homo sapiens
agcacagtagttttcctccttaaaaacattgaaatttaacttttcactgtatgatcttttagttacttataacaaatttttggtttcccagggaaaatatttttttctgcttttacattttatagtcattcaacatagaatccaaaggagctctgaaaattcgaa

SEQ ID NO: 169019 - DNA, 440 bp, Homo sapiens
cagaaaccctcctcccctcccagcctcaggtgcctgcttcagaaaatgaagtagtaagtctgctggcctccgccatcttagtaaagtaacagtcccatgaaacaaagatgcagtcgggcactcactggagagttctgggcctctgcctcttatcagttggcgtttgggggcaagatggtaatgaagaaatgggtggtattacacagacaccatataaagtctccatctctggaaccacagtaatattgacatgccctcagtatcctggatctgaaatactatggcaacacaatgataaaaacataggcggtgatgaggatgataaaaacataggcagtgatgagggatcacctgtcactgaaggaattttcagaattggagcaaagtggttattatgtctgctaccccagaggaagcaaaccagaagatgcggaactttt

SEQ ID NO: 169020 - DNA, 613 bp, Homo sapiens
cagacatttctatatgctgctgatatgaatgcaaattggtataacctttctggaaaacacattggaaatgtataatcaagaggcttaccttcagtgattccttgactaggaatctagcctgaggaaataatagagagatggtccaatatttgtttttaagttactgattccctaattaaatttagtaacaaaaacttaaatacattgaaatttgcacaacaatgtgtgcaagggttaaatcagttgtggtttcattgtaaaatggaaatattaggcatctattaaaaataacatttttgaaaaatttagtggcatgaaaatatgattacaacataattgctgaatgaaaaaccgtaaggcacaaaatagtatgtaccatatggccagaaatttataaaataagccaactcaaaccaaatatttttctttaggaaaaaaaaatgaaaacggcctttgacaaatgtcttcttgattcttacacttagacaattacaatggtttcaaaggaaaataaaattcaaattaatataaatttttataaagctgcttcctttgccattgttagttactgtataaggcacttcaagagtctttttagacctgtttccttgaa

SEQ ID NO: 169021 - DNA, 139 bp, Homo sapiens
ccttctttgccagccaatgcaagttagtggattttctactctaaatattgcctgaagtagtagaaataaagtatccagaaatcagaactaacagcagccggatttacacacctcagttataacagcttatacacctcag

SEQ ID NO: 169022 - DNA, 262 bp, Homo sapiens
atccgccgatgctgcctacccgcttaaggtctggagatgcaatgtggaaatcagagccacatcccccctggccatgcctcactctctgcatacatgctgcatacttaggggtcccaacaccttttgtttctcctggaaaaaaaatgtgcagcatcccattcattgggccagagtctcacccaggataccagcagaatgggaaagcaagccccaaaaaacacacagaacagcacagccatgaaggggcaggaaggcatttcta

SEQ ID NO: 169023 - DNA, 480 bp, Homo sapiens
agtgctgagattacaggcatgagccactgtgcccggccccagcagaggagttttctacactgaggagaggattcttggagagctttagtcattacccaggaccccacaactaggaaatggaagagccaggttcaaacacaggctgtgtggccccaacgtgaattgtttaaaagctgaattatactttagtagaaataatacagtcagctgtcacctggcatgtcttcaactagaattctctatgaattgttgtgttactggactgccaagacaaatcttgtttataatacaaatcttcaagaaccgtcttaaccatccgaagattaaacagtgttcattgtggtttattaggtatactttatgatgttgagaaaaatgtttgttcataaatcaccaatggagtgactttttaatcctttttttgaggcataattaatgtttggtgacttttttaatgtgaatatttgaataccacatttc

SEQ ID NO: 169024 - DNA, 132 bp, Homo sapiens
tgatgctccccacttgtaatccagccagcaagccctgtctctccattcccaaggctgtgttcacagacagcattgacgaaaaccagccagttacccccaaacccctgctgcacagtatctgacagatatcag

SEQ ID NO: 169025 - DNA, 883 bp, Homo sapiens
  misc_feature (872)..(872): n is a, c, g, or t
ctaaacaaagccagtctgaagactgggagaagtgacagatcctaatacaaagccacaaggtgcatgaaaaaacaaggaaacatggctcaatcaaaggaataaactaaatctccagaaactggatctacaaagaggtatgtggacaacttgaaagagaattcaaaataattgtcataaagatgcccactgagctcaaagaaataacaaacgaacagaataaagtattaagaaagatacagaaaatataaaaaagaagttttggagctgaaaaagaaaataaactgcaaaactcactagagaagtttaatggcagacttgatattcagaagaaaacatcagcaaacttgaatatgagtcatgtgaaattatctgctagaggctcaaaatgaaaaaagaatgacaaagaataaagaaaacctaagggacatacaaggcaccatcaaatggaccaatatttgcattattgttgtttcagaaggggaagagagagagaatggggcagaaacattacttaataaaataatggctgaaaacttcccaaatgtaaggatggaaatggacatctagatttgagaaactctgcacgctccaactaagatgaattcaaagaaatacacaccaagcaacatcataatcaaattgtcaaaagtcaaagaaacattgaagcacagaagaaagcactgtgtgacagagataaacagatttcagaagaactcagaagaagatggtggttttaactggaaaactgcgtgattgttcgaaattctgttggaaatcccaaaaagggttaaagcaaaaaggaagaaagggaagaatataagggaaagaggggtaaaaaagggggaaggggggtgagtgaagtgaaacggttngaaataagaag

SEQ ID NO: 169026 - DNA, 494 bp, Homo sapiens
tggagcagcaggaagcactgttatgatgcaggagctcgcgaggcctcacccaggcccatgctccagatggtgtaagcctgtctggaggctctgggagggcctcctaatcatcagcatcacggctgtaagaacaaggaccaggtctcaggtcccaactcacacctggtgccctcaccacccgacagaagcctcctctggggccttccacggcactggacaaaggaaccatgatgagtgatttctgatatttaggtgaaatcagtttggaagatgtgtataacatttcagaaaaacatcggtcaggggcagagaaatagccaggggccaaaattgctacttatttaatttcttttagacagggtcttgctctgtcactcaggctggagtgcggtggtactaacatggctcacttcagccttaacctcttgagctggagtgatcctcccactgcaatctcctgggtagttggaactacaggtgtgcgccgccacgcc

SEQ ID NO: 169027 - DNA, 223 bp, Homo sapiens
acaactaatatgcaaaatgcaaactggctatcactaccattctgataatggaattagctgtcctacatacctgatgacctaatgcttaacctaatcttcctctttcccactttgatttggaaacttgttacaagagagttctttacctcaaagtcttaaggaattcaagacaagactagagtatgttaagataccacaaaaaaaaaaatatatatatatatag

SEQ ID NO: 169028 - DNA, 523 bp, Homo sapiens
tcaagatcattagtcattggggaaatgcaaatcaaaaccacaatgaaatacagcttcatacccactagaaatgggtataattatacaactatggctactaaaaaggatgagatggggaaatagcaagtgttggtgaagatgtcgagaaattcaaacctttgtacattcctggtgggaacgtaaaatggttcagcctctaaggaaaacaatttgttaattcctcagtaaattacatatagaattaccatataacccagcaatgtcacttctaagtatatatcccaaagaattggcaacaggtattttaacaaatacttgtacacgaattaatgttcatagcagccctatttgcaatagccaaaaggaggtggaaacatcccaagtgtccatcaattgatgagtgaaaaaaaccaaaatgtggcatatttattcaatagaatattattcagccataaaaaggaatgaagtactgatacactctacaacaaggattaacctcaaaggcaaataaaatgttcacttc

SEQ ID NO: 169029 - DNA, 319 bp, Homo sapiens
caattattcagacaacaagcatttgctatgcatttatggagctaatactgcaagctagacatactgtttttgcaatttctgagtaaagagaaaacagaaaaaagattcactttccacactcaaaagagctcatccactctggcaattgtattaaagaacggtaaaggttacagacttcagggtgagaaagatccgggtacaaatgccaactccaacttagccttggcatatccattaacctctctgagcctcaagttcctcaggaataaagtgggataataagatgacccacttttcggcactgctctgaggcctaacg

SEQ ID NO: 169030 - DNA, 359 bp, Homo sapiens
gatttttattacactcaaatggataccctgattgattatcagtcttacaaatgtttagcacatttctcacttctctaataatcagaataatctaattttcaatgtcatttaatgtactctattcaaggttataatagatcatatttctaataaaacacagcaattatgtaatgaataatacaggaggaccagcattcagattcccttgattttaaggcagtgccaagggaaggtcttagacaaacccatttctttaaatgtgatgcacattccaagtctttgcctgcattatagaggatgtttttttcctgctgatgatctgaatggaactttgccagaaaacttgacctcccccgaca

SEQ ID NO: 169031 - DNA, 386 bp, Homo sapiens
gaaattttattctacaaatactgttattaacataactttgcaaaactttttaaagatactaggtataatagatactatttattattgttcatctgttaatgttcatccagaatggtttttccagatcatacacttttgcttatggaaggacatatttttgtctaggttgccttcagttttctagcctaactttcttgaaactgtctgtagtctttgcctaggtttttctattttttttttttagaaataaaagttagatgagaggttttaatacagttttcttcctgcattaggcttttgttattaagccacacgcaaacagctatgagattttaaagcccatcagagataccacaccccaataccgcaattcctcatccggggag

SEQ ID NO: 169032 - DNA, 307 bp, Homo sapiens
agccttcccatccccccatgctacccctcccagttgtctggcacacgccatgcactcaaggcaagaaaccaacctgacctcttttaacctccccctcccaaaagtaaatcttgcccgctgagcaagtccattttaatgctaacctcccatccttgctagaaggaaagaggagggaaggcagataatcaggccactaacactgagtgtgaatattaggactttaaacctgttgaaggtaagacacaagctcttagtacaaaaagaaggccgacagagggcctgaccagaagcctgatttccaggctgc

SEQ ID NO: 169033 - DNA, 202 bp, Homo sapiens
atccagttcaacttcgtaaactctcatttttccaaaatccagaaaaacagcatagctcatttcttttcctgttcctgatattttttagtattagaagctaatgaaccgatgtaaccttttatcatctgaattcagcagtgaggcgtgtgtaaaccagtcactggtcataagcatctttagcttttttgaccacctctttgtt

SEQ ID NO: 169034 - DNA, 186 bp, Homo sapiens
tgtgcagtcactagattagtcttcttacaacacaaatccgatgattactttgccttaaaacttttcaatggctcaccattgcctataggataaagtttaaatttcttcatacatcatataaatgcctttacaatcaagtccttttctatccatacaaatttatctgcttacactctgaacttgaat

SEQ ID NO: 169035 - DNA, 534 bp, Homo sapiens
tagtcttaagttctcctagtttatgtaatgtgtcccagcaaagtattcctaaaagttgtatggacatcaaattttcaattcaacaaatactatataaaaagtcaccattataaaaaacataaaacataaatgatgacttagaaatggcccgtgtcttaagggagtcactatctaatgggacaaagacagacacatttcaaaagtaccacgacataaggtatacggggttaaattttttaaggataacatacaaaacacaaaaagaaaacaggaaagaagttcagtttcaactagcagtacaatctgtgaaaacttcatggaagagttaggatctggggatctgagttgaaccatgggagacgaataataagcccaagacaggtcaaaatgggaaagactttaaggcaaaggagaggctttagcaaaggtacaaaggcagataaacaaagactgtggagaacacctaatagttcagtagtccaatgtggttgaagcagtaacgatgtacattcaggagacacggttcaaaattta

SEQ ID NO: 169036 - DNA, 293 bp, Homo sapiens
agaaaacaaaaaaaaaaaatccagactaaattacaagggacttcaaagagtgtagcaattatgtcttccccttttatagagaagggggtgtgacattcctaaagccatgtcatccgactgtccactgctatgccctatttctgttgcccagaagggaccctcctgtttttgagactaagggctctgaaggaaatggaagccgggcacaccctgtgttctcaatgaacacaggctgactagactttggaatgggtaccaagcagagttcttgttgtttggtttaggggttttta

SEQ ID NO: 169037 - DNA, 392 bp, Homo sapiens
cccaaacacctcactttacagtcagagaaactgaggcccagagaagtaaaatgagttgctcaaggtctcagagagcaagaaatagagatgggacttgagcacctagatctctggtattgctgtcctgtagttcatggagctggcagatggatacatctgtgacctgggatgatggagagactgctggacccttcagaggatctcatctcaaggtggggtttatgtgtaaatgatatctgtgtgtttcattttcctttcataaactaatttaaaaatccttttggtatcaaattttaagccaaaaagtagtgagggggaacatgggtaggaatagcttacagcttgcctaacaaggttgttgactgcataagagtcaggagtgttggcgataa

SEQ ID NO: 169038 - DNA, 252 bp, Homo sapiens
cctacaggtagcacaaacataatagaaatgacaaggaagaagagaatttctagaaataatgatcaagagcatcggggatatttagcactaaaactagtgatccaagggacatgctggtaggaggtcatggggaaccatggagaatgtcagactgagatgggcagggatgagggcagagcaggagcagcacccaagatgtctacctcttaattccatcaaggagacaagagggactcgacagagccatcatgg

SEQ ID NO: 169039 - DNA, 242 bp, Homo sapiens
ggatttcccacattccttacactgataaggtctctctcctgtatgaattctctcgtgttttctgaggctggagctccggctgaaatctttcccgcattccctgcactcgtagggcctctttccggtgtggatcttttggtgttgcgtgagggctgagctctggcggaaggccttcccacactcccggcactcgtagggcttctccccggtgtggatgatctggtgcctgagcaggtgggagc

SEQ ID NO: 169040 - DNA, 489 bp, Homo sapiens
cgaaggaaatcctgtcatgtgtgacaacgtggatgaacccaaagtcattatgttaagtgaaacgacccaggcacagaaagacagatactgcatgtcactcatatgtggatctaaaactgtcacaactcacagaaacagagtaggacagtggttgccaggggctgggggaatgcagactgtggcgatgctgattaaaggtgtaacttcccgtcacaaggtgaagttctgaaggtctgataaacagcatggtggctagagttaatgttatagagcatggtggccagagttaacattatacagcatggtggctacagttaaaatcatacagtacggtggctatcattaatataacttgaaatttgcgaagagagtagaccttaggtgtctgtatctccaaaaaaaaaggataattgtatgaggtgatagatgtgtattaagttgattgtgtcatcagttcacaaaataaatcatcacgttgtacaccttaaa

SEQ ID NO: 169041 - DNA, 288 bp, Homo sapiens
atatcatcctccctctgttgctgctaatgttccccgtaaactaaattcagccccggtggtggagctaaggaaggtggtgagggcgcttccggcatcccttgcacggtcaggaagcccctgatctgtgctttgaacgcagagcatactgggttcagcatctacctagtcccggccatttatctggcaaggcggtatcacctaacctggctttgacccaaaaagaatgacattcttgtccaagccccagcctggacattgacttagtagcctcaaatgaggcctgggaca

SEQ ID NO: 169042 - DNA, 558 bp, Homo sapiens
agcttctcaaactacccatggcaggcacttagtcaatgaacagttgaacagttgaaagtccatcttacagagaggaaactgaggctcagaatggggcagtcaccggtccaaagccacacagtgggagagaagcagagcaaggcttcccctcaggactgcatcccctgaaaggtggccccctcgctgcaccatggggtgccaagtccgggagggggtgctcagggaccgcccaggactgtgcagatccgggctgagggcagggagggcccctgttcagtgaccgttccgtgccccatcctgatgggtgttcaccagcccaggggcaccctagagggcagaggggtgacctcacctgctcagagtcaccaggctgtgattccaggtcaggagggacagacagaagggccctgcagtcagccctgtgctgtctggggcctggagcagagtcctatctgcctgcacctcccggggtggcccagcgcagggtgtgtggcagcccctggagcccccaaacccagtttccatcctggctctgccaccttctgctgtgtggcctcg

SEQ ID NO: 169043 - DNA, 124 bp, Homo sapiens
acatgcagagccatttatattctggctctaactaacctttctagtctcatctccaagcatttcccacaaggtatgctattctcatgtttttcatggccgtgcctctgactatacaattttctct

SEQ ID NO: 169044 - DNA, 339 bp, Homo sapiens
tacaaatgaaaataatcgcactaagaaaccaagaaagcctatttttttgccattatatgtaaaatgctaattccataaattatctggaataaatgtacctacttgttaatataacgtttcttctaaacttttttttggcattaatggtaaggggaaagaaaaataaattgtcttttggaaagacactcagtaagttataagtgtcttttaaacagttcctctgtagaattaatcttttaaggtgggaattcagaatagtaccaaggtctaattattctgttgctcttaattagaaaatataatggtctgtgaggcactacaaattgaatctggaatgcg

SEQ ID NO: 169045 - DNA, 331 bp, Homo sapiens
acgctaaatgaactaagccagtcacaaaaagacaaatactgtaagacgacatgtgtatgaggtacccagagcagtcaaatacaaagggacagaaagtagaatggtggctgccaggtgatggcagtggtgggtggagaggggtgggggaaatgaagagttattgttcacagggtggagtttccactttgcaaaatgaaaaagttctgaggattgatgataacggttgtacaacaatgtcaatgaacttaatgccactgaacttgtaagttcacttaaagtacacttcacttaagtacaatttgtaagttgtacacttaaaaatggttataat

SEQ ID NO: 169046 - DNA, 224 bp, Homo sapiens
acagctaagcaagtaaccaagtcaggattcaaggccagacattcaaacttgagtatgctttcttaactgctgtggggtactgctgggacaggtagcttaagttctaggttcttctgtttttcttggttgtaaaatgggcataatcatattttactcagaaactaatggctcaggccgtgtgcggtggctcacacctgtaatcccaacactttgggaggccgagg

SEQ ID NO: 169047 - DNA, 112 bp, Homo sapiens
accaagccaacatgagcttccagcaaaagagcccagtgattgggaacaaattcaaaacagctttatttcattgacagacaggacctttttgttaaactgtggtttaaagacc

SEQ ID NO: 169048 - DNA, 182 bp, Homo sapiens
tccccgtacgcccaaataaaaggcgaattcaaaagggataatgttaaaaacttagtagcagtgagagaaggcaaccaatctcaagttccatatagtatacttagacagaaatgaagtaagataaaaaaagcagagctctggtgggagggagagtgggcttgtgtggattgggcgtacgggga

SEQ ID NO: 169049 - DNA, 284 bp, Homo sapiens
caggatgggtagcaccttctccgcaaagtgcaggggcgctctgcctcctccctctcgttgacctcaaagcaggtccaatagtccttctccctgatgcccacgttccggcgatccaggatctccagggtgagctcctcagcagtcatgggatcctgaggaccttaagccagattctgcccatccttcactcagaactgtccagtggcttcagtctcagagtagagacccaaattgtcatcacagcccacaaggcactctctctgtccctgcccccacctcctcca

SEQ ID NO: 169050 - DNA, 657 bp, Homo sapiens
ctcgagtgatccacctgcctcagcctcccaaagttctggaattacaggtgtgagccacctcgtgccagctgcttcttgctttctgaaattaaaatttaggccgggcacggtggctcacgcctgtaatcctagcactttgggaggccgaggcgggtggatcacctgaggtaaggagttcgagaccagcctggccaacgtggccaaaccgcgtctctactaaaaatacaaaattatagctgggattacaggcacgcaccaccacacccagctaacttttgtatttttagtagagagaggtttcaccatgttgaccaggctggtctcatcctgacctcaggcgatctacccacctcagccttcaaaagtgctgggattacaggcgtgacctactgcgcccagcctcgacctttcaaacatagcctaatctgaccacttctccccattcccattgtccccagcccatactagacgccatcttcttccacctggaccactacagtgacctcctcattgcgttcctagtgtctcccttcaatctcgtttattgtccatgcagcaggcagagagaatggcttgagcccgggaggcggaggtggcagtgagtggagatcatgccactgtactccagccggggcgacaagagtgagactccgtctt

SEQ ID NO: 169051 - DNA, 203 bp, Homo sapiens
ggccggcactctagtcaggagggagagtgtgatgaattgatgagagtggctacagacagtaagaggtgggtggattctagatatacagagaaaatacaaaaacacttagaagaagggagatgggttaggattatatgttacagagagcctgtaatctttaaggttgagtttcatcataacgaatttgttttgtcactgttttt

SEQ ID NO: 169052 - DNA, 838 bp, Homo sapiens
gggagtagtaacagagagataagagtcattagtctcacagaagcagaaattaaaatagcaatgagagctgagtaatgcctagtgttggtgggaatggtgatggtgggggtgctggaattgagtaaaagttttgtttagggagaactaatagttttagctatgcatgaagaaagactcttgaaaattctgtaatatataagaaaagtgtggtatacagctgatcttggttatgaaaatcccactagctggccgagtgaggtggctcatacctgtaatcccacactttgaaggctgagatgggaagatggcttgaggccaggagtttgtgaccagcctgggaaacacagtgagaccccatctctacaaaaaaaatacagtaattagctgagcatggtggtgcacacctgaagacccaactacttgagaggctgaggctggaggatcgcttgagcccaggaattccaggccagagcaagctatgattgtgccactgcactccagcctgggcaacagagtgagaccttgtctcaaaaaatgtacagaaataaaaaaagaaatttttaaaagaaaatcccactagaaaacacatttgacaagtaatttttatcaagtcactaaaccttcttgaaatagggcaagatcggtattattaaagaggaagagcttcccagttttgctctacatgtgggagaatgtggtggccaccaacatacttttattcaaacagtacactgggaagcaaaaagtttttgtaacacagacaagaaaatacacaacatcttatttattttagagatgtaatttcagcaaacacactcaataaaacacataatctcct

SEQ ID NO: 169053 - DNA, 835 bp, Homo sapiens
ctctggggagacgagggggaggaagtcaaagcaggggtagcatgcggtgtccatgtggcaggagatactgaagtatgtgtagttcaggaagtggtgatggtgggggtgctggaattgagtaaaagttttgtttagggagaactaatagttttagctatgcatgaagaaagactcttgaaaattctgtaatatataagaaaagtgtggtatacagctgatcttggttatgaaaatcccactagctggccgagtgaggtggctcatacctgtaatcccacactttgaaggctgagatgggaagatggcttgaggccaggagtttgtgaccagcctgggaaacacagtgagaccccatctctacaaaaaaaatacagtaattagctgagcatggtggtgcacacctgaagacccaactacttgagaggctgaggctggaggatcgcttgagcccaggaattccaggccagagcaagctatgattgtgccactgcactccagcctgggcaacagagtgagaccttgtctcaaaaaatgtacagaaataaaaaaagaaatttttaaaagaaaatcccactagaaaacacatttgacaagtaatttttatcaagtcactaaaccttcttgaaatagggcaagatcggtattattaaagaggaagagcttcccagttttgctctacatgtgggagaatgtggtggccaccaacatacttttattcaaacagtacactgggaagcaaaaagtttttgtaacacagacaagaaaatacacaacatcttatttattttagagatgtaatttcagcaaacacactcaataaaacacataatctcct

SEQ ID NO: 169054 - DNA, 403 bp, Homo sapiens
tggaaggggggagccttgtgggaggagcgagcactcagcaggagccacggctcagatctgactttcaaggccttgcctggagggagccggcagagtcaacatgtgacccctccccgctcccccagttgcctgctggagcatcttcttggctgcctggggcagaagctggaggccgagggagcctgttgatatgatccatcagtggacctggaggggcaaatggaagacattcagcaaaatcatttaccagcagcagaagggaaaaaaagcagtgatggtcacgatggtcccaatgaagatgctcttcgaagtgcagcaaacacccacattcatttaaagtggggctttactccacatgcctagattgtcctgagaagcagcaggaaaaatttggaaatggaag

SEQ ID NO: 169055 - DNA, 517 bp, Homo sapiens
cgaggggcccggggcgttccccgcggggcggggcgctcctgactgcggagcgccgtgggcaggggcgcaggtgagcagagcgagcggagctggccgcggccgtcctggcgcctccgccctcccggcgcccgcactgcgctgcaccccggcccggggggcgggcgagggctctgccccaccgcccgggggctgccaaggggagttggggcggcgacgtgggcgtcccgggactgtgcgcccgcacccgccccgacagggtgcgctgaggcgccggggccgccactggctgcgggcgctgggcgcggcagccgcgggagccgcaggtggttcccgggccggcccttttctcctccccctttcctttctttcgcctcccctccctctcgcccggtgtcggcggcacttccctcgcttcctcctccctctccaatccggagggagggaaggagcagccggcgctttcctgcccgcctgcaaacttcagcgggactcgcggctcccctcgccgccgcggccg

SEQ ID NO: 169056 - DNA, 439 bp, Homo sapiens
tacattaaagccagcttgtgcttacctccattctccattggactgcagatgggtacctggtctttgcatacagaaggtacccagtgaatgtccaatgaataagccacatactaactgtcttggagtgggacatcacaggagacaccctctccaaggcccagggagaggaacaggcttggtcaatgtcccttatagggtcaggggccaagttggggctgggcttggttcctggtctctcaggcaccattcctctgcctgccgagccatccctggaagtaagctggaggctggtctcagtggcacccctgccagctgccactgtactcctgtggatggacttaccaaggcccttccggagctcagaactgaagagactgagcaggagaaagggcagagggccagttctcaggaagcctttcaggaggagagttttggcctc

SEQ ID NO: 169057 - DNA, 482 bp, Homo sapiens
aaaagctgggaacccaccccctttcgattggcatctggagtgggagcagtcttatgggacagggcccttaacaagtgaggtctgtgctaactccagacagtactggaattgattgcatcgtaggacacccagttgtctgcagagaattggagaattgtgggaaaaaactccatgaatctggtgtcagatgtgaagtattgacaatggcgtaagttcagaaagaaaaactgatttttccccttaatctacgaaccagcaccttgctccaactctcacactcacatcctaaagtatggggctcagggagcttctagattgttgaacacaaccacatgctgggagtgtggtgcaccctaactccacagggcagaggctcctgtgcttggacccatctggacctcactgtgagcttggatgagtcacagattctcttgagtctcaagttctctatttgtaaaatgaagtgatggaattgatttctt

SEQ ID NO: 169058 - DNA, 177 bp, Homo sapiens
agataattgaggaaaataaaaacagacttattataaacaactaagaaagaccatctcttgctcacttgactgttcttgattcttgcaaaattctcattctaccagagcatctgtagtgtaatgagtatcttgactccagggtcaagtcatagcatccccattcagggttaaattttt

SEQ ID NO: 169059 - DNA, 732 bp, Homo sapiens
atgaggcccagagaagggcagtcttaggatgagaaccacatgggccagagccaggagggagccacacgtccaggaagtgacggccagggtgatgcagactctccaggtcatgatgacggagtatcggagagggtggcagatggccacgtaacgatcgtaggacatcagcaccagcaggagacattcgctgtgtccaaaactcaaacagagaaaggtctgcgtcatgcagccagcaaaggagatgggcttggctggatgcaggaggttcgccagcatctggggcaccgtgttgcgggtgtaggcgatgtcgacgacagccaggtgtgagaggaagaagtacatgggggtgtggagtctggagtccagtgagatgagccccaggatggccccgttccccagcagggtgaagatatagaacagggagaagagcccaaagaggagcatctgaatccttgggcccaggagaaatcccagtaggaggaactctgtgaccattgtctgattttcccccatttccctgtgaaaaagaaaaagatcacttaggaccagattgtcaaaaaacacctagacattattttatgaatttagtcatttttaaaagataaacttttaacattagtgattgagctacacattaagttaattactgattgtaagtatccagtgttatagaagggattgtgtcaccagtgataggatacatagagccattgacacatcatgggaagaaag

SEQ ID NO: 169060 - DNA, 466 bp, Homo sapiens
ctgtcctagcctattctttttttttttttgagacagagtcttgctctgtcacccaggctggagtgtggtggcatgatcttggctcactgcaacctccacctcctgtgttcaagtgattctcctgcctcagcctcccaagtagctgagattaggtgcgcaccaccatgcctggctaattttgtatttttagtagagacggggtttcaccatgctggccaggctggtctccaactcctgacatcaagtgatccacccgcctcagcctcccaaagttctgggattacaggcatgagccactgctcccgggccctgtcctgcctattcttgcttcctcttctttattcttcaaaggtgtttccttcgaatacatctcttgtcatctaatcctaagttgatgcctgcttcctggagatcttgagctaccataactgtgaagtttttttttaatcaccactttattgagata

SEQ ID NO: 169061 - DNA, 1509 bp, Homo sapiens
aacaacagtacagacgtttgggacctgtcagctggccccctttgtttttaaaacttacttcatttggagatgacagcacaatctgcccacatccacccttgatggctcccgcaccgacccttgccaaacttccctatgtgtctcttgggctggaatagagaagcttgggggaaaggggctgatcaggactggtgagagggccccccaggagagggcagaggtggttgtccccaccccttctgcagcagttgccccaggcacctgttcgacattggtgtctgagacagtgttgctactgctgagggaacatcaccctggctcacctccatctttcaaaatatggcaagctgcacaaatcgcggaggcctcccagagaaacacagctcctccaaggtgtcaagccacgcccaaatgatccaaaaagcagttgattttttagaccttttaatcggccacctgagcaaattctcaccagttatgatagttttccagtttagtcccttgggttttctagttagacagtcatctgcagataatgttcaatttttgtcctttgccccctccctcattctaccaagtggcacaggaaattggttggtttggtgatgctgtttagctttaatagaaacccccagcccctggaggggctggattcctttgggagcagtgttccattccattaagcttccttgcagggtggggcccactccatgaagacagcagtcatgccttaagaagcagagctaccttacgtgcctgcccaggctgttcctgcctaaatctccagccctgcatgccgtctcaagggtgggtcccagagagtttggagtgtaggattccctctgtgaaggaatcatctctacttctctgaggacaattagggtatccttggctgctttactgtggtggccgaagagctggaattgcctttgttgagagttgtgttcactatcagtggtcgtgtaccttctccacctgcccccaggaaaaagagtctcccccttaaatttcctggtaccccctcacctatgcctgaaagcatttcaccctctcaatgcctcacctttcccgttcgccagatggaaccatcagtattcctctcctggtaccgcaaggcctcctggatccaaagcaccatgtcagtattatttgttggtcctttttgtgcctttcttgacctggagggggaggcaggaggattgctgtcagcctagtttctttctgggaatatggctccctagtgttggaaagggcagtgcctcgtggacagatggtcatttagcctctggggtgaaatacttgcaataccaggtcactctgtggtccaaaaggtcacattcagttgtcatcaggcaactttaacccttagagtgcttcccttccattaagctgaaattgccccacggccatatccacccattgactctgccttcatcaaggaaggtgggaagtaaaacatcactttttacattaaaccaggatcaggaataaaatgttaccaaaaaaaaa

SEQ ID NO: 169062 - DNA, 477 bp, Homo sapiens
ctgggaggcggagcttgcagtgagccgagatcacgccactgcactccagcctgggcgacagaacgagactccatttcaaaaaaaaaaaaagaaaaagaaaaaagaaaaataacaactattatattagcatatgagaatgcctgtgatgtcaaaattacgaaatcatatcaattatttcctaaagactgtagagaaatgcatcctctgttacccacgggtatctctggatgtgggattatgcacttttcctcctgtactttctacctgtatttctggatttactacataatcagggagggaaaggctgggcacggtggctcacgcctgtaatcccagcactttgggaggccgaggtgggtggatcacctgagctcaggagttagaggtcagcctcggcaacatggtgagaccctgtctctactgaaaatacaaaaattagctgggcatggtggcacatgcctgtaatcccagctactt

SEQ ID NO: 169063 - DNA, 470 bp, Homo sapiens
gggaggaaaactagcttaaatctctcactcaacctgatttttgaattgccttctctttttatggtggagggcaagcaattcagatctctggattatgaattttgtgaaacccatgatagtactattacttgaagcctgtgttgaagatatgagttaatctttaatgtgctttgtgatatgtatttatttagtctcaaactaccaccaagtatcattgtaggcttgtttgcactggatttttagcttactctcattatacagagttattggatgtatttgtatttgaagctatatttgtagttatagcaagtgtactgcttatattgtagcattgtgtataaaaatctgatttagatttttggaatgctagtatctggaaaatacccttaaagtattttccagacagctgggccaagtatttcagtaattatgcttgttaacttttattatttatatctcttgtgtcttag

SEQ ID NO: 169064 - DNA, 479 bp, Homo sapiens
caggctgtactggaagcatggccctggcatgtgctcggcttctggggaggcctcagggagcttttgctcatggtggaagatgaagtgataacaggagtctcacatggtgggagcaggagcaagagatgggggtcggggagtagatgccacacacacttgacaacaaccacatctcgggagaactcactaccaagaaaactgcaccaagccatggaggatccgtccccatgacccaaacgtctcccaccaggccccacctccaacactggggataattcaatatgagacttgggtggggacaaatatcctaactatatcgggagtatccctcttctgcttttctatataaatatttctgaagggtaagaaatacctattctttgaatgtttcatggaaatttcccctaaatccacctgggtgtcaagtttttaaaaacggagctgaaattcatctaacagaatgaaccatgttgaagcag

SEQ ID NO: 169065 - DNA, 179 bp, Homo sapiens
gccacccagtctatgatgttgttttagcagcccaaactaagatatgctaagaccaatctttcacccagtggttttagtatccattaaacgctagactaaatcagctattatagtagaggctgcaaactggtcaatttaaagttccagtctggcactgtgtctcacccattatcctggtg

SEQ ID NO: 169066 - DNA, 347 bp, Homo sapiens
ttgttcctttggtggccactccccttctctgccattgaccttgggagggacagaatccaactaccgatgagagcctcccccatgatggagctgctgggagcaggctcagatccccatgtatgggaaggactttctctcacacactctgttattaggctctgatggaggagatgctctcggtggagggtggagttggagtatgaccatctgaattagaagacttggaaagggagtggccaccaaaggaacaaaggcccctattactgagcaccaacttcgtgctcagagcttctgtctcaccccaaactagagccttttcagagatgagcaaccagaaaaactatcac

SEQ ID NO: 169067 - DNA, 631 bp, Homo sapiens
ttcccagggtaactttctctttgctttcccgtcacccacacttgggtcactgctgctcagaggaggcacaggccccttgcgaggaggtgggagctgacacaacaaggcttgttggaggtggcctccattcctaactccctctgtcgcctgggtggggttgccgagcaaagggctcgtccgtattcatggacatttgtttgcaagctcaaaagctttactctgagttctgagtgcaaaggcaggtggtggtaatttttcttcaaacccagctttggactacaaccagttataaggtgctcactgcgtacaggcaccagagcagtcaatgaaaccgcgctggaaagcccctgcatcctcctcccgcccgttgaggcaagtgggggtgtggttcccggaccgagcctgtcagaatcccctgcagggcctagctgggccctccttccttctggggtagagtgaggagctgtatcttgcagggtcctgggtgacactgaactagaggccgtggcatttctagctcacagtgctggaatctctctgcagggatcctctctgaagactctggcagtcaagggaaggtgaagggggcacagaggaaacagcttttccaagtgtaaggagaagagcctgt

SEQ ID NO: 169068 - DNA, 368 bp, Homo sapiens
gagaaaaatggcctattccctccctttaaggaaactttccaaaagtatcacaaactctttctgcttatatctagagtgtagtcacatggccattcctagctggacggaagacgaggacactttgtgttttattccggatggccaagtgcctacctaaaaatgggggtagaggaggctttatcaccattgagaaagagacagaatcaggagaaggttagtggcttctgtcacacaagtccagacggttaagagcctatgacagtctctttgaaaagatccagtaaaaggctgtgaagattacaggatctgagagatgctggtcaggtgatttctggtgtagcagttaagctagatgctcgcttctcaag

SEQ ID NO: 169069 - DNA, 228 bp, Homo sapiens
atgcaattataccccaatacttaaacaagaaatagttgataaatgacagttaaatttcttggtggtgaggatttcacaggtagcacacttattcgtgcactcatggaggtgtgtacattaaacatgcacagctttttatatattaatcataccccaataaagtggtttaaattttttttttttttttttgagacagagtctcactctgtcgcccaggttgaagggcag

SEQ ID NO: 169070 - DNA, 323 bp, Homo sapiens
ttctatcagacattctaagaagaattggtaccaatccttttgacactattccgcaagacagagaaagaagtaaccctccctaattcattctatgaagccagcatcgccctaataccaaaaccaggaaaggacatacccaaaaaagaaaactacagactgatattcttgatgaaccagatgccaaaatcctttacaaaatactagctaaccgaatccaacaacatatcaaaaagataatccatcataatcaagtgggtttcatacaagggatgcagggatggtttaacatatgcaagtcaataaatgtgatatcccacataaac

SEQ ID NO: 169071 - DNA, 482 bp, Homo sapiens
cagaaaatgattatggagtggtcaaggcatcatcttgaagaggaagactggcgtatacttctgagtgaactggacaatggggcaaagcaggaaacacgtaatctgacttgcagtttaaaaagatgactggaagaattgaggcagatgcattcattaggatcctaaacaaagatggtggcagtgtagatagagaggagtacatgaatctaagagttatttatacagagtagggatgttgtggtgacaattatgacaggaaggaaggagttaaagatgattcccagacttcggctctaatgaccagcagaatagtcatacaggaggaatagagtggggagctatgaaaagatgaattctgcctgggacatgagctttaagtacgtaatggacattcagatgatatgaagatgttggctacctgagcttggaccccagaggaaatacacatacatatattatatatatgtttgtcggtcagtcta

SEQ ID NO: 169072 - DNA, 263 bp, Homo sapiens
attatcgcgaagcttttctctccctcgctgtctttctgtggtaaaatcacgtagccttagcatttttcgggagttgggtcaattctttgaggacagaacccctgcgttgtcactgtgtagcattgcagtaggtactcaatatatattcgatgaataaatgaaccaatagaaaaccgagtaagtctgtgaaagtttgctaaaaatgctacctggaaatgtcaaggtaacatttacatttgatttgtgtggagttcagtaatatt

SEQ ID NO: 169073 - DNA, 303 bp, Homo sapiens
tcaatctcctggtttctaacttttaaaccatttttagggaagcattatatgtgaaggtaggagatactccctacatacaaaatcatgttattaatgttgtgaattatgcatttcctttttagtattaggcaactttttttcatatatcaagttatcatgtacacttttcaaggttttttggattataaaatcttagttgaggtaatataaatagaaaactagatacagagtgcgtgtctggtttgtgttacctcagaagcaattgggctgtcacttagcctagcaaaaagtaaatttagttgt

SEQ ID NO: 169074 - DNA, 314 bp, Homo sapiens
ccatgagcccaccagagcacagtttgtcgctgtctcttttaaaaagtctaggattagagatactatggtaagggtgatgtgggagtatgcgatgtactgagagattgtacccagtggtggagtttgaaatacctctcatgtctgaagagcaagccataggtagttgccacagttcactagaaggaatttttgggtttcaggttgaactggtgatactgtaaagaacccacagtctttttccacaatgctgtctagacaagaagaaaatatttttaagtttctatgattttttattatagcctttttaaaaattg

SEQ ID NO: 169075 - DNA, 211 bp, Homo sapiens
tatcattgtctttagtattttacagtggcccctcagcacctcttagacccaacagcaaaggacttaaaataagcacaggaaaccttgctatggtgattagttttgatacctttgagacaattgagtctagcttcttagttgccccttatttatgttgaaatctggctcattcatatgatgttttactgtgctggccttgtaaagaatttta

SEQ ID NO: 169076 - DNA, 329 bp, Homo sapiens
cttactgctgaaacactaatacagccattaaaaaaaaaaatccccatccgtaatgcttaatacagactgctgggagggtgactccccatgcagccttccttgcactgatgtacaactgttccttttaaataaaaatatccggcgagccatggtgtctcacgcctgtaatcccagcagtttgggaggccaaggcgggtggatcacttgaggtcaggagttcaagaccagcctcaccaatatggtgaaacctcatctgtactaaaaatacaaaaattagccaggtgtggtggtgggcccctgtaatctcagctacttgggaggctgagcca

SEQ ID NO: 169077 - DNA, 863 bp, Homo sapiens
agaggttgcaatgagtcgagagcacactccatcctgggtgacagagtgagaccctgtctcaaaaaaaaaaaaaaaagcaaaagcagtcttttgtgtctcacaaagaacttcagataacatcagtaaaataatcataatagctagtggggacttactgtctgccagctatattctaagtcctttgtgtttattaattcatttaatcctgacaataacttgatgagggaggtggtattattacccttttgaacagatgcgaaaatgtaagcacagagatagatgttaaataacttacttaaagtcacacaacataaagtcaaatttcacttcaaggcctactgattcatatcttataaaaccactttctcggcattcagttttctcctcttcctaattctgataacctgtggctgctccagagcccatcaccctaattcttcttcagaaactcccctacttccagtttcttccagacacacagcctcaggaggctttctctttcttgcctcttgtcctaaggctgattcctggttggtatctctctcgtatctctcattttatacttttttggttgggggaaggctagggtctaatggaagaccatacggtggggaggggtcatggaacagagcccctgaatctctcccatttcaacttgctactttgagagtaaaaaaaagactaaatctccttggctgtgatcaggagatagtgtgttggctcccctgatactggaatccagtcccacttttgcagctcttaaatcttgctatctaaagccctcagttccaataaccagcttttctggtggtgcagcttcagagtttcaccaaatgcttagcaaggtagtgttctctttttat

SEQ ID NO: 169078 - DNA, 277 bp, Homo sapiens
tgaatgacatacaagcaaaccaaaatcctgaaactaataaacttagaggcaagagaaatagctgcttaatatgactactactgctgtagagtttctctgagaatttacttctgtgagcctattctttttttaaaatttctgcatatgtcagaccaatcagaccttcatttccttctgctccagagaaaaactggtctagggaaggagcagagatttcagtaaggtggacctaggttcaacttcccagctcataagttaagtaacctaactagtttat

SEQ ID NO: 169079 - DNA, 195 bp, Homo sapiens
ctgtgtatatatataataggattatatatatcctattagctctgtccctctaagagaaccctaatacatttgttctctttcttgagatttcttctaagtctcctgctctgaagctaaaacctcctgcagtctccctaaccataagaaagcaggcaaaaaccagagtgaggccaagaggaatgtgtgacactctcc

SEQ ID NO: 169080 - DNA, 716 bp, Homo sapiens
ttatggaccaaacaagtagaccacattatgaacttataacattgatttccattgcatgcggtatgacttcctctctccttttcccagcagaataaccaagttctctgtgctgattcataataaccaagttcactgtgctgattcatacttcccaactcttctgcagtaaagggatgctagaccagtgggaaatcagagctgaagtctatggctttgattggtgttttcatattccatctaaaacagggcattgctgatatggttccttgaaccaacattctttagtttcacattttggcagtgtaaagtgcagatcatcagtggaaagatctggtatgctgaaatatttcagggtcagcttgactgtggttattgctgttacataactttgataatatactcactgctcttcaagtgggtagctgggaaggtggggttggctgagctacttttcagtgctttgtacagactacacattttctcattaagtgcattttactggaaggaaacagactggaatttttggtgatggttctaatgaaccatgctctcctgggaaataattaaaaacaattaagagaaattatataatcattgaagtaggctccagatctcaaaagactggatttccttctttatagctgggtacagtgcttgttataaaactatggagaatttcagctagatgttgtatgggaagagggaggtagaaaagt

SEQ ID NO: 169081 - DNA, 484 bp, Homo sapiens
tttaatcatatgttctttgaggacaaatggaaggcctatagtgtttaattatttaaatttaaaaaaataaaacttctggaattgcccgggcaagatggccaaataggagcaactccagtctgcagctcccagcaagatcaatgcagaaggcaggtgatttctgaattcccaactgaggtacccagttcatctcactgggactggttagacagttggtgcagcccacagagggtaagcagaagcatggtagggtgtcacctcaccctggaagtgcaaggggtcagggaactcccttccctagccaagggaagccatgagggaccctgctgtgacggatggtgctgtccagcccagatactacacttttcccatggtcttcgcaaaccgcagactaggagattcccttgggtgcctacaccaccagggccctggctttcaggcacaaaactgggcggctatttgggcagacactgagctggctgca

SEQ ID NO: 169082 - DNA, 686 bp, Homo sapiens
atcctagcactttgggaggcagaggcgggcagatcactggaggccaggagttcaagagcagcctaaccaacatggtgaaacctccatctctactaaaaatacaaaaattagccgggcatggtggtgtatgcctgtaatcccagctactcagaaggctgaggcataagaattgcttgaaccccagaggtagaggttgcagcgagcccagattgtgccactgcactccaacctgggcaacagagtaagaccctgtgtcaaaaaaaagtaaaaaaaaaaatcactttcattaattactatagtccgaatgtgtcctccaaaatatatatgttgaaacttaatggccaatatgaaagtattaggcagtaggatgtttaggaaattattaagtcctgagggcagagccctcataagcaggactttggcccttataaaatggtgtaaaaggatgggttcactctcttccactcttctgtcgtatgagaacacctagacagtgccatccatgaacaatgaggctttaccagacaccgaatctgccagcaccttgatcttagactttccagcctttacaactatgagaacatgaatttcagtactttataaattacctagtctcaggtatattgttgtagcagcacaaacagactaagacattgacgttacgaaatcctacatctattgtaaga

SEQ ID NO: 169083 - DNA, 432 bp, Homo sapiens
ggacaaggcccttggggcctcccaagagggtctttctccactccctgttcctgagctggggctgggctctgagagatccaaggatctgcccagtttgagagctaaaagagaaagcgctcaccgttggggagagggcgctgggtggggctggggtgcctgggagtgtgacacagcctcttccccattcttgacctatggccccctccccacgcaagcctttcccacctccgcaccctcactcgggaggtgtcgccgctcaactggctggggcggactctcccaccacatggaacaccgacacagcccgcagcccctccctgcagccctcactgccccggcggaggaggggcacagaggcctctactctcatctaggtgagtccgaaacacgtgtggtcccgcccgtcccggccggaggggagcgggcagggcc

SEQ ID NO: 169084 - DNA, 380 bp, Homo sapiens
ggtagtcaccggcaggctccgaatggctccatcttacaccagacaccagctcccatgtgggaggcacacctcagtgcccagggaggtggctcagcacagtgtgtgtgggaggaaggtggggacacggggaacactgtagctgcagcaccgctggcttccaagcctggctctctaatcactagccatgggaccttaaccttccttgtctgtttcctcatctgtgaacggggcagtaacagtccgtgcctcctgatgtgagcaaggagtcaggcagccaagtgtgcagtgagggtttcatggccatttggtgaccaccatcgcagtggggaaggacagccaatagctccttttgcagatgaggaggctgagtgccccagaag

SEQ ID NO: 169085 - DNA, 328 bp, Homo sapiens
ctgttctagagtatcccccggagcatttctcaaactaaggaccaaggaccatctgaatcagaatatctgctatgcctgtgaggatgaccccagataaactacatcagaccctctcaggcagatccatagattctttcttctttttaagcaaataacccagggattcttatgttaaaacctttagaccaacctttctcaaactcttcgctctcatggcccctttatttattattttttaaatttaaaagaaataataagcaaaccgggtcaggtggctcaaaactgtaatcccagtactttgggaggctgaggcaggcagatctcctga

SEQ ID NO: 169086 - DNA, 184 bp, Homo sapiens
tattctaaccacatcttttccattgactgtccattccatttttatcatacatggtgtagtttctttacttgcttctctgttctttgatctttctcatgcattggccataacattgtgcatgtgtgtgggtggcctttttattaaaatataacacacatgcagaagagcgaataaatgtgtgccc

SEQ ID NO: 169087 - DNA, 544 bp, Homo sapiens
acttcaaacacccaccagctaagtcagtttattatgggttaagagccacacctatttgcttctcgtgttacaaccttccatctgattataagtaattcttctaccacttcacagtaactcaccagcagcaacctttctgacatccctttccacaagcaaaccagggctttttcaaagaaaatgccacatttattacagtatctatatatttcttaaccattcaacgtgtaaaactgttctatcatttttaccaggttccttttttaaatgtgtcactgataaagctttagagtgctgtaccccaaccccatttgtaagtcatttctactgcacgattctgcaaagcagtgatttttaggaacctgtatgttgctttacagcagaactgactgtataaattaacagttgtatgagaacttcttagaccttaagctagtctcactattccaattccaataatttactagagagaaaactgccttccccccaaaatttcacaaaatgtttacaacccatatcctagcaaaccatcaggatactggta

SEQ ID NO: 169088 - DNA, 401 bp, Homo sapiens
atttcaggcctgtgcttttgaatcggcaacagtgctctttctaaaggtaagaacatgagaaaaccttcaactctgggaggatgggaaagatcatgagtttggtggtagatatgtggatttgaggtctgtcacatgtgcaggagatgtcaagtgggcagttgaatattcttgtctggagctcacaggggagttctaggtaagaggtatgagagtggttcactatttgaagctgtgaatgtgcacgaggtcttccagggtaagagaggatagggtgagaagcagagggcctctgactgatagacagaggcaccttgagagacccagcttcaaaggatgggcaggacttccctgggcaggccacatacttggggctgtctgtggctgggatgattcgtttattc

SEQ ID NO: 169089 - DNA, 407 bp, Homo sapiens
ttatatttttagcagagacagggtttcaccatgttggccaggatggtctcaaactcctgacctcatgatccacctgccttggcctcctaaagtagagcctacttgtatattgctaagggcccagtgaagaagccagggatctgttaaatatctcacccatacatataacattacacatctgaggactgttatcaaatgaaatgatgtggttcagggagaccagtgagtgggatgtggctgctgagaatgaggtgcagggtgatgttacatatttttttcccaagaaagggatgtataggctgacagctaaagtgtcagtaggtgctcactagtttggaacagaagagaacattgtccatgcaaaggaacagctcgaatgaggctgtgggacaggagggagtgtcacg

SEQ ID NO: 169090 - DNA, 543 bp, Homo sapiens
cgtcggcctcccaaagtgctgggattacaggcgtgagccaccgcgcctggctgggaagtcttttttaatggcaataaccaaatgaactctcttgaccttgctgcctctgcaggcactgccccgccccggcccttccactctagaggaaagcacctggcatttagcatctttacacacaggaaacaacagatatgctcagggacttttcctctagcttgtaaccagggatggctgttgggcttggcagccgtcaggctgagagtgactcagcttaaaaggtttcattgttgatatctgccctgagcattcccctttggacttggagttccaggatgtcttgtgtctgtgcttcagcatctgaagccccttgttgcctgttcttaaggtagactgcattatcaacggtgtcttaaattaatagcttctctctactgactattcacttgtcacagctgacatgaaggttctcagtcctgagtgcctattaatgaagctcacagatagagtgcagaaaccctttgcaagatctgttttgccagcttg

SEQ ID NO: 169091 - DNA, 237 bp, Homo sapiens
atgtgggcataaacgtggtgacaaacgtaagagctcctaactatctatatctttaagtaatgtatgcttttaatttaagggaaaaatataactttgtaagaaatattataaatagcagaaagtttcctgatcaaaaaaggaatcttaacatggggtaaaacaattactaagacaaaaacctactgtatccaatataatataagagggtactgtaggtgtgttcttaaagtaataagt

SEQ ID NO: 169092 - DNA, 246 bp, Homo sapiens
acattgtactttttggtgtgggtcagtggcaggattggaactagtaattggatttccgcactcccagttcacttatctatccactacaaaacagcatgttaattttggaaatatttataccactaggtcatcatgacctttgaatataaccactggcaccaattatataccaggaatctccttatgcctcacctaactagagtcattgcccatggcagtatggacttcagatgccttctctcctgg

SEQ ID NO: 169093 - DNA, 405 bp, Homo sapiens
tgggcaaaagaggaagtaagtcaacatgatctgaacaggtttacattagtcaggatgtatctataaggttgaactatgtgaaactgccaatctaaaatatccaggtgatatttgatcagaggcagtggagaaagaagagcagtccaaggggataaattcagtttgtgtctagattcaggaagcagaagggtgaagtggagtcagtaaaatggttaagtgaaacagtctactgtagagatgggattctgacttaatttccttaatatcacagaaaaacatgggagagctcctgacttttatctccagtgttagcttcaaaatagatttcatatcttgagtatctctccaaaacctaagattcctgattctttattttgctccttcattatcctttaattaaatccc

SEQ ID NO: 169094 - DNA, 750 bp, Homo sapiens
ctaaagctaagattgcttaagtctcacttggttctagagttctatagttcagtaatggttcaaaacagttcaccatgtttagaatcaacattaggctgacagcaaatgcagctcatcatgcaaatggcatggcttgataatagaaatggctcatagaaaggaagttaggctagacaaggtgcagtgtacccacaatagccagccctatgcacaggtgttactactattgtccttattttctagaggagaactgaggcacaagggagttatgttatgtgcccaaggagcctgtgctcttaacaactacacttgccacaagccaatattggtcagacatattccagaaattttacaacacaaaaaaacataaataataactcttttttaaaacaaaaagtggagaaaaagaacaaaacagttaatagatgaggctgacattggagacagcggcttaggtgtgaaaaccctagaggtagacagacttctccccagtcatagaagttactggtccacctagatggtgctgaagggacaggtcttcctgaaacctgcagccctgaggaacagagcagacagcaaactcctgcagaaggtttgtttgcttgttttgttttctctcccaactcactagtcagatgtgccactctgggtaatgctgagtaaggagtagaagagaggccagagtgctcccatcatgggtgccagttggaaagaaaaaatcagaaatggagaagaaatgtcccatcctta

SEQ ID NO: 169095 - DNA, 275 bp, Homo sapiens
taacatagtaaaatgggagcatgaaaacaaccacaatttccatttcctcatcatttcttgctattggcaacttcttggatttttttatccaggatgaactaaggatctatttcacagaaattcttagtagcactctcattctctctatatcgttattatttttcttttaccatactctccagactaatcgcaagctccatgtgaatccagtctttctctctcttgtcttattatttccaggctggttagcgttactggggttgcgggagtgacaa

SEQ ID NO: 169096 - DNA, 465 bp, Homo sapiens
tgagctcatcggagtcactggtaaatatcagaacagaaggaaacaatggactgggatatttttaccacaagttctcagacctttataaagataccagcagtcacctgcttcaggctggcacaaaggtgatcagccaagccaggcttgtggggaatctgtgtgccccgagggggctcccctcccaggtaacaacattcgtcagaagcctgccatttctgaagcacttagccccacacatgcccttgaagactgacatgcagtcaacagaatctcattctccggaagctcgggttggcagcagcgagagcgaagctgcagggagcctgaggccagcagagggtgcggcgccttaccgggcctctgtctttgcagctacaggtttaccaggttcctcgccaagctcagtttttcgccttgaatatgaagatgctagaaagagctctgcatttaagcagagccttgtgc

SEQ ID NO: 169097 - DNA, 542 bp, Homo sapiens
ctatcaccatcattgacattgctgtcatcaccatcaccatcttcaacatcaccatcaccatcatgatctactgggtgcccaggaaggggtgagcagccatctggaggaatctaccttgatgatgaggtttggtatttttacagaacaggagaacataatttctagtagtagacatgccagggacattgaccatcagaggactgagtgttttcttttctaagctagcaaagaggaaaaaatttcctgatattagaattatctccacctctactctcccagaaggctgtacttgttaccttcaaaaagtaacccttgtctctctgaaatgttcccagataagacattatctcttcctcttccttcatttcatagcttctcactgtattttcacatggaatgtacacaattgtaggctggatattttcaggctataactctggcaacagtcttagttcttgaaacagcagatttacatcagatagacccaagcttgcccctctctctctctctgattcttattgaaatagcttttgcttccaaca

SEQ ID NO: 169098 - DNA, 363 bp, Homo sapiens
catgacaggactggaaccccaatgccaaataaaccccagtagattcggctaccggagagaaatacccaaacagagaaacatggggagatggaagggggcttcatgtggcccccagggaggggagggggcacacggatggcacaatcactaacacagatcacatcatgggactatcggggccccaggttctcccataacaggaaagtcaccaggacccgtcaagtggggtgctgctgtttctgtaacatgtctaacattgctctgatactccttccaaagagaaaacaggcttcaggctggcagccctccctggcagcagaggctcactaggctccaataacactttcttttcattgagcctga

SEQ ID NO: 169099 - DNA, 182 bp, Homo sapiens
gcagctgccccgtgtgtatcgactctgaggatcccagccgtggtatgcacacaacggggaagggtgcacacactcggccagatgctgcagcccaggcccagcgcggctcagaggcccagcctgcaactgacttgacctgggcctgggtgtcacttgttttggtcaagatttcccccactgca

SEQ ID NO: 169100 - DNA, 109 bp, Homo sapiens
accttggcctcccaaagcgttaggactacaggcatgagctactgcacctggccaattcaatgcttttccgtactgcacatatatgcacaaccatcaccacagtcagttt

SEQ ID NO: 169101 - DNA, 522 bp, Homo sapiens
gatattgtaatcttaatgtgtgacaatccaggattcaaatacaagtaggatttggaatggaatcatttataaaaggtgacaaaagtgccaaaattaatcagggaccctttggatattccagtgaatatggcacactgactagcccccaggattgttccagtctcttttgcaagagtgtcaatatagtgaggagaggtttccatagcttgtccaattctcccatgttaaaaaaaaactaataatatcttgactttatatggtatttttagtagacttttcattcaagtgtaatgtacaagaagaaaattatacaaattctaagtgtacagcttgttggattatcaccaaatgagcacacttgtataaccaataccttgtataaccaatactcagatgaaaaaatagaacatcacgaacatctcaaaagctccttttctgccacctatcaagaattaaccattttcttcttccccagaggaaactgtcgacgcggccgcgaatttagtagtagtaggcggccgc

SEQ ID NO: 169102 - DNA, 514 bp, Homo sapiens
ctagaggatccccacaccacctgagtctagtatattttattattctttttctaatttgagtccgatgcttaattcatatcttttgattctttcttcttaaataatgaaagcatttagagttctaaatttccttctctgtataatttgtagaaattacagaaattttaatttgtgatattgtattatcgttcatctctaaataaaagatgaatgattatatatgtagtttttctcatttgcctttcttctagaggtaaccttctattattgttatttatttatttttttagacggagtttcgctcgttgcccaggatggagtgcaatggcgtgatcttggctcaccacaacctccacttcccaggttcaagcgattctcatgccttagcctcccaagtagctgggattacaggcatgtgccaccacatctggctaattttgtatttttagtagagacagggtttctccatgttgatcaggctggtctcaaactcctgactcaggtggtgtggcgc

SEQ ID NO: 169103 - DNA, 256 bp, Homo sapiens
gacttgggtagggtgacagtggagagggaaagaagtatatgatttcaaggtggcagtaaaacaggactttataataaattgcatgtgtggggtgaggaatgggagggaagcaaatatgactcctgagtttttggcttgagcaactaagtgcacactggtaccatgggggagaggcaggttttgtagtttgagtcaagaattatgtattgaccatattatgttctgttgttttacagatgacagtaaagttcagttc

SEQ ID NO: 169104 - DNA, 432 bp, Homo sapiens
gccacagattccaccgtggctcctcctggaggaggagggagcgctggggaggcaccactggccacacaagccggaggtgagcagagacctggacgtgagtttggggcttgcaggggctgggctggcttggaggtgacatggcatttggctggggacaatcctcagataggggcagggccttcctgagcagggggcagatgtgcactaggctgtacacacttgcaccagggtcgtcagcctcctcactttcgtctcctgtctgagcatccttcgttccacagccagaggcacattcctggagtgcaaagtggatcagcactcatttactccaaatatcctgtgcactctagaatgtggggagtaaggttcaagtacttcagcccaggctagaggatttgcagccactgggcacagggccccctcacctcctgc

SEQ ID NO: 169105 - DNA, 650 bp, Homo sapiens
cgtcgtatgcttcctaccaagtttaatacagattttccctttagtcataaagccgtcttagaatgactccaggcagtaagaagtgagtcagaaatttatgtccagactgtgagattgttatgctctatggattcccctgccaccgctgtcactgggctagtgagcgtgtttattattgacttcacagtctcttttagtgactttgttcctataacttttctttactccagaattactctttctcttgcagtctttttcctatgcctcagaaaattcttattatttacttcgacattataagcatatttttactttctctatgagtatcttaaaacccactcatcctttcatagaaccatggaagtctgttataataaaacttactattccatagatttgcacacaatccagaacaatcacgctcctataaatcctattgagaagaacaacagggactccagtttttgcttcccatcactgctgggaggacaagcatttgagcatttctttgtcccagtttctactggagaaactgtgcaaggacatcaaaaaaatcttgtaggtcaccaattgtcattcctgttaaatgagtccatacatgtaaaaatattatcaaaagacctgtccacacttcatgctcaataaatttg

SEQ ID NO: 169106 - DNA, 218 bp, Homo sapiens
aagaaaagccttctcccagtaaaaatgtgtaaattatcagaattcatattggtaatattttaatacaaagcaatctgttttatccaactatggagggatataagaatcaatatattatggctttaggaaaaaattaccctgaggaccatccagcttttttgacagacacaataatttctgaaagatagcacttacgttctctttaatgttgttttaat

SEQ ID NO: 169107 - DNA, 235 bp, Homo sapiens
  misc_feature (31)..(31): n is a, c, g, or t
tcgaggattacggcaagctatccggttcaanacactgcgcctggccaaaaacttttctaaggttatacagctgaagagtatatttagcagagctgagatttgaacccaggtcatttggtttcagaattcatgttctgaattataggactattttgctctattcacagtgttagataaatgaggtatatctgtactccattttggctatgggactatgattgaaccggatagcatg

SEQ ID NO: 169108 - DNA, 556 bp, Homo sapiens
ttcaatgtgccatggttatcaatattctatgctgttctcctggtgaatggtttcagcagcagatttatttgaaaagattttagtttatttattactaaaaccatcttatggctactaagtaggagggatgggaaaagagaaatgaactttaaaataaaagaaagcaaaacaaaactaactactgttgcttattcatgtgtttttttctgtggtgtgttaacacttaaaaaggctattcatctgaatgtgtgtccactctaagggttggctcagaggacactgtcttcacagagctgatcttcacagtgatcaccacctctctgggacagcccagcccatgtactgcccaggctagtggggcaggcctctttcttaagacagtatctttatttgtaatcaacaggctgctccttttctcaagtctcctttttccctcaaccagcagtggaaactggccgagagatttaaggcacagtcatatatatacagacaatgtatttaaaacacaaaagagaatgataatgcaaaacactaacaactgtagtaaaactgcttt

SEQ ID NO: 169109 - DNA, 405 bp, Homo sapiens
aaaatttgcaaatcatgttcaaaaaatatagcaaaaaaaaaaagaaaagaaaagaaaaagaaaaaagaaagtgtgtctttgtgtatgagcacaaaggaaaagaaagaggacagagccattgagaccacctgttaatggctggtgccagcaaggtggtgcctccatggctgctcaatgttgatataatgttgatgtctctcaacttctcttgaagttgaaaattttcaaaataaaaatggggcaaaataccagagagaaaatttgcatttatttaaaaaacactgagcattggttgagagttttagaaccagaggacataaaggttcttgataacatatgtatttttcattcctcagatccctagccagtctatactcctttgttccagacacactgataagagaa

SEQ ID NO: 169110 - DNA, 376 bp, Homo sapiens
tagaaaaaatgacattgagagtctatggtagcttgtttctttgtgattttttgcaattttgtattttgagctcctcttcagaacttaatctgtgataattttgtgacacctgaactgggagtgtgtattcctccaggtaagatattgtttgcttcaggcaagcatcctgagacattatttatctactaatgatttaattccttatcttgggctttctcagaccccacaggtcatctaaagtttgatcttaaaacctgtagccttgaataccttttccccaaatccagataaataaagactaaaaagttttcttgatacttctcttttctaagagctacatattttctagatgctctctcctgcctcctgtcctgga

SEQ ID NO: 169111 - DNA, 430 bp, Homo sapiens
attcgaatatagggtctttaaagagataattaaggttaaatgaggttgttggtgtgggccctaatccaatctgactggtgtccttataagaagagaagactgggacacagacacacacagaaggatgaccctgtgaagacatagggagaagatggtgtctataagccaaggagagaggcatcgggagacatgtaccttgccaacaccttgatttcaaacttccagcctccagattgtgagagaatacatttctgtagtatgagccaccccccaatctacagtactttactatggcagccctagaaaactaacacagcacttcattccttttcatggctgactaatattccattgtatgttccactgatgcatgcaccacatcgcttatccgctcatccgttgatggacattggagtggtttccacctgtt

SEQ ID NO: 169112 - DNA, 204 bp, Homo sapiens
ttctattcccagaagttttgctcagcatgagaccttctttctagaaggaagccctgatgggtccagtctgagagctcacagcaggcaagagcattctagaaatgtcacaccttttttaccctagcctctgcgcatggcaaaacccttccaggtttagctctgctctcaagccagctttccattaaatatctgttgcctattttg

SEQ ID NO: 169113 - DNA, 183 bp, Homo sapiens
tgctaagatcgtgagccactgcactcggcccagcagtcaatatttgtaatagggattcactagtagtctgtgagcagctcagcaaccctatatgcaccccagagtgttaaggatgactggattcttctctgaggaggagaaaaggctatgtaggtacagtaggtatagtgggttcagaaaagc

SEQ ID NO: 169114 - DNA, 225 bp, Homo sapiens
agcctgttgccctctcttcaacgtaaacacccacgatcgtacccttgccacctcccccgtgggtcaggcgatcatcctctctccctgaaatcaggccagttgcttcctgattggactccagtcacttattccccacggtgtagccagagtctcctctcctgacactctccggggctcctgctcactcagaggagcccaaatctttctggccatccacagagtgtg

SEQ ID NO: 169115 - DNA, 446 bp, Homo sapiens
aaatgctgatgcagccttcacctgcgtttaatagagtatggcatctagaacaaagtgagtgggtgattctgcaaacctagaacacctggaaactggcaagtgcagaggtcatgtgagcctcaggcacagtttgaacaggactctagctctgtttttctgcagcacttcttgctctgcccttttttgtgcctgggcttcatccttggaatgttttacctcatgggccatgagacggctgcctgctgaaacccaaactatagatatccctgttcccatttaggggaaagagcctggtttgctatattctcataggcttggctgactgtatatttctgaaccagtcattgaagccaagagaatgggattatggtaatatgaaccactattctcctgaaactgaatttggacatagtcccatccaaacctcatggtactcacacagtgga

SEQ ID NO: 169116 - DNA, 1295 bp, Homo sapiens
ctttgccggtgtggctgttgtaggcactcacaccctgttggccacaaaggacattgtctgactctcccagttggctgggggccattagggctttgcttttctttgggttctagggatgccaaactctatggctgcaagaaccagtttcctatgccaggttaatgcccagcttaaactaatgggcagctctctaaagttgctgtgaatgtggatagaggaacagagccaaagatttccaggaaaaggttgtgggaaaaaatgatttcgtctaaattttgttccttttggacttcttttcttccattaagaaaactcattcccattgttgtctcccttttggaattgaggacccaagttgttatagaactgagcctgctttacaggaagatctttctgtgaggaattaggagttaggagagctgcttctacttgtgaccttttaagactagactctagaggacttccctccactaggcaacaaagttctttagtttgagagaggagttactcatgccttgtttattccagagtgttatatatacaggatggacatctctaaggagtgtttatcagaggagggataaagttggtagtaatatcacccaaagtggccacatcagaaaatccacttatatgtggaggtctaattataagtagtcccttagatgcatactgcgtcaaggtattttaactttattctcaaacttcctttattctctgaattattcaccaaatattgagagtttagtatgtgtcaggcattgttctggacaaatgggacaaaccagcgaacaaaacaaaaattgcagtcctcaagaattcaagtagggaaagcttatgttcctcatcaccttgttgtcaaaagactgggttccttttacttccattctgaactgccctcctctgcccccgcaaacagggttgattctttgcatggaaccataaacctcctgaagcctcatgaggcaatttatgtttgtagaggctgcagtttctgggttcttggcaatgattttttcctcctcactcttggatatctgtcaaacacatacttttgtgtttggctcctgtgaggactgtgggtttcttaaataaggccaggaaagaggtagcaaagcaacagccttgtctcagcacaagggatatcaatggtaagtaatgttgattagaaagtcaaggaatgtaggtcgggcgcagtggctcacacttgcactttgggaggcctaggtgggaggattgtttgagcctaggagttcaagaccagcctgaacaatacagtgacaccttttctctta

SEQ ID NO: 169117 - DNA, 596 bp, Homo sapiens
taccaagcagcattgatctgcaacctaccactataaattcagtttctagaatttgtaataataaacttttataatatgcctactgttgtttcattctctcaatatattttaggatcacctatgtagcaaaatcagtggttctttctattttattctattgtatggaaatactacaatatgtttatcctttagcctgttggtgaaccatttacaaatgtttctattccttgattattacaagtaaagctgctatgttcatttgtatgcacatgttttcatttctcttgagtaagtaagaatggaatattctaggtcaaattgtaagtgtatgtttaactgccaaactgcaatccaaactgattatccactttatactcccacctaaatatgataattcagggtgttgtatgtcctctcaaacattcagaattgacatttttttggatccattatagtttctgtgcagtgttattgcattttgatttttaagttccattcccaggtggttaatgatgcatttttcagtgtttatcaatcattcatatatctttggttattgtcatctactcaaatctcttgcccattttgttattgtg

SEQ ID NO: 169118 - DNA, 693 bp, Homo sapiens
  misc_feature (613)..(614): n is a, c, g, or t
  misc_feature (618)..(618): n is a, c, g, or t
  misc_feature (625)..(626): n is a, c, g, or t
  misc_feature (649)..(649): n is a, c, g, or t
agggctaggaggtgccttggacaaccccagtccctcatccagcataaatggggacaagagcatggtggggtcaggtgcagtgagagtggcagtgaggctgtaggcattggctgggacagggcaggggtcttcccttgcttcatggagccctgtgcccctccctctgtgatctgaggcaggagtgcacacagtcccccacgctgcttgtcctttgtcctgcgtggagggtggtggcagggcaggagtgctctgaggagctgtcccgcccccgtcctctggttctgtttgagtggaggggttgggcttcctgggctctggtcagtgcctcgatctcatccttcctgacctccagacacctgggaggatccttctcctgtgtcttcagcttttctgtcagctttttccaagcatttaaggattctctagttgaatccatccttaaaaaaaagaaggttctgcctggcctcctgctccccctggtgactgtccccttgccctgcgttcttgcctttcctgatcttctacgtgacctgtagctaaaccttccaccagcgcttgagaacttaatttgaactggatcctttcccagaccgctttcttcttctcctcctcnncctncaggtgnncaacagcccccttctcctccttncattccgtactccccggcgggtacgagctcgaatcgtatgtggt

SEQ ID NO: 169119 - DNA, 367 bp, Homo sapiens
cttgctcattttctccccttaccttattaaagtgtctgccttctgtgccaaaggggaagcagcacatttaaaggtaggacacattctgcttctttccctaagctagccttagaataaattcacttttcttttcctctttttttaaattctttgtaggtctcttatttaaaaatcaattggcaggcaggttagtatgttatagttccaagcttgaatattttcttaggcttagtgattctggggccctgagattaattttcctttcacagtattatgcatcctacagtaacacagctattttaaactttcctgcaattgttactaaatagcaggttagtgcccactgcttttagagtccaatttacaa

SEQ ID NO: 169120 - DNA, 219 bp, Homo sapiens
aatttcaaaataattgctttttatttaaaataagaaaaatcattaaacttcaaccaataacaggttaaagaatttaaaggtaaaagacatttcaactaattacaaatactttgtttttttttagttgggctacattttaccactctaggaatagctgttaattattttttatatagggtatttttatgtatttaatgttgacaactgacgtttccaata

SEQ ID NO: 169121 - DNA, 537 bp, Homo sapiens
tctcttacacactttacatttgctcatttaaataactggataagcaattactttcaggtcacaactatttttatactatatatgcctctggggggagccaagataaaaaattggttccaaaaaattctttgattatttgatcatctgttaccagttaggaactccatattttctgaaattgaacgaatgtgagaagtacctaaaaaaagcatctttgttatttttaaaagtcttaatttaagaggaaaagataggcatcaccaaggacagtagaggaaaaaataaggaaattttagtgcctaaagtagaacagtttgtagttgtaaaagttagctatgagtctttatgggccgggcgcggtggtgagattacatgcctgtaatctcagcactttgggaggccaaggcaggtgggatcacctgaggtcaggagttcaagaccagcctggccaacatggtgaaaccccgtctctactaaaaacacaaaaaattagctgggcatggtgacaggggcctgtaatcccagctactcaggaag

SEQ ID NO: 169122 - DNA, 628 bp, Homo sapiens
aatctgcctcactttttcacactttgctactctgccctgaccctgaattcacatagacccttttccatttctttcagcaccaagagaggcagtggggttgaggggaaagatctctgcttttggagctagatgaaacctgactctatcccttcttggctgtgtgaccttgggaaagtcatctgcctctctgagccttagtgtctcctttataaaacagggatataacagtatcaagatccaggattgttgggaggactgaatgttaatttatgcgctactttagcatcctactgggcatatagttggtccccacaaatgctgatgctttctatcattcattcattctcctccacaacctccccccagccaggtccatgggtcactgactttgttctctagttttctaggtaacgtttagaaaggcaggggacacaccaggtgcagtggctcacgcctgcaatcccaagactttgggaagccaaggcgggcggatcacatgaggtcaggagtccaagaccagcccggccaacacggcaaaacccagtccccaccaaaaatacagaaatagccgggcacgtggcgcgcacccgcagtcccagccactcgggataaggcggagaaccgtcga

SEQ ID NO: 169123 - DNA, 366 bp, Homo sapiens
cggggctacctacaaattttattagcaaagcagtttttattgttaaccatgagctaagatcactatataacagttcttaacaacgctactttttttttaaattcagtgtctgccaaaggtaattgctcagttataatcgtggtagtgaatagttactcttgatagtactacagtaacatctaatatcaacaagagtgaaaatctgtctcaaaacaaacaaacaaacaaacatgaggaactcctacaactcaatagtaaaacaaacccaaacccctgattcctggagatcctgattccataggtgtggtctctgcaagcaccaccaatacagcgagcaccaccaatacaggcagcaccaccaataca

SEQ ID NO: 169124 - DNA, 562 bp, Homo sapiens
taaaacctcagctgataaaagtataaaaataaagttaaaacatattaaagacaaaacccaagaatcagcttcctcttccttcattactcttgcatgggtgttggctctaatttctccatctagttaggcagtcctttgctttttattgcttgtttattgatgacatttgccatttgtagcaatagtaatagaatcatctatatatttgtggccttgttgaatgtagaaaaaggatagtggcattttctaattgtgtaaccctataacaccttgacgggggactacagttcatatgctggaccttttgtgtttgttcatggcgggtgggttgctttaatatacttagcacattgtcctaattgccatccttttggggagggctatatatccaagctaatatggtagcatttttgttttaacatagagctgacccaaggtagacgtaagtgttgttcatttttgcctaatactaataaaattacctaattgttgaagcttggagcttgaatctaggcattttatttcatttcaagtacaccctagtattttaaagcataaatat

SEQ ID NO: 169125 - DNA, 411 bp, Homo sapiens
catgtgacagtgtggcagtgtgtgtggcagtgtccatatggcagtgtgtcggtgtgttcatgtgtgtgatggtgtgtccatgtgacagtgtgatgtctcgtgtccctgtggtagtgtgacagtgtgtccatgtggtgatgtctccgtgtgtctgtgtccctgtgatagtgtggtggtgtgtcagtgtgatttctccatatgtctgtgtgtccgtccatgtgactatgccagtgtgctcgtgtgactgtgtgacggtgtctccatgtggtaatgtctccgtgtgtctgtacatgtgagtctggtcatgtgtccacgtggcggtgtgtccatgtaacaatgtggcggtgttccctccccggcttgcggagctagcatctttctctctcagcccaggacgcctgaagaggccgc

SEQ ID NO: 169126 - DNA, 207 bp, Homo sapiens
ctattgtattgactaggacaaataaaatgttgaatagaagtgggtgcaattgcctccattttcttttccaaatattaccagggaagctttcattcttttaccattaagtatgatgtagctgtagtattttattgatatgtattatcagggtgatgaaattttatttattccaagtttgctgagagttttcattatgaatactgttca

SEQ ID NO: 169127 - DNA, 552 bp, Homo sapiens
agccatgcaggactgtgagtcaattctacctcttctctttataaattacccagtctcaggtagttatttatagcagtgtgaaaacaaactaatacatgtatattttgctacaattaagtttttttaagtaggtgaagaggacttttgctttcagccatgatacagtaacaggaatcagatttattcccccaccttaaacagcttgaaaaccagacaaaatatgtgaagcagcgatttctgacactggaccaccggcagcacgggacagtgattcctgggtgaaggaaaacaaaagagtgtccagctcgctgccttgaaagagttcccaatccaggctgagggaagccagacagatcccagtgggcttgctgagttaacaagccagagtttagagtctgcggaggcccaggaggctaaagctagtggagaaaaatgccacagaagaggcagctgtggcagacagagcttcagggtcttttgctggtgggcagagtcacctaaccttcaggggcctcagtttcctcatctgtgaaacagagatggtaatatgcc

SEQ ID NO: 169128 - DNA, 454 bp, Homo sapiens
aatcacacaccctccctgtagccttcatcctccttccctcctttcttctctgtctgatatcctagatatttaattatttgttatttattgtctctttcctcctcctcaactgtcaagctccatgaggacagggactattgtcagttttgttcactgctgtatcacatctagaaaagtgcctggcacatagtagggggtcaataaatgtttgatgagtgaatgaataagtgtatatgaatgtttaagagcaggtgctctagactgaggtctcatctcagctcttctacttactttgtgatcttggaccctcttttgccttgatttaattaatcagtaaaaggagaatgacaacagtacctacctcataggattactgggggattaaataagatcatgcatataaagagcttaaaacagtgcctagcccccaggaactactcagctccacgctggc

SEQ ID NO: 169129 - DNA, 576 bp, Homo sapiens
tgtacaactgtgtctataaatggcactgccatccatgcagatgaaaaatcttcatcttctccctcatcagaaaaccctacagagccctctcatctctaatacacctaatctaaatgcctaatctctaatatactgatgtaaaatgtccttcccatccatcccctccttgtcactcccataacctactagttcaagccctcctcatctcctaccagaagtgttgtagtgtcagcctccttatgggagatagagcctccagaataattctcctcaaacacttgttgaatatcctaaaaacaagggctcccatccccccttcctgtgtatatgctgcatacacagaaaagttgagaacctctaatcttactgttcgaacatccttgcctggcacttcactcccgtaacctctcagcttacaagccaccccacactccatccacccttctagacatcccacatgcttaccagcctccttactactcctgaaaacactgtattttcacatctctctgccttcagctttctctctcttccactttgtccatccctgagggaaaattcagcctagtggttaag

SEQ ID NO: 169130 - DNA, 535 bp, Homo sapiens
tgtacaactgtgtctataaatggcactgccatccatgcagatgaaaaatcttcatcttctccctcatcagaaaaccctacagagccctctcatctctaatacacctaatctaaatgcctaatctctaatatactgatgtaaaatgtccttcccatccatcccctccttgtcactcccataacctactagttcaagccctcctcatctcctaccagaagtgttgtagtgtcagcctccttatgggagatagagcctccagaataattctcctcaaacacttgttgaatatcctaaaaacaagggctcccatccccccttcctgtgtatatgcgaacatccttgcctggcacttcactcccgtaacctctcagcttacaagccaccccacactccatccacccttctagacatcccacatgcttaccagcctccttactactcctgaaaacactgtattttcacatctctctgccttcagctttctctctcttccactttgtccatccctgagggaaaattcagcctagtggttaag

SEQ ID NO: 169131 - DNA, 595 bp, Homo sapiens
gccactgctcctggccactctcttgataattttttaaaaactattttgattttttttgtaaggatgaattcaaagttatatgaatactaaatcttacatcttgggatatttatcaaatgttattaaaatattctgtgtttatgatgctccctcttttcccttaggacaaatattctgtcttacacacacatagataaatatattttactgacttcactgtttttgacctgaacagtcttgctcctgtgaaggtttatcatcttttccttggaaatataaattacattcctcatagataggaccagaccaataaatgtttacttacgtgtgtctgagattgtttgtttgtttgtttgtttgtttatttgagacagggtctttctctgttgcccaggcaggagtgcagtggtgcaattatagctcagtgcagccttgaccttctgggctcaagtgattctcccacctcagcctcccaagtagctgggactacaggcgcgtgctaccacgcccagctaatttttgtatttttagtagagacagggtttcaccatgttggccaggatagtttcgatctcttgaccttgcgatccacccg

SEQ ID NO: 169132 - DNA, 609 bp, Homo sapiens
aatccactcaaagacaaattattctggaaagcttgaactaaacctggtcagatgcttctgagttatgagagagggattgaaataaactttttcagctaaaaataattttgctcacaagttaccaaaaatggctgactagaaatgcttttaagatacttgtctaagctaccataagctaaaggtcaagaaaaaagtttagaacacgctatgagaaacgattggctctactttgctaaagcttttgccaaacctcttattctgtaatgaccacatgagacaaaagctggtgaaagtggtatgccttagattcagtggggacctagagattttttcagtggaacacatgtgctgcctatctcttctgacgacgaactagtacctgtggaaggcactagggttaggtgaaaatgggacacttcattctgaagctgttatacaattgcctatgccaattaattatttaaagcttttatcttctgttgcagagcaatttttgccctcagaatatttgtcagtcctcacaaagtgccaagtgatgggtatttagcatgtggcattgccgtcagtgttctgtcattttgtttagacacttctttgcatctcactgaa

SEQ ID NO: 169133 - DNA, 281 bp, Homo sapiens
aaattaatatataacctcttttaattcaagtgaggaaactgaggcatacaaaggttaaataacttgtacaggtcatgcatatagtaagtgcagagctttagttatggctttaaaggggagatgagcaagcaagtaaccaagtagatggtgaatgggggaaaaaaaaaagttcacaaactgtgagctaacactagatctggctaaatttagggcataaaataaaaagaaaaaaaaataaaggcaaattatatgagacatttgaccacaattgtatgacaaag

SEQ ID NO: 169134 - DNA, 303 bp, Homo sapiens
actgccgtggatgcatgacttgggggaggcctgtgtgtgtgccattgtgtgtctgcgtgattgtgtgtctgtctagtgtgttatgaaggtgcatgagggattgtgtatataccttggtggctgtggcctatgtatgactctgtatgtgtgtgtctgtgtgtttgtgtgtgggtatgcatgaatgttggtgccactgtgagttcctgagaagagccactcagccactgctatgtcccacacgagaccgcacaaccccagcccagctccctgcttgcacaaccttgctcctgagactctattccc

SEQ ID NO: 169135 - DNA, 259 bp, Homo sapiens
ccagtagaaattgtggcagaaaaataattgttgaaaaattttgtagagtcacaacagaattaatgatcagaaaacaaaaatcagaaaactaaagacatttataaacattgagtcatgaaaaaataaaacaaaaaaagttgaaaaacatcaacacggaatatgtaactaatttattagatatgattaaggagaccaatgtattcatgaaaggagtctttgaagaagaatgcaggagaaaagtcacagagaggttatttga

SEQ ID NO: 169136 - DNA, 431 bp, Homo sapiens
gtcctttctaatctaaaagtccaggagacaatagtaggaatatgaacaatgactagatattcttccttttactttaaagaaaaaggaatgaaatgaaacacagttcacaccatttttcaattgttctaacttagtcttcagaagttcggaacagcaaccattgtcatgaaaatcttgtgaaaggaaaaatcactccaaggaaaaaagtggttatatagcctttctacactgagaacaaaaaggggaagggctaaggaagtaaaaggaaccaagatgtttttgttagataaataagggatatggatgtgaaggcattgaccctttaaacatattttgctctttttttttttttttttttttttgccaaaaaagtcacacatttatttttggtaaaagtcacatggtaaaatctttctttatgaaaagaggaa

SEQ ID NO: 169137 - DNA, 257 bp, Homo sapiens
gggtgttatagacgctgctgaacatgacaaatacattggtgaaccagacatggttcctccctcaaggaggaacagaaggagacacggaaataaaatctcacagactatcaggaaggagggtccaacagcccctgttcaaccaggtgtggtggctgatacctctaatcccagcattttgggaggctgaggcaggatgatcacttgagcccaggagttcaagaccagctagacaacatagcaagaccctgtctgtattt

SEQ ID NO: 169138 - DNA, 301 bp, Homo sapiens
attcttccctcagccaacattgcttaggcaattaactactgtgtactctgcaactgctaagccctggaagaatccaaaccgaaaacaaaacagtagtgatgtttggtctttggagtccgagacagctgagtttgaatcccagttctgccacttgccggctgggcaaaattatgttatctctctaagcctcagttttctcatttgtattgtagatttatatagaaaaaggtatttgtgttgtgtttgtgtgtgtgtgtttgcctgtatgtgtatatgtcatagtgttatggggaggattcaa

SEQ ID NO: 169139 - DNA, 364 bp, Homo sapiens
cttgttctccctcatcctgcaaactgtcttgagagctgtcttttgtcccaggctcagctgggtggtctgcctctgctcttcggccctaccttctgtgcaccccatcatggcacaattcatgctcaattcaaagcagggagcaaaatggaggcagccactgttgtgtgtctccactgctaaatgaggctctcccgagtgcaaggctgcaggggggctttgggagaactcttggtggaatgcgattaggcttacattctttactggcaattgcctcagagttttcctgttttttcccatagccctatgtggacactggaattatgaacctggtatttgatgcagtgacagaaatgtaactgttgac

SEQ ID NO: 169140 - DNA, 157 bp, Homo sapiens
atgtcctgcactgaaccaattgaataacacagcaaaagagccaccagtatctgacctggcttctacagaccaaataaaccctttgtatgtttgtttattttcatctgtaactttgtttgcttatttttcattctgatactttttagtaaaatgagta

SEQ ID NO: 169141 - DNA, 386 bp, Homo sapiens
aactgaggccgtggacatgtgcttaggaccagtcttaacaggtaactatacacaatctataagcagagcatagtgcaaactccagaggtactgatgatactaatttcttccaaatggtgaaatgccaagcaaactgcaagagatgaaaaggctgggtaaaagagagagagagagacagatgagctttgagatgaacaaatacagataatacagctggagaaaaagaaaacagattatggctaagtggcggggccctagagtaccatacgtgacctacgaaagagacaaccacagacaccatgagcactgagtctcacgacactccaggcgccattttaagttctttatgtgcattcacttaagactgtcctggtccgagctcgatc

SEQ ID NO: 169142 - DNA, 115 bp, Homo sapiens
gttcaggagcagctggatatccataggggaaagaaattaaccttaattccaaactcataccataacagaaaaattatatgaaacagaatttacacttaaacagacaagctgaaat

SEQ ID NO: 169143 - DNA, 457 bp, Homo sapiens
gccaggtgtggtggcacacccctgtagtcccagatactcgggaggctgcagtaggggagctgcttgaacccaggaggcgtgggttttaacctctcttttactattttaaattttgggtgctttttatgacagtttcctatggaggtaagatgaattaatgtagaatggtcttatgttgcctagttctaaggatgtttctcttttatcttcttttacgtctttaaatgtattatctttaagaaatattaaatggagtattaagagaggtatagaaatggattttctgacaaaataataaaatatgccatagtaggaaaaagtttccagaagacaagagtttgccagtcatcttgttgctgactgtggcagtccattccctcacttgaaaggatcttaaaaaaacatttgtgtatcacttcaaaatattgttttactgctaaacatcactcttaattta

SEQ ID NO: 169144 - DNA, 380 bp, Homo sapiens
ccattctcctgcctcagtctcccgagtagctgggactacaggcgcccgccaccacgcccggcttatttttttgtattttttttagtagagacggggtttcaccgtgttagccaggatggtctcgatctcctcatcttgtgatctgtccgcctcggcctcccaaagtgctgggattacaggcgtgagccaccacgcccggcccagtggaggcttttctactctgcctgatgattgagttcagttgcaatcttagcattcacgcggcaactcagactccagctatgaagcctggcctggcagtggatgaactttgtacttcagaaattggtttaggtacatttatagttgctattccgaagcccccagaacatgctgcgaga

SEQ ID NO: 169145 - DNA, 474 bp, Homo sapiens
gattgaagatgtccaacacaagagtttaaaattgcattccagtcctggaggctcacactgcttatagtattttgcagattattatttttaaattgcaattatctgataaacagcacatactagttgacatctttgtatttttggcatagctttttttttctatgtcataggattttcaaaaaatggaagtaactgatagcctctcttaacttatgaggttcctaggtaagataagcaatgcaaactaaaactaccatgaattacactgacacacccacaaaactggtaaaaatttaacatggagggcataccaaatattggtgagaatgtagagaactgcaaactctcatgtgattgttataagaatttaaattgcatatctacaactatctgatctttgacaaacctgacaaaaacaagcaatggggaaaggattccctatttaataaatggtgctgggaaaactggctagcc

SEQ ID NO: 169146 - DNA, 562 bp, Homo sapiens
gtaaaaaggttgaaagtttagactgggcacagtggctcatgcctgtaattccaacacttcgggagaccaaggcagacagatcacttgaggtcaggagttggagaccagcctggccaacatggcaaaaccccatctctactaaaaatacaaaaattagctgggtgtggtggtggtgcgtgcctgtaatcccagctactcaggagactgaggcaagagaatcgcttggacccgggaggtggaggttgcactgagccaagatcatgccactgcattccagcctgggcaacagagcaagactctgtctcaaaagaaaacgtgaaagtttagtactaggactattaaattgaataagtggttaataatcttcccattacaaaaatacatagtcagatgatttggcaggcttgtctaccaaactttcaagcaacaaatcatctgtttatacaaattcttctgggcattgaagaaagagggactacttcagctcatcttgagagggtaacgtaaccctgctaaatccagagacgcacattaccaaaacaaaatcacgggtctactacat

SEQ ID NO: 169147 - DNA, 375 bp, Homo sapiens
ctctggaggctcccagaacaagccagggacctaagtgaagacactcccaagaccagcacccatgccgcctgtcctgccctctctgaattggtggccagttcccctctccaccctgacacaagtgcaggccttgaagctgaagtctcctggccctactaaaatggttccttgtgtaggaatggtgaccctcaagagggaagcaatgcagattttgaaacttgacagaattaaagcaactgtaggtctttactacccgcctgaccagctacagagaaaagtggaagccaactgtgctctgcaaactgttctgtagtctggcagtctccttcctctccccctctgcctgctgtcctcaaaacttaagaatcagcagaa

SEQ ID NO: 169148 - DNA, 425 bp, Homo sapiens
cccaaacgcctcattcaatttaattccatatacttagcatattaggcatcttgtcaatatttcctttctgaggtctatttttaaaatttgaatgcattctgcatgtgtaggtttttttttttcttaaatgatgagatctactgcaacagagagccagaattagctctgtgcctaggagaaaaggaaagcacagagggaaagaatatttctcacattctcagaaggtgtatgcaagagccagcccttggcacaattatttatacagtgccactatatctatctgcgtgcaccttcccctccatttgggagcataggcatccagtattctccttgggttttcttagtttctgtcaccattaacccttctactcagggccctgcattcccagtctttcctcgtttcctactttccccataaaaaactt

SEQ ID NO: 169149 - DNA, 649 bp, Homo sapiens
cctcaatgtctcatctggacttcacaccccagggcctcctgaaacctgcacgataaggtcttcttagcggccaggctcctctgtggaggcccatcgaggtggatctgctgggtgaggggctcagccgagcaccctgggaaactcagttccaaggggctgatttcaaatccagaaaccaagtagcagaatcctgcgacttcaaaagccacaacaaggaagccccccgggaggagctgaaaccttgagtggagggaatcaggattggaaatgacctaagcacagggcggggcttcctcagtggcttcttaggtaggttttcggacctccctgcccactctgctgttccccagtgccggacacccaccacggatggagagcctcatttaactggacacccacaacaaagtgtgcaaaaccaaaaaggagcaggctccaaagacgttgctgcatttttccacgcaggccagccctggaatcggggagcatgcaagttaatggggcctcatccccccttctcccgcccaaccctgagattctcagggaggtccccaggagtgtccacttcaggagtggaggggtctagcccttaagagcaggagaatgagaagagagggccttcagcctgtcaagttttcttatactttactta

SEQ ID NO: 169150 - DNA, 199 bp, Homo sapiens
tgattgccatatgaaatgccgggagggcaggctgccttcttaattcatcctaccatttcagctcactccagtctgccttgtcttcagaatttttcaggggatggtgagaaagtgtttttgttcacatgtcccctaaattccaagggatatgtgtcaagccctccaaagaattttcaccttttttgctccagtggaacag

SEQ ID NO: 169151 - DNA, 480 bp, Homo sapiens
tctgctgatcaactcacgtatatacatagttgtgaatctgcgtattcatgagggataagaaaaatgtagacaaaatccaacatccttttatgataaaactcttaacaaattaggtgtaaagaagtgtacctcaacataataaaggccatataaaacaagcccacagccaacattatacccaatggcgaaaagttgaaagcttttcctttaagatcaggaacaggataaagatgctcgctgtcattacttttgtcctagccagagtaattaggcaaggataagaaataaaggcctcttaatcagaaaggaagaggtaaagttgtttctgtttatagatgacatgactttatatatagaaaaccttacaggctccacgaaaaaactgttagaactataaatgaattccagtaaagttgcaggctacagaatcaacatacaaaaacaattgtgtgtctatataccaacaacaaactctataaa

SEQ ID NO: 169152 - DNA, 367 bp, Homo sapiens
tcagactgtgagagctgggatacaggcactgccaccatgccggctaattttgtattttttagtagagacaggggtttcactacattggctaatttgtatttttagtagagacagggtttctccatgttggtcagactgatctcgagctcccgacctcaggtgatccgcccgcctcggcctcccaaagtgctgggattacaggtgtgaaccacccattcctggcctcattttaaccatttttaagtgtatagttctgtgccattaagtacattaatattgtgtgaccatcaccactatccattatcattaaacaataactcccattcctccctctcttagcctctgctgactactgttctgctttctg

SEQ ID NO: 169153 - DNA, 625 bp, Homo sapiens
cctgtattcagctcagacaccacacatcccagcaacagcagctcctcaatccctaagcacacacatgttgtcaacaaagcatgtgctagttgccattcccagaacaatacgggcctggccatcctctggaaaaaaaaaatacacattctttcctgaatactaccctacgaatacattatgccttgatcatagatcccaaacactatcagacaaaataggagacaagcattgcacacaccatatctaatcaactgggaaaaaagcatcactcaggtgttcctgagggtccacgggagatgcatgtaagggatacactatgataatgatgcttgaacacgggaacaatctgggggcaaaggcagactcacgcaggaacaccccgaaaacgtggatgtggaaagcacccttctccaaaggcacaagcacattcctttgattggcaaaagccatttctgacaatggatccgcggtgacaggggctgctcggcaatcaggaagtgagtgagtgtatgagtgtgtctgtgttgtgggggagggatgctctagttgtgatcaaagctggaccttttcagagaaggtctcgaatcctgaagacagacttcgaggtgaggcaggggcatttatc

SEQ ID NO: 169154 - DNA, 200 bp, Homo sapiens
ctctttgccagtgaaccattgctttatctcaggtggataaggcctgtgtaactcatcctcttgcccttttgacttggccaccaggggtgcacagtttggcactaaggccccggggaccctgagaagcaggaggagcttggtctgtttgttctcaaggagtctgatctggtgagagggaggcagatgggccactggtccca

SEQ ID NO: 169155 - DNA, 378 bp, Homo sapiens
ggtatatcaaaagccagagacactggtaccttgtattaaaaccctggatattgtgtgctggcacctgaaggaaggttgtttagaaaacttaaactgagagtaaaactcaaaccaagtgtttccgtgaacatttgtgtcttcttaatttgaaaaaggccatgtattaaaccagtgctcctgtcagtgtggaactttctggtttctcaagaagagtctcttaaattaagcactaagttaatattacacatttaaacattttcgctttcgaaaacatacattgttgtgaaagtaaaatattaaatgtagagagaaattatcacttacacgtgtaccttattttgtagactatagagtccatttgtgctattattattttca

SEQ ID NO: 169156 - DNA, 435 bp, Homo sapiens
ccatataagaggcaaatccaccaccacagttgctgtatttactattctttttttcacagacaggggttttgctctgttgcccagtccttggttctcatccttcacccactttccagacgctcttatctcaacaaaacttgaggctcagcccacaaaagttatgacactagctatcaaagcctcatccaagattgcccaggctgcagtgcaatggtgtgatcatagcgcactgtaacctcgaactccatcaggtccagtctttttgttttagagagactaaaacaaaaatacgtttttttaagagaaaaaaccccgatctcttaaatgatattttctcctgtataaaatgaatacattgttgctatattttttacattattattatattattgttttggaagtactgtactgaaaaataaaagaaagaaattaacc

SEQ ID NO: 169157 - DNA, 186 bp, Homo sapiens
aggtcaaggtcaagggggagtgtaaggtcaaggtgaagtgtgatgttgggtgagtggttcagcgaggttcctgaaaggtaccatcaggttgtaaccaacagcttggaaacatccatttgtagtcctcttggcaatcttagagtgaatagttgaaagtatgggttatagtctgttcagtggtgctta

SEQ ID NO: 169158 - DNA, 588 bp, Homo sapiens
atttattcctttattcattcattcactaaaatgtacactgagcacctactgtgtgctacgccctggggagtgctaagttcttaggtagacagcgatgaagacaagtataggattctggggattctgccatccttagaatgccaccgtgtagagtcatggtttataggggacacagacattaatcaaaccacttggcaagcagagaattataagccatgataaagagaatcacaggatgctttgagcacctatagaaaggccaggagacaggaagcccggctgaatgggaaggaccatgggaggtgcaggagccaggcatatacctggtagaacttggcttggtgcttatcttcctcctgaaacatgaccctagacccttgagaacgtcccttcctgtgccctatccctcattccccacaccgagaaaatctgccagcccctctgcatggcccctccctctctgaggatacccgggcatctctccttgcttcctgttgattggtggcaggaggttctagtgccccgcatggtcactgactgaagttttcaggccagctaaggggtggggcttcaggcttgtgcggccgc

SEQ ID NO: 169159 - DNA, 473 bp, Homo sapiens
ctgccccattaccttgtcacagtagccactggcttctctatatcacccatattagtcagtttctctcaactcaccagtgatgttctttttgggagctgtgatctcctccagttgaatctctttggagggactcacagtactgcaatcaggtttgttttatccaggacctcagttattatgaggattcatatcttctcacacagggctccttgggctgacacaaattacacaacttagccaggcagctgctccagtgtcctctgcttttcatgacaagtaagaagttcctaaaacattctatgccatctagaggctgctctgcccagagcatgcaagacagacccctaggacacttgcacaatctgattctgctccagctgatgtcatttcatacgcagagtgtgataaattccataaagaaagcaccccaaaggcatgataggaatgcagaagatgaagctgaattcgaggtt

SEQ ID NO: 169160 - DNA, 1379 bp, Homo sapiens
gccttataagtggtttagtgctcagttggctctagtaaccagaggacacagaaagtatcttttggaaagtttagccacctgtgctttctgactcagagtgcatgcaacagttagatcatgcaacagttagattatgtttagggttaggattttcaaagaatggaggttgctgcactcagaaaataattcagatcatgtttatgcattattaagttgtactgaattctttgcagcttaatgtgatatatgactatcttgaacaagagaaaaaactaggagatgtttctcctgaagagcttttggggttgggaactattcttttttaattgctgtactacttaacattgttctaattcagtagcttgaggaacaggaacattgttttctagagcaagataataaaggagatgggccatacaaatgttttctactttcgttgtgacaacattgattaggtgttgtcagtactataaatgcttgagatataatgaatccacagcattcaaggtcaggtctactcaaagtctcacatggaaaagtgagttctgcctttcctttgatcgagggtcaaaatacaaagacatttttgctagggcctacaaattgaatttaaaaactcactgcactgattcatctgagctttttggttagtattcatggctagagtgaacatagctttagtttttgctgttgtaaaagtgttttcataagttcactcaagaaaaatgcagctgttctgaactggaatttttcagcattctttagaattttaaatgagtagagagctcaacttttattcctagcatctgctttgactcatttctaggcagtgcttatgaagaaaaattaaagcacaaacattctggcattcaatcgttggcagattatcttctgatgacacagaatgaaagggcatctcagcctctctgaactttgtaaaaatctgtccccagttcttccatcggtgtagttgttgcatttgagtgaatactctcttgatttatgtattttatgtccagattcgccatttctgaaatccagatccaacacaagcagtcttgccgttagggcattttgaagcagatagtagagtaagaacttagtgactacagcttattcttctgtaacatatggtttcaaacatctttgccaaaagctaagcagtggtgaactgaaaagggcatattgccccaaggttacactgaagcagctcatagcaagttaaaatattgtgacagatttgaaatcatgtttgaatttcatagtaggaccagtacaagaatgtccctgctagtttctgtttgatgtttggttctggcggctcaggcattttgggaactgttgcacagggtggagtcaaaacaacctacatataaaaa

SEQ ID NO: 169161 - DNA, 520 bp, Homo sapiens
cagctctatggatcccctgagctagcgcccaccaccatgcccagctaatttttttgtatttttaggagagacggggtttcaccatgttggccaggctggtctggaactcctgacctcaagtgatccgcccgccttggcttcccaaagtgccaggattacaggtgtgagccactgcacctggcttgagcatatactttaatggggaagagttgacaaatgaaataatacctgccttccaaccccaaagttaatgtatctgttttttaggagaagcttccagaactatctactgccacagataactgtggtctgtattttcagtcccggatgttcctatttgaagcttttgtttttctcctaaataagcttaatatcttttgttgtgagactcagcttcattttccaagatggtggcaacgtttttcttgctaagactgtaattttgagagaccctttacaactaaacttctcaatcataagtacttttctagcacagtgctagttgctgtgtgagatataa

SEQ ID NO: 169162 - DNA, 499 bp, Homo sapiens
cattctctgacccaatacagcttaatattttcattcctggctccatcacaccacagtccattgaattaatccattttaaggctactcaaaaattggagctggtatttttcaaacattcaacgggtgaccatcaactaaacagctcaattacaacccctacttatacaatttttcttgttataagtaatttaggacctccatgggagaagggagaagggataatttattaaatggagttaataatagctactggtggtagtaaggaagctggaatccttgcaccaccaccaaaatagataaaagatttaaatgtaaatagtgaaaccaaaaagtcctggaagaaaacatggggaaatatttaagtcatctcagggaagggaaaatattaagaaaaaaagccaaaaaccaaaaaaaacataaaacctattagtcaaagaaatgtaaaatgagatcaatatttaatcatcaaacaagcaaaaataaaattatggtaagtagt

SEQ ID NO: 169163 - DNA, 438 bp, Homo sapiens
gacaagatttacagggctctgcttatttggatgaaaaatagagaaagacaagctgtcagtagaaggggaggggaaaatgggaagatttccttttctctttttttggttgaagtttagaagtgttttgaaatcatgattctttaaatgtttggtttttgaaaggaaggatttcaaagtgaaactcagcaattggcatgagacaagactcagtgtcaaggtggcaaaagttaggacagacagaggcagattggctgtggattattgtagggagggaagagtaagtcaagcctaaggcaggagatgactttctgaattacccaattaattccagaaacctgttggatgattataactcagagagcttgccatccatgctctgtatggaatactaaagtattgtgatgaatagaattttgttcaacaagcacattttggaaa

SEQ ID NO: 169164 - DNA, 764 bp, Homo sapiens
cgtcggcctcccaaagtgctgggattacaggcgtgagccaccgcgcctggctgggaagtcttttttaatggcaataaccaaatgaactctcttgaccttgctgcctctgcaggcactgccccgccccggcccttccactctagaggaaagcacctggcatttagcatctttacacacaggaaacaacagatatgctcagggacttttcctctagcttgtaaccagggatggctgttgggcttggcagccgtcaggctgagagtgactcagcttaaaaggtttcattgttgatatctgccctgagcattcccctttggacttggagttccaggatgtcttgtgtctgtgcttcagcatctgaagccccttgttgcctgttcttaaggtagactgcattatcaacggtgtcttaaattaatagcttctctctactgactattcacttgtcacagctgacatgaaggttctcagtcctgagtgcctattaatgaagctcacagatagagtgcagaaaccctttgcaagatctgttttgccagcttgctggtgtcctggcatgaaggtctccgaccgacgtctttgaaatagttcctggccgggtgcggtggctcacgcctggaatcccagcactttgggaggccaaggcgggcggatcacgaggtcaggagatggagaccatcctggctaagacggggaaacaccgtctctaataaaaatagaaaaaatagccgggcgtggtggcaggcgcctgtagtcccagctac

SEQ ID NO: 169165 - DNA, 703 bp, Homo sapiens
  misc_feature (616)..(616): n is a, c, g, or t
gtaggctgcgggctgtacatgagttgatcttattataaagtgaaagaaggaagatacgtagaatatccatggaatggttccatcctgccaacgcgatatgaacatctggtccagagcttcaagaagataacaaatgtatttcatctctaggcctctgtcaacttttcaaattttctaccactgttttcacaccaagaccaccataacagccttagcattatgcatttgcaacttgcgtacctccctgatgtttcccgtcccctctctccctttacagaagcaattacttgggccaggcacagtggctcacctattaatttatttattttgagacagagtctcactccatcacccgggctggagcgcaatagtgtgatctcgacttattgcaacctctgcctcccaaagtgctgggatcacactactacagccggctgaatatctttatatctaggtccttgtaaagctgtaggcactaaagaatatattcttaattctgctttactcttctttaggtctgtttcctgcagctctccaagctgcgcgcctctgcttctgttttctctccctgtgtttgcgcatcttctagctttgcttacgttgacttcctgcctgnccgttttatcactcagccacatctgctttaaattgctctttcctgtgttggcccaagcaacttttcctgtattcatttagttcctgg

SEQ ID NO: 169166 - DNA, 581 bp, Homo sapiens
tagcctattattgatttctagatgaaaagatcttttatctgagctatggagagtggaagaggacagggccgggagagtagatgaggaagtctttttcatctttcttcagtttttctctgggagactctgggaacagagctgaagtggtgcgaaagcaccttcacacttcctttgctgaggtgatccgctaattgcatgctatcaggaaatgtgtaagatgggagtgagatggtttcccagggggcccttcttcctgtgctccatcaagaaatacattttcacttgctggtgtctgagcagtgcctgtgtggctgctagagaatccttctggcttttctaagtgaatgcacctctctaagctgcaagctttctggatggccccaccctggtctcatccctgagaaatcttgtcattttttcccactggtatagttttcttctgcatgagtgatgcacatacactgcccggcccattagttgtaggcgtttgtggctcagtttgctccatttatttcttattttgttctcaggcatctttagggctgtgagctacagcttttctccttgagcatggatttgta

SEQ ID NO: 169167 - DNA, 351 bp, Homo sapiens
gaggtctgggaactagggtaagggacatgaagatggggcagatagcacccactagcaacccgcccccaaccccagcaacacactgaaactggctgccagacaacttcgcaaagattccctgttacggccaggacttgggcaaagagaaatggattggctggacagtcacccttcttcatacccagggccttctgggatcctgttcctttgaaccagcctttctggctgtcttatgtagaatattttcagggtcctagattggtgaacagttggaggtttcaggaaaacccgataaaaattctttattgggggaggggctcaaacaagaaaataatcaacaagtggtgtcca

SEQ ID NO: 169168 - DNA, 459 bp, Homo sapiens
ccttaatagaatttcagtttgaaattgatactaatacgttgtcagagttaccagctactagaatttggagaactgaaaaaaacagagcaatccttatgagttatatatgtattagcacaaaaataaccaattaaatatcactcaactaagaaaatctgacatttaaaaaataggaataattctctctttgtaattaataattgttatgaagaaaaattataatggttacaccctttcaaccagactcaaaacaccttgaagaggttacgaattctcagtacttttctaggtaatagtaaagattagtggcaattgtaaggaagataatgaattaaaatgttccatgtctagttaaggtcagggcagtaaaaataatggatgccaggatgctaatttctactggaataaatgaaaaatacaaagttctctgaggtgggagagctattttaaaaatcaata

SEQ ID NO: 169169 - DNA, 223 bp, Homo sapiens
accaactcactatctttgaaaggcagtttgggaatgttctccctccttttcttctctattcacacaccaaatactattttctccaaaccctcaaatgtccagtcatgctatcccaaactctccaatggcaccatccccaagcttgctgttccacgacacattgctctgtacttagtaattacccacccttcttttcctttcaataaaatgtccatttccttga

SEQ ID NO: 169170 - DNA, 263 bp, Homo sapiens
acatagaaagctgcaattatatgaagtttgtttttatatggtgagaattaaggctccaacttagttttcttacaaatagataattgcttcagtaccacttagtggaaaaatcatcttttctctattggtttgaaataccacatttatcctgtattattaatatcgtactctctacttttttaaattagcaacttacctacacttctctctcttctagattacaaaaattatatggacttaaggaaattcagggttccaattct

SEQ ID NO: 169171 - DNA, 301 bp, Homo sapiens
catgcaagccttcatagtggttgtctttatcaggttgatatgtagatttttgtcttttaaatttttctgtactgtcttaattatctattatggacagaaattatttttcaattctcagaaaatgtttagacgtaggggaactttttgcagctgtttttatttgagcagctacaaacaaaatgtaaatatttcacctaaaatgtatatttgttcacagtaaataaattgtgaaacttgattagaaatggaaccaagattcactaaattggtctcagcccattaactatgaggaagttacata

SEQ ID NO: 169172 - DNA, 189 bp, Homo sapiens
ttttttttttaacttaaaatcccatccattctttgaaaatcagtacaaatcccacctactttatggagtctccccatccactccagcccacaatgatcactgcttttctctgaatttctaaagcacttactggattgtataattatttaaatgtttcatctgtgtatatcttgtctttccaatgagatt

SEQ ID NO: 169173 - DNA, 374 bp, Homo sapiens
gtatggagtaggtggagaattgggtctaactagggctggcttttgtcgagtgagtgcagtgtatctagagtgggcaagagggtagccattcctctgcctcgaacccactgtcccagatatccacgcgaatccctccctcacaacccccaggtctccactcagcagtcatctccttgggatgtccttccttacacccttctctctatccctctccctacatgacacacagtgaacatctgtttcattacttgtttgctgtctgtcacctcactaggatgcagaccccacaaggccatggatctttgaccatttggttcattgctgtatcccaggaacctagaacagtgcctggcacatggtaggggcccccccaa

SEQ ID NO: 169174 - DNA, 307 bp, Homo sapiens
gaggctgggactttggttttggcctgagcaaagtggtaagagaagaaagagtgggaaggggacactggggagccaggtaaaatcaagggtttggttatggacttgttgaatttgaaatggctgggagataatctagcaaacttggagacaccccacccagatccccttcaaggagggacttgctcagctgtggggagtgaagttggtagatggcttccacctggccacaactggcctgcagaaagccactttgtctgaggtcacacccttcttaaggcagcttgcatccatgactgagcaagtcggg

SEQ ID NO: 169175 - DNA, 528 bp, Homo sapiens
gtacacctccttacctggaaaaccaggtgaagatgtacaacttaaatctgagatccttggtgctggtcagacccaagcagagaaattttcagcccatggaaaaggtctagacccatctgtatattcagcaaggatattttatctaacaaggctctttctggcatgacatgtgggattggtcaacaagaaataggaaacatgtaccactcacactgaagcatcacaaaccagtccaggcagataaacacgagtggggggtcacttgaacacagaagctctcaatcaagttggtgatctctggacagacgtggagaaactcctagttccacaaatatcctgattttctatagctgtgagcatgttctgggtcatgaataccccgatttaagagcttggtatgtatttgaaggtcaagaatgcttaactggaaattactgctatgcacagcaaatgcattataagcaaagaaagtgggtctgtgacaaattaatatcattgatactgtgcaaacccacaatgatcatttgt

SEQ ID NO: 169176 - DNA, 328 bp, Homo sapiens
cacctgagttcacccacactggtgagagacagtttcttgcacacagtctgcttcccgtattaagctccttttctctctgtttctctgcctgagcaaagggagggcgctcagcagcagtaggcagcatgttctttataaaagtataaaaatgtgtgcttgcaggggaaaggattaacactcctagaaggagcctcaacccataacccatgggagatgggagttgtgcattaaatgccccagccatgaagcttgctccttgctttcccaggtgattccagtgggatggagggagccccaggtgctcacattagtaaaccactcttcattc

SEQ ID NO: 169177 - DNA, 497 bp, Homo sapiens
agggcgggggcgtgcctcccagccaatcacaagccacgtagttgggcgcgcgctctctccatgacaacggcctggggttctgagagctcctccgggttctgctagctactcaagagttcgaaggcagaaaagaccgactcgcaagtcccctggaaaccgggaacgcaggggcgggacgagagagactggcagaggtctccacgtgcccaagtggtgcctcaaagcctcttcaaaccccgcgccccggtgggcaagaaggcactcctgggcttggagggcggaggatgaggcattcagcgggacctagtcctaacccagcctgggagagcatcagggacccgtcgttaacgtcaactgcctttcttgttgcctgctctatctttcatatccacgaggatcccattctccatgatgtgcttatttcacgttgcatgtctatcaaaacatctcatagaccccgtaaatatatacacctactgtatacccacaaaaattaa

SEQ ID NO: 169178 - DNA, 370 bp, Homo sapiens
tgggactaaccttgcagcctgcaggactatggcccagatgacctttccggagcaggggaagagttcacaggtctcagaccaggttgaccccgagccctctctttcctgcttcgcataggggcgggccaagggaggcagggacaatggcattcctgtttgcaggcctttgttcccgccaggagggcccccggagctaataaaaaggtttgtggctccgatgtctaagaggcagtggaggagttctttcaagcctgacattccaggcccagccggcctctggcatttcccagaaaaacttcgaggaggggaggggaaagaaaacacttgagtcgacgcggccgcgaatttagtagtagtagtaggcggccgc

SEQ ID NO: 169179 - DNA, 139 bp, Homo sapiens
ggtgatcccccagcctcggcatcccaaagtgctgggattgtaggcatgagccaccacacctggcctccgtaggttctgttttctgatttttttctgagtttcagagccctgcatcactgccaggtgagtgaaatgctgg
